United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 20

SEQ ID NO: 77086 - DNA, 654 bp, Triticum aestivum
  unsure (1)..(654): unsure at all n locations
  Clone ID: PAT_TA_77086
tcggcacgaggctcctctctcctttccccaacccaaaccaggnagcgccctccctcccccagccgcccgccccctccccacccaggaaaccagccatgaagggggccaaatccaagggcgccgtcaaggccgacaccaagttggcggtgaagagcaagggggcggagaagccggccgccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagtgctgctgctgctgccccaaagaaggcggcggccaaggaggtagaggaggacgatgaggaggaatccgacaagtccaagtcggagatcaatgatgacgatgacgatgagggtagcgacgaggacgaggacgatgacgagtgaagcggacaatgcgggagctgctgtgcgagaagcgacctgagctgtgtgcggtggtgtcataaggagcctatcc

SEQ ID NO: 77087 - DNA, 623 bp, Triticum aestivum
  unsure (1)..(623): unsure at all n locations
  Clone ID: PAT_TA_77087
gcaaaccaanctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgct

SEQ ID NO: 77088 - DNA, 647 bp, Triticum aestivum
  unsure (1)..(647): unsure at all n locations
  Clone ID: PAT_TA_77088
gcaggnaattcggcacgaggcccagctcagctcccacccactcccaaaccctctcgccggagccccagcaacccgccagcaagcaagatggacggcagcaaggcgaagaaggtggcggcgaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgcagcagaggtgctggagctggccgggaacgccgccaaggacaacaagaagagccgcatcgtgcccaggcacctgctgctggccatccgcaacgaccaggagctcgggaggctgctgtccggcgtcaccatcgcccacggcggcgtcatccccaacatcaacccggtgctgctccccaagaaggccgccgagaaggctgagaaggccgagaagaccgccaccaagtcgcccaagaaggccaccaagtcccccaagaaggccaccaaggcgtagatctggctccgagcgcccgtgccggtgaactggactgatggtgctccgtcagccctcgtgtgcctagtgtctctgtgttaagttagctgtgg

SEQ ID NO: 77089 - DNA, 528 bp, Triticum aestivum
  Clone ID: PAT_TA_77089
cacgaggcccaagtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggaaatgtgacagctggagcggatggtgttgctaacatcaatgttactgactgccatatcccccttactggaccaaattcaattgttggccgtgctgttgtcgtccacggtgacgctgatgatcttggcaagggtggacatgagcttagcaagagcactggaaacgctggtgcgcgtgttgct

SEQ ID NO: 77090 - DNA, 602 bp, Triticum aestivum
  Clone ID: PAT_TA_77090
cacgaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtcca

SEQ ID NO: 77091 - DNA, 710 bp, Triticum aestivum
  Clone ID: PAT_TA_77091
attcggcacgagggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagcttggagttctacatgaggaag

SEQ ID NO: 77092 - DNA, 637 bp, Triticum aestivum
  Clone ID: PAT_TA_77092
agcgccctccctccctccccacccagggaaacccaccagccatgaagggggccaaatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcggacaaaggcgggagcggctgctgcgcgagaaccgacgtgagctgtgtgcggtggtgtcataaggagcctgtcca

SEQ ID NO: 77093 - DNA, 595 bp, Triticum aestivum
  unsure (1)..(595): unsure at all n locations
  Clone ID: PAT_TA_77093
cgagggccagtagtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatt

SEQ ID NO: 77094 - DNA, 298 bp, Triticum aestivum
  Clone ID: PAT_TA_77094
atcgtctctcgtctcgtcgaggaatcaacaaccatgggcggtggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcacgccgaggcgaagcatccgaagagcgacctcgtccagtgcttcccccacctcaagccgtgatatctgccaaatcggacggagagagagagaa

SEQ ID NO: 77095 - DNA, 304 bp, Triticum aestivum
  unsure (1)..(304): unsure at all n locations
  Clone ID: PAT_TA_77095
cgtgctgggagctctactgcctcnagcatggcattcancctgatggccagatgcccggngacaagaccgntgggggaggtgatgatgctttcaacaccttcttcancgagactggtgctgggaagcacgtcccccgngctgtcttcgnagatctcgagcccactgtgattgatgaggngaggactggcgcttaccgncagctcttccaccctgagcagcttatcagtggcaaggaggatgcagccaacaactncgcccgtggtcattacaccatctggcaaggagattgntgatctctgncttg

SEQ ID NO: 77096 - DNA, 662 bp, Triticum aestivum
  unsure (1)..(662): unsure at all n locations
  Clone ID: PAT_TA_77096
ggcggcggcgaanatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctcaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagttcgaggccaagcgcgccaagagcaaggcaagcagggagaggaagattgccaggagggaggagagattggctcagggcccgagagatcatgcaccagcaccagcggctgcagctcccgctcaggcagcagcggcaccaaagaaggccaagaagtgaaggtctgacatgaagcttt

SEQ ID NO: 77097 - DNA, 446 bp, Triticum aestivum
  unsure (1)..(446): unsure at all n locations
  Clone ID: PAT_TA_77097
tcggcacgagggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatncccgacgcgctcaaggttctgaggctgcagcctgggcacaggtactgc

SEQ ID NO: 77098 - DNA, 411 bp, Triticum aestivum
  Clone ID: PAT_TA_77098
gcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgcgggcaccttcatggccaaccacttcgaccgccactactgcggcaagtgcggcctcacctacgtctacaaccagaaggcttagaggttgcttgcgattgctctgctcttttactctacctatcgagagtcgaactcacttagatgtgt

SEQ ID NO: 77099 - DNA, 492 bp, Triticum aestivum
  Clone ID: PAT_TA_77099
gggagagagctccagccatggtgcacgtcaacttctaccgcaactatggtaagacattcaagaaaccaaggcgtccttatgagaaggagcgtcttgatgcagaactgaagctggttggtgagtatggattgaggtgcaagcgtgagctctggagggttcagtatgcattgagcaggatccgtaatgctgcaagacacttgctcacactggatgagaagaatccccgccgtatctttgagggtgcggctcttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccgtcgttcatggtgagggttgaatctgagaagcacatcg

SEQ ID NO: 77100 - DNA, 379 bp, Triticum aestivum
  Clone ID: PAT_TA_77100
ttcggcacgaggccgccagcagctgcgcaaaggctccacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttatcggcagaaggtttgctgatgctcctgtccagagtgatattaagatgtggccg

SEQ ID NO: 77101 - DNA, 517 bp, Triticum aestivum
  Clone ID: PAT_TA_77101
agagaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaaggg

SEQ ID NO: 77102 - DNA, 571 bp, Triticum aestivum
  unsure (1)..(571): unsure at all n locations
  Clone ID: PAT_TA_77102
attcggcacgagggtagtnatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcc

SEQ ID NO: 77103 - DNA, 482 bp, Triticum aestivum
  unsure (1)..(482): unsure at all n locations
  Clone ID: PAT_TA_77103
gaggcgaatnnncagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggtttgctgctgctg

SEQ ID NO: 77104 - DNA, 588 bp, Triticum aestivum
  Clone ID: PAT_TA_77104
gggataaccgtagtaattctagagtctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagcaccgacctactcgacccttcggccggcatcgcgctcctagccttaattg

SEQ ID NO: 77105 - DNA, 521 bp, Triticum aestivum
  unsure (1)..(521): unsure at all n locations
  Clone ID: PAT_TA_77105
gggatgcggcgntcggcgatggcgctccgctcccggcggaccggtgcttcggccccactcaccgttgacgaacgttatccaatcaacattcagtgcaaacattggttcaagatggggaagtcttgcaagaactttcagtgcaaaaccacttggaaatgaggttattgggattgatttgggaacaacaaattcatgtgtttctgttatggagggaaagaatgcaaaagtgatagagaattcagaaggcactaggacgacaccatcagttgttgcctttagtcagaagggcgagcggcttgttggaactccagccaaacgtcaagcaattaccaatccacagaacaccttctttggtacaaagcgtatgatagggcgtcgctttgatgacccacagacgcagaaagagatgaaaatggttccatataaaattgtgaaggctccaaatggtgatgcttgggttgaaacaacagatggcaagcagtactcaccgagccagattggtgcatttgtattgaccaaga

SEQ ID NO: 77106 - DNA, 165 bp, Triticum aestivum
  unsure (1)..(165): unsure at all n locations
  Clone ID: PAT_TA_77106
catcgataccgtgaacactgaacaacgcctagctactgctaatctgaacatctgatcaagtggtgcgagctcgattcgcctcgccggagcctagcccccgaatncgtagagggtgcgtccctggcgcttgagggcgtagacgacgtccatggcggtgacggtttt

SEQ ID NO: 77107 - DNA, 737 bp, Triticum aestivum
  Clone ID: PAT_TA_77107
tgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtacttgccgtggcgggggtcacacttggccatcatagatgaaggctcaaaggcgctgttggtgatctcagcaacagacagctgctcatggtaggccttctcagctgagatcactggggcataggaggaaagcatgaagtggatcctcgggtagggca

SEQ ID NO: 77108 - DNA, 646 bp, Triticum aestivum
  Clone ID: PAT_TA_77108
tgcttatttataagttgagacaacttttcccaaacagtatgctcattgtggcagacgcagcaaaccacctagagctaatagtttattcagagagcaatagcctggccggctgcttcacagtaaccaaacgacaaaagacatacagtcagagcaaattccacagactgaacattcgacagcaaatcactcgcacagcaccacgccctcctccagagaatcctccgctcgccatgcgaggaggttggcgagcttgccttccttgaccagcgggtggctctccacagtctcggcctcgaagcagtggaagacggacctgggcgacccggcagagacagcaacctcttcgttcgcggcaaagctctggtagatgaggacgcctccacaggggagctcctgctccacaacgttgttgcagtcgtatgcctcggcgtcgagcttcttgccccaggtggcggcatggccgcggccaccgaagatggtgaccgccactgagaactctgaagggccaaagcaccggaggaccctcttgacgatgtcgccataggccagggccgaagcgtccatgcccatgacctcgtagctcgcgtaactgaagtcttgaagaacacagaggccttcttcttgtcgagcccagtcatgcacatct

SEQ ID NO: 77109 - DNA, 372 bp, Triticum aestivum
  unsure (1)..(372): unsure at all n locations
  Clone ID: PAT_TA_77109
gcatgcatattaacncaggtgcaaagcaggttcaaagatacaaggttcttacaacacaacaggttgtaaaacaaacaccacaaagcaaacgttcaaacagacagataacagataaagccactcgggcagatcataggatagcagtagcaagccttgggaaagcaccaggaggcaggcttaatactcatcgccctcatcaccgtcctcaccctcgtcgaactcagcaccaacttcttcatagtccttctccagggcagcgagatcctcacgggcctcagagaactctccctcctccatgccctcaccgacgtaccagtggacgaaggcacgcttggcgtacatcaggtcaaacttgtggtcgatgcgggagaa

SEQ ID NO: 77110 - DNA, 516 bp, Triticum aestivum
  unsure (1)..(516): unsure at all n locations
  Clone ID: PAT_TA_77110
cacgnttactcattacaaagncaaatcccacaattatcagnaaagttttcaagacactcaacatctgatagttaccgacacaacattggnagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcag

SEQ ID NO: 77111 - DNA, 331 bp, Triticum aestivum
  unsure (1)..(331): unsure at all n locations
  Clone ID: PAT_TA_77111
aggtcaggtgcgtacataaaggccctcgatcaggttgcggttacatggtatggtagtagtagatcgatatgatcgatgatgcacgcacggcacggtgcatgcatgatcgatgatggatctagcagctgcagcaggagcagccgcagctggtgccgcacttgcactgggtgcagccgcagccgccgttctcggccgccatctccatcccgccggagctngncttgtgggtggnggtggcggagacgaggagggtggcgccggcggcctcaacctcggngtacatgttgcagccgccgcagccgttgccncacttgcaggcggtgccncagcc

SEQ ID NO: 77112 - DNA, 545 bp, Triticum aestivum
  unsure (1)..(545): unsure at all n locations
  Clone ID: PAT_TA_77112
cacaattatcagnaagttttcgagnacacttaacatctgatagttactgacaccaacattggagagtcgactgacaaccatacatagagcagagcaaaaatactgacgaccccaaagattttagcatactgtgccattagcacttgacctctttcagcccatgtgcaaagtacaggaaagttggatcagcagctccctccttgtagtacgcgaacaccacgccgccatcatcatgcatgctctcgccaacaaagaactgaaggtccttgagcttgctaagaagatacttcgtggcagactcaacattcttcttgaaaacatctaggtcatccccttcaagcttggcagtgaggttcttgatgtagcgcttcatgtgagagataaactgcttcttgtcaaaagcaggttgctcctgaagacggaaggtgtcaacaatgtcaaccaccttcacggcctggtcatcgacaccctcatcgtcaccaccaccctcagcagagggattggctccaatgtccacatcaactgctccttgaacgacccaatgg

SEQ ID NO: 77113 - DNA, 542 bp, Triticum aestivum
  unsure (1)..(542): unsure at all n locations
  Clone ID: PAT_TA_77113
caacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttnccagagcacgccgttctncag

SEQ ID NO: 77114 - DNA, 426 bp, Triticum aestivum
  unsure (1)..(426): unsure at all n locations
  Clone ID: PAT_TA_77114
ataatttggattgatntgaacggggcacagaagtacaagacttggttttgaagacttggcctcatacaaatgcatttctaaatgctgtcacggcgcttctccaggaagcgctgaagggagtgtctcctggcgatgggaagatcagcctgaagcttgcaaatcgagccaggatccgcgacagcctgaggttgtccatttgctacagaagtgctctggagtgagagcgaccgcgtaagcatggcttggatagcattggtcgcagacatcgctggaggcttaacagcagtggtgccattgctttttgaggccgcagctgctgctgctgcaatgagcatgattgcttgagccttctctggtggcactgagtcatacacacatactgacccaccataaaaaatggtaagctgtccccggatttgctggagg

SEQ ID NO: 77115 - DNA, 318 bp, Triticum aestivum
  unsure (1)..(318): unsure at all n locations
  Clone ID: PAT_TA_77115
tcggcacccctaacaacggaggaacacgcgggatagatcagccgccgaatccgtagagggtgcggccctgtcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagcccggagatgcgcttcacgccgccgcgccgcgccagacgccggatcgncggcttggtgatgccctggatgttgtnacgcagcaccttccggtggcgcttggcgccnnccttgncca

SEQ ID NO: 77116 - DNA, 545 bp, Triticum aestivum
  unsure (1)..(545): unsure at all n locations
  Clone ID: PAT_TA_77116
attatcagnaaagttttcaagnacactcaacatctgatagttaccgacacaacattggagagtcgactgacaaccatagagcagagcaaaaatactgacgaccgcatagnattttagcatacagtgcgattagcacttgacctctttcagcccatgtgcaaagtacaggnaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcg

SEQ ID NO: 77117 - DNA, 548 bp, Triticum aestivum
  unsure (1)..(548): unsure at all n locations
  Clone ID: PAT_TA_77117
ataatatattatgtgcatgtgcatatacatagccccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggccgtcgtagtacccgggagacgcattgtgctcacggaagatgaacccgaccttgctgaactcaaggcaaggcacccacttggagcggatcangtagtccacctgcttgaggagggcctncgtgctgagcggnggcagg

SEQ ID NO: 77118 - DNA, 664 bp, Triticum aestivum
  unsure (1)..(664): unsure at all n locations
  Clone ID: PAT_TA_77118
atggtgtagataacccgttagcatgcatattaaccnaggtgcataacaggttcaaacatacaaggttcttacaacacaacaggttgtaaaacaaacaccacaaagcaaatgttcaaacagacagataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgcctgggacaacaccaggtggctggtagttgataccacacttgaagccagtggggcaccagtcaacaaactggatagtgcgcttggtcttgatggtggccacagcagcgttgacatccttgggcacaacatcaccacggtacatgaggcagcaggccatgtacttgccgtggcgggggtcacacttggccatcatggaggaaggc

SEQ ID NO: 77119 - DNA, 625 bp, Triticum aestivum
  unsure (1)..(625): unsure at all n locations
  Clone ID: PAT_TA_77119
aagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagagcacgccgttctccagctccctgtacgggaacgaatncgacagaagctcgtcgccggaaagcttgtcctggtacacgagcatggtgccgcc

SEQ ID NO: 77120 - DNA, 589 bp, Triticum aestivum
  unsure (1)..(589): unsure at all n locations
  Clone ID: PAT_TA_77120
cacgaagcgttggcacacatacgaccactcctaccactacttgcagatacataagcagagtcngcgactaacagcagccaactacatctgtcacaacaagcggcgcgtcgtcagtctaggaggatgtgaacttggtgacggccttggtgccctcggagacggcgtgcttggcgagctcgccggggaggacgaggcggacggaggtctggatctccctagaggtgatggtgggcttcttgttgtacctcgcgagcgatggcttgctttgagcactctaatttcttcaaagtaacgatgccggaaacacgacccggccaattaaggctaggagcgcgatgccggccgaagggtcgagtaggtcggtgctcgccgtgaggcggaccggccgacccggcccaaggtccaactacgagctttttaactgcaacaacttaaatatacgctattggagctggaattaccgcggctgctggcaccagacttgccctccaatggatcctcgttaagggatttagattgtactcattccaattaccagacactaatgcgcccggtattgttatttattgtcactacctncccgtgtcag

SEQ ID NO: 77121 - DNA, 687 bp, Triticum aestivum
  unsure (1)..(687): unsure at all n locations
  Clone ID: PAT_TA_77121
cnaggtgcttaacaggttnaacatacaaggttcttacaacacaacaggttgtaaaacaaacaccacaaagcaaatgttcaaacagacagataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgcctgggacaacaccaggtggctggtagttgataccacacttgaagccagtggggcaccagtcaacaaactggatagtgcgcttggtcttgatggtggccacagcagcgttgacatccttgggcacaacatcaccacggtacatgaggcagcaggccatgtacttgccgtggcgggggtcacacttggccatcatggaggaaggctcaaaggcgctgttggtgatctcagcaacagacagctgcttcatggtaggccttctcg

SEQ ID NO: 77122 - DNA, 700 bp, Triticum aestivum
  unsure (1)..(700): unsure at all n locations
  Clone ID: PAT_TA_77122
catgcatattaacntaggtgcataacaggttcaaacatacaaggttcttacaacacaacaggttgtaaaacaaacaccacaaagcaaatgttcaaacagacagataacagataaagccactcgggcagatcataggattgcagcagcatgccttgggaaagcaccaggaggcaggctctagtnctcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgcctgggacaacaccaggtggctggtagttgataccacacttgaagccagtggggcaccagtcaacaaactggatagtgcgcttggtcttgatggtggccacagcagcgttgacatccttgggcacaacatcaccacggtacatgaggcagcaggccatgtacttgccgtggcgggggtcacacttggccatcatggaggaaggctcaaaggcgctgttggtgatctcagcaacagacagctgctcatggtaggccttctcg

SEQ ID NO: 77123 - DNA, 565 bp, Triticum aestivum
  unsure (1)..(565): unsure at all n locations
  Clone ID: PAT_TA_77123
aaacgtattngttgantnttgtatattttgcgtccgtgcatatacatagccccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccactttggagcggatcaggtagtcgacctgcttgaggagggcctccgtgctgagcggtggcag

SEQ ID NO: 77124 - DNA, 686 bp, Triticum aestivum
  Clone ID: PAT_TA_77124
cagaggaaatagcgaactaacaagtcggggcttcatcaggcttctggaatctgcaggcggcgacaaagagtgactcccgtcggccggccggcccttagccgccgaagccgtagagggtgcggccctggcgcttgagcgcgtagacgacgtccatggcggtgacggtcttgagcactctaatttcttcaaagtaacgatgccggaaacacgacccggccaattaaggctaggagcgcgatgccggccgaagggtcgagtaggtcggtgctcgccgtgaggcggaccggccgacccggcccaaggtccaactacgagctttttaactgcaacaacttaaatatacgctattggagctggaattaccgcggctgctggcaccagacttgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagtta

SEQ ID NO: 77125 - DNA, 390 bp, Triticum aestivum
  unsure (1)..(390): unsure at all n locations
  Clone ID: PAT_TA_77125
ataatagaatctggatagctttagatncaaccaaacaggcaaaacattctcagttcaacctaggactcgaaccgtttacagaaaatggtgttcagtatgtctgcaaacatgacatggacgcaacatctaagaaaatccaacgagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccactgaactgctcctcaatgtgcgagtccagtgtacgtccctgctggcgcttctcaagcttcctctggacattgttgctcttctttc

SEQ ID NO: 77126 - DNA, 619 bp, Triticum aestivum
  unsure (1)..(619): unsure at all n locations
  Clone ID: PAT_TA_77126
cctgttggtacatgaacatggnacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggcctccgtgctgagcggtggcaggtaagacagggtctcgaacttcttgatgccctcgatgggccacacctgcatgcacctgatccttccaccgttgctgacgctgccgaggctagcgccgttggagcggcggctgacggggaggccnggcggtggacttgagcc

SEQ ID NO: 77127 - DNA, 153 bp, Triticum aestivum
  unsure (1)..(153): unsure at all n locations
  Clone ID: PAT_TA_77127
cacagcctgtcgagggagccatcagcatcaccctgagcacggacgaacccagagagagcaaaggtggtgaancggccatcatagaggccattctcatcaacatgaccaatgttgatctggacagaggcgtggtccttggccnnaatgatcctg

SEQ ID NO: 77128 - DNA, 147 bp, Triticum aestivum
  unsure (1)..(147): unsure at all n locations
  Clone ID: PAT_TA_77128
tntgataggggccaggatctccagctgagttcccaacttctcctcggctgccttctcggncttgacgcggagcttcnccagntgctttntcctgtcgtaggagatcttggncttctccttcctcttttcctccagctccctgatggt

SEQ ID NO: 77129 - DNA, 572 bp, Triticum aestivum
  unsure (1)..(572): unsure at all n locations
  Clone ID: PAT_TA_77129
ttncacgnattaccattacaaancaaancccacaattatcagnaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccg

SEQ ID NO: 77130 - DNA, 618 bp, Triticum aestivum
  unsure (1)..(618): unsure at all n locations
  Clone ID: PAT_TA_77130
atgcgtccgtgcatatacatagccccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggnctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggcctccgtgctgagcggtggcaggtaagacagggtctcgaacttcttgatgccctcgatgggccacacctgcatgcacctgatccttncaccgttgctgacgct

SEQ ID NO: 77131 - DNA, 397 bp, Triticum aestivum
  unsure (1)..(397): unsure at all n locations
  Clone ID: PAT_TA_77131
tgagtgaaaatgactntgatttagttaagcagtacataataccaccaaaatgtgagccgctaagcccaaccaaccatcaggatacatccaataaaaggtttttagctgacataattccatacaaaaatttattctcagaagaagaggctttgaacactcctctggggcaaaccactctcccctgtatgcctctcatttacttggtgctgtgcatgtgacggatgaggtcgaccacgcgggtgctgtatccccactcgttgtcgtaccaggagacaagcttgacaaagttgtcgttcagagcaatcccggccttggcatcgaagatgctggacctgttgtcaccctggaagtcagtggaaacaaggtcctcatcaacgtaacccaaaatgcccttgag

SEQ ID NO: 77132 - DNA, 468 bp, Triticum aestivum
  Clone ID: PAT_TA_77132
gaaaatactgcaaggtagaacaacacataatagaatctggatagctttagatcacaaccaaaacaggcaaaacattctcagttcaacctaggactcgaacagtttacagaaaatggtgttcagtatgtctgcaaacatgacatggacgcaacatctaagaaaatccaacgagtaacatgcagcagctcttcggcctaagctgtggcacccttgcccttcttcttctggagcttcctcatgtagaactccagctccttgccctccaggatgtacccatcagctctgccacactgtccagggcgagacgaaatgcaggccagcagccttccaccactgaactgctcctcaatgtgcgagtccagtgtacgtccctgctggcgcttctcaagcttcctctggacattgttgctcttctttgcttcctctgtggcagcagcagcaacctcagcctcttgtccctcagcagct

SEQ ID NO: 77133 - DNA, 590 bp, Triticum aestivum
  unsure (1)..(590): unsure at all n locations
  Clone ID: PAT_TA_77133
tggcaccnacattgttnaagaaaacggcgatctcgtacgtgcttgctgatgagaacacatcactccgaaagattgtactggaaatctctctcgtgcatttacggatttagcttagcggacacacacccaaaccaaaaccaaaacgctaacaagaatctacaaatgaacggctactgtttcttcttcttcttcttcttcctagcatgcacgcggccggccgggttgacaatcgccggcgtggcgtggcgtgtcgtcgattcgtcgtcacacactggagcggcacggcacggggaggaaaatgtacatgcgccgacgcgcgtcgctgaggcgaggcaattcgcgggggatcttggggttgtggcggccggatggatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcangctccctctccggaatcgaaccctaattctccgtcacccgtcaccaccatggtangcccctatcc

SEQ ID NO: 77134 - DNA, 563 bp, Triticum aestivum
  unsure (1)..(563): unsure at all n locations
  Clone ID: PAT_TA_77134
ttaaccaaggtgcataacaggttcaaagnatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccantcaacanactggatagtgcgcttggtcttgatggtggccacagcagcgttgacatccttgggaacaacatc

SEQ ID NO: 77135 - DNA, 596 bp, Triticum aestivum
  Clone ID: PAT_TA_77135
cttgcgataaccgagtcccagacaagcactaaaccacaggaaggaactgcatttgctactagatacaggcgacgcaatctaagaggaggtgaacttggtgacggccttggtgccctcagagacggcgtgcttggcgagctccccggggaggacgaggcggacggaggtctggatctcccgggaggtgatggtgggcttcttgttgtagcgggcgagcttggaggcctccccggcgagcttctcgaagatgtcgttgatgaaggagttcatgatggacatggccttggaggagatgccgatgtcggggtgcacctgcttcagcaccttgaagatgtagattttgtaggtctcgacgctcttcttgctcttcttcttgcccttcttctcgccgccctccttggaggcggtcttgccggctggcagccgcttctcggccttgggcttcttcgccgccggggccttctcggccttctccgccgcgggctcctcctccgcgggcttcttcgccgccggcttcttctccgccttgggggccatcgctgcttcgggagggagagaagggtgggtgggttgcttcgccgccggaaggtgttggc

SEQ ID NO: 77136 - DNA, 688 bp, Triticum aestivum
  Clone ID: PAT_TA_77136
agataatgaaaacttacaagacgacatggtccgaacacatgactattacagagtaccatcgatcgaccaagaaaccggaacagactatctaagcggaggtgaacttggtgacggccttggtgccctcggagacggcgtgcttggcgagctcgccggggaggacgaggcggacggaggtctggatctcccgggacgtgatggtgggcttcttgttgtagcgggcgagcttggcggactcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttcgacttcttcttgcccttcttctcgccgcccttccgtcaattcctttaagtttcagccttgcgaccatactccccccggaacccaaagactttgatttctcataaggtgccggcggagtcctataagcaacatccgccgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgccccccgactg

SEQ ID NO: 77137 - DNA, 525 bp, Triticum aestivum
  Clone ID: PAT_TA_77137
ttcggcacgagggtcgaagcacccatggcacccaaggcggagaagaagccggcgccggagaagaccccggcggggaagaagcccgcggcggagaagaggcccgcggccgggaagacggcgtccaaggagggcgggggcgagaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctggcccgctacaacaagaagcccaccatcacgtcgagggagatccagacctccgtccgcctcgtcctccccggcgagctcgccaagcacgccgtctccgagggcaccaaggccgtcaccaagttcacctcttcttaggcttcatccttgtatcatgagttgatggcggtgttctgtgtgtagttagcagtgcgatgttacaatctctgtaagaat

SEQ ID NO: 77138 - DNA, 322 bp, Triticum aestivum
  Clone ID: PAT_TA_77138
gaacgtatcgaagcccaggtagaggagagcggagcagccgacgagccgccgatcgacatgggtctcaaggaggagtttgaggagcacgcggagaaggccaagacgctgcccgacaccaccaccaacgagagcaagctctgcctctacggcctctacaagcaggccaccgtcggccccgtcaacaccgcccgccccggcggcctcttcgatatggctggcaaggccaagtgggatgcttggaaggccgtcgaagccaaatccaaggaggaggccatggcggactacatcaccaaggtgaagcagctgctggaggaggctgccg

SEQ ID NO: 77139 - DNA, 332 bp, Triticum aestivum
  Clone ID: PAT_TA_77139
gcctgcctcgaaaccgccgtcgccatggggagaagacctgcgaggtgctatcggcagatcaagaacaagccgtaccccaagtcaaggtactgccgtggtgtgcctgaccctaagatcaggatctatgatgttggcatgaagaagaagggtgtcgatgagttctctcactgtgttcaccttgtctcatgggagaaggagaatgtgtccagtgaggctcttgaggctgcccgtattgcttgcaacaagtacatgaccaagcatgcaggaaaggatgccttccacctcagggtcagggttcacccgttccatgtgctccgtatcaacaagatgct

SEQ ID NO: 77140 - DNA, 400 bp, Triticum aestivum
  unsure (1)..(400): unsure at all n locations
  Clone ID: PAT_TA_77140
gnattttttctattcaggtcggcaaagcggccggtgagaggtggaagagcttgagcgaatcggagaaggccccctacgtggccaaggccaacaagctcaagggcgagtacaacaaggccattgccgcctacaacaagggcgagagtgctgctgctgctgccccaaagaaggcggcggccaaggaggtagaggaggacgatgaggaggaatccgacaagtccaagtcggagatcaatgatgacgatgacgatgagggtagcgacgaggacgaggacgatgacgagtgaagcggacaatgcgggagctgctgtgcgagaagcgacctgagctgtgtgcggtggtgtcataaggagcctatccatctccactagaattatcccaagtttcacttcacatcgtg

SEQ ID NO: 77141 - DNA, 416 bp, Triticum aestivum
  Clone ID: PAT_TA_77141
gctacccgctgagtttaagcatataaataagcggaggagaagaaacttacaaggattcccctagtaacggcgagaccaaaccaaagctgcggcggcgcgcaggcgaatcagcagcggagccaagcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgag

SEQ ID NO: 77142 - DNA, 195 bp, Triticum aestivum
  Clone ID: PAT_TA_77142
ccccgccgccacccaacccaaggcacaggagctcccggcttctcccccctacgaggttaggcaaggatggtgagggttagcgtcctgaatgatgctctcaagagcatgtacaacgctgagaagcgtggcaagaggcaggtcatgatcaggccttcctcaaaggttatcatcaagttcctcatcgtcatgcagaag

SEQ ID NO: 77143 - DNA, 459 bp, Triticum aestivum
  Clone ID: PAT_TA_77143
attcggcacgaggcgcctcctgcacgcttctcctccgctccccgccccgcctcgagcagctcaggaacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccaacacgctcacgatcgtcgacagcggcattggcatgaccaagtcggacctcgtcaacaacctcgggaccatcgccaggtcggggaccaaggagttcatggaggccctcgccgccggcgccgacgtgtccatgattgggcagtttggtgtcggtttctac

SEQ ID NO: 77144 - DNA, 635 bp, Triticum aestivum
  Clone ID: PAT_TA_77144
gccgcagcgccgccactccacccgcagcggcaaccatggcggtcggcaagaacaagcgcatctccaaggggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgattggaaaggagattgagaaggcc

SEQ ID NO: 77145 - DNA, 619 bp, Triticum aestivum
  Clone ID: PAT_TA_77145
gccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgatcggaaa

SEQ ID NO: 77146 - DNA, 571 bp, Triticum aestivum
  Clone ID: PAT_TA_77146
gagcccctggtacccctctctctctctcaccgcaagaccggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgagccatacaagggtattggtgactgctttggccgcaccatcaaggatgaaggctttggctcattgtggagaggaaacactgctaacgtcatccg

SEQ ID NO: 77147 - DNA, 591 bp, Triticum aestivum
  unsure (1)..(591): unsure at all n locations
  Clone ID: PAT_TA_77147
tgcaggnaattcggcacgaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctc

SEQ ID NO: 77148 - DNA, 598 bp, Triticum aestivum
  unsure (1)..(598): unsure at all n locations
  Clone ID: PAT_TA_77148
gggagcgtctcatcggcgatgccgccaagnaaccggtcgccatgaaccccatcaacaccgtcttcgatgcgaagcgtcttatcggcagaaggtttgctgatgcccctgtccagagtgacattaagatgtggccgtacaaggttattcctggccctgcagacaagcctatgattgtagtgcagtacaagggtgaggacaagcagttttcagctgaagaaatttcttccatggtcctcatcaagatgcgtgagatcgctgaggcttacctaggagtaactattaagaatgccgttgtcactgtgcctgcttacttcaatgattcccagaggcaggcaaccaaggatgctggtgttattgctggtcttaatgtgatgcgtatcatcaacgagccaacagcagctgcaattgcctatggtcttgacaagaaggctaccagtgtcggtgagaagaacgtgcttatctttgacctcggtggtggcacttttgatgtctctctccttaccattgaggagggtatttttgaggtcaaggccacagctggtgacactcaccttggtggggaggactttgacaaccgtatggtgaaccactttgtcca

SEQ ID NO: 77149 - DNA, 585 bp, Triticum aestivum
  Clone ID: PAT_TA_77149
cctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttgacgagatggaaggcccgctcgaggtcggcgccgacggcaccctcaagttcgaggagaaggacggcatcgactatgcggccgtcaccgtgcagctccccggaggcgagcgcgtgcccttcctcttcaccgtcaagcagctcgtcgccaccggcaagcccgagagcttcagcgggcccttccttgtgcccagctacaggggttcgtctttcctcg

SEQ ID NO: 77150 - DNA, 607 bp, Triticum aestivum
  unsure (1)..(607): unsure at all n locations
  Clone ID: PAT_TA_77150
ggccgntncccgnaaccgggnaggaacccggcgcgaggnagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctc

SEQ ID NO: 77151 - DNA, 568 bp, Triticum aestivum
  Clone ID: PAT_TA_77151
aggaattcggcacgaggctccccccgcccgccgccgccgccgcacagccgcagggagagaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctca

SEQ ID NO: 77152 - DNA, 503 bp, Triticum aestivum
  Clone ID: PAT_TA_77152
caacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactgccttgctcctcttgctaaggttatcaatgacaggtttggcattgttgagggtttgatgaccacagttcatgccatgactgcaacccagaagactgttgatggtccttccagcaaggactggagaggtg

SEQ ID NO: 77153 - DNA, 686 bp, Triticum aestivum
  unsure (1)..(686): unsure at all n locations
  Clone ID: PAT_TA_77153
cgaggggcgaatnagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaagct

SEQ ID NO: 77154 - DNA, 428 bp, Triticum aestivum
  unsure (1)..(428): unsure at all n locations
  Clone ID: PAT_TA_77154
tcaagncttagcacagaagcaaaacaatggcggagcagaccttcatcatgatcaagcccgacggcgtccagaggggcctcatcggcgaggtcatcagccgcttcgagaagaagggcttctacctcaaaggtttgaagctccagaacgtggagaagtcgttcgccgagcagcactacgccgatctgtcctccaagcccttcttcgctgggctcgtggagtacatcgtctccggcccggtcgtcgctatggtctgggagggcaagagcgtcgtctccactggacgcaagatcattggcgccaccaaccccctggcctctgagcccggcaccatccgtggtgacttcgccgtcgacatcggcaggaacgtcatccatggaagcgactcagttgagagtgccaggaaggagatcgccctgtggttccctgag

SEQ ID NO: 77155 - DNA, 254 bp, Triticum aestivum
  Clone ID: PAT_TA_77155
ggacaggaataaactaaatatttagttttaactcattacctccatccagaaagtaacacgaacaaaataagatagcggaacactggctaggaatgtcgacagaagtactcaagaaatcagccatcaaaactgactacaaagttcacgacacccaggtggcacatatatcatcttctagatatgaagcagcaaaatagcaacttctatcctctactcagcagcagcaacctcctctgctccaggaatcacctcat

SEQ ID NO: 77156 - DNA, 524 bp, Triticum aestivum
  Clone ID: PAT_TA_77156
gccggcgccggcgaacccaccgcggatcgagcgattcctccgatcaggagaggccagccgggaggaagagcacctacgcgggaggagaggagatggggctcacgttcaccaagctgttcagccgcctgttcgcgaagaaggagatgcggatcctgatggtgggtctcgacgccgcgggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggc

SEQ ID NO: 77157 - DNA, 560 bp, Triticum aestivum
  Clone ID: PAT_TA_77157
ggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctg

SEQ ID NO: 77158 - DNA, 510 bp, Triticum aestivum
  unsure (1)..(510): unsure at all n locations
  Clone ID: PAT_TA_77158
ggcccacgaaccccccacccaacccgagcgagcaccggccgaggaggaagaggaaggtgagatggctcgcggcacggcggcgacggcggcggcggctgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaatctcggcgactccgtcaccgtcacgcgcgacaagagcaaggtcaccgtcacctccgacggcgccttctccaagaggtacctcaagtacttgacaaagaagtacttgaagaagcacaacgtgcgggactggcttcgtgtgatcgcagccaacaaggagcgcaacgtgtacgagctccggtacttcaacatcgctgagaacgagggcgaggaggaggattagagtgcattgntatattgtagtgcttgttgagttttgatacttgatctgagtacctc

SEQ ID NO: 77159 - DNA, 599 bp, Triticum aestivum
  unsure (1)..(599): unsure at all n locations
  Clone ID: PAT_TA_77159
cggcggcgaanatggtgtcgctgaatctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctcaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagttcgaggccaagcgcgccaagagcaaggcaagcagggagaggaagattgccaggagggaggagagattggctcanggcccgagagatcatgcaccagcaccagcggctgcagct

SEQ ID NO: 77160 - DNA, 588 bp, Triticum aestivum
  unsure (1)..(588): unsure at all n locations
  Clone ID: PAT_TA_77160
ggtagtntatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatt

SEQ ID NO: 77161 - DNA, 768 bp, Triticum aestivum
  unsure (1)..(768): unsure at all n locations
  Clone ID: PAT_TA_77161
ttcggcacgaggcaanatccccagccaattctcgtctccgattcgactccaggctcgtcggatcctcctcccccaccgcctcaagatgcagatcttcgtgaagaccctcaccggcaagaccatcacccttgaggttgagagctccgacaccattgacaacgtcaaggccaagatccaggacaaggagggaattcccccggaccagcagcgcctgatctttgctggcaagcagctggaggatggccgtaccctcgccgactacaacatccagaaggagtccaccctccatcttgtcctgcgtctgcgcggtggcatgcagatcttcgtgaagactctcaccggcaagaccatcacccttgaggttgagagctccgacaccatcgacaatgtcaaggccaagatccaggacaaggagggcattcctccggaccagcagcgccttatcttcgctggcaagcagctagaggatggccgtaccctcgcagactacaacatccagaaggagtccaccctccacctggtgctgcgcctgcgtggtggcatgcagatcttcgtgaagaccctcactggcaagaccatcactctggaggttgagagctccgacaccatcgacaatgtcaaggccaagatccaggacaaggagggcattcccccggaccagcagcgcctgatctttgctggcaagcagctggaggatggtcgcaccctagcagactacaacatccagaangagtncacccttcacctggtgctncgtctncgtggngg

SEQ ID NO: 77162 - DNA, 280 bp, Triticum aestivum
  unsure (1)..(280): unsure at all n locations
  Clone ID: PAT_TA_77162
acccgagatccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgntgaggagcgcaacctgctctctgtggcttacaagaangcgattggtgcccngagggcttc

SEQ ID NO: 77163 - DNA, 182 bp, Triticum aestivum
  unsure (1)..(182): unsure at all n locations
  Clone ID: PAT_TA_77163
tcccctgcaaccgccgccgccacctcccctccccccaccacaccctcagccatggcggtcgcggagccggtgcccgggggcgacgtgaagctcttcaaccgctggaccttcgaggatgttcaggngaccgacatctcgctgaacgactacctcgcggagacgtcgatgaagcactacacttt

SEQ ID NO: 77164 - DNA, 640 bp, Triticum aestivum
  unsure (1)..(640): unsure at all n locations
  Clone ID: PAT_TA_77164
ttcggcacgaggcagnacggcaggtaagggaggaggaggaggagtagcggcggcgaagatggtgtcgctgaagctgcagaagcgcctggcctcgagcgtcctcaagtgtggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcagggccccagagatcatgcaccagcaccagcggct

SEQ ID NO: 77165 - DNA, 354 bp, Triticum aestivum
  unsure (1)..(354): unsure at all n locations
  Clone ID: PAT_TA_77165
ggggaagagcnccatccatcgcctccgtttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtg

SEQ ID NO: 77166 - DNA, 467 bp, Triticum aestivum
  Clone ID: PAT_TA_77166
ggttttgggactttagcctcctgcgccgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcccgaacgctgcccgctggtacgacaccgtcgccgcggctgttgcttcaaggttccctggccagtcctctggggtgagtgcatcatcggctcctgctgcagctgctcctgccgcttccaaggatgaagatgacgatgatgacatggatctgtttggcgatgagaccgaggaggacaagaaagctgcagctgagcgtgaggctgccaagcctgcaaagaagaaagaaagtggcaaat

SEQ ID NO: 77167 - DNA, 314 bp, Triticum aestivum
  Clone ID: PAT_TA_77167
tcggcacgaggagatcgcgtcgctggagaagttcctccaggagcgcatcaaggtcgccggcggcaaggccgggaacctcggcgactccgtcaccgtcacgcgcgacaagagcaaggtcaccgtcacctccgacggcgccttctccaagaggtacctcaagtacttgaccaagaagtacttgaagaagcacaacgtgcgggactggcttcgtgtgatcgcagccaacaaggagcgcaacgtgtacgagctccggtacttcaacatcgctgagaatgagggcgaggaggaggattagagtgcattgttatattgta

SEQ ID NO: 77168 - DNA, 526 bp, Triticum aestivum
  unsure (1)..(526): unsure at all n locations
  Clone ID: PAT_TA_77168
ggcacgagggcgacctcctgtttccgcccaccttctccggctccggcgccggcgaaccaatcgcggatcgagcgattcctccgatcaggagaggcgagccgggaggaagagcacctacgcgggaggagacgagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttnca

SEQ ID NO: 77169 - DNA, 413 bp, Triticum aestivum
  unsure (1)..(413): unsure at all n locations
  Clone ID: PAT_TA_77169
tgtccgggacgcggcaagggcaggcaaggggctcggcaagggcggcgccaagcgccacaggaaggtgctgcgcgacaacatccagggcatcaccaagccggcgatccggcgcctggctcggaggggcggtgtcaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgacagggccgnaccctctacggcttcggcggctaggctcgtnctcgcctncctgcaaattncgatgtgcttgttngnatgtgcgcaggagtctngctgtcnagaaaacttanntgnnatganatncccatgnnta

SEQ ID NO: 77170 - DNA, 147 bp, Triticum aestivum
  unsure (1)..(147): unsure at all n locations
  Clone ID: PAT_TA_77170
gccccaggtaagggagagagcctaccccccgccgccgccatgaagcgcaacccccgcgtcacgagctcccgccggaagtgccgnaaggcgcacttcacggcgccgtnctccgtccgccgcgtgctnatgtccgcggccctctcctcc

SEQ ID NO: 77171 - DNA, 530 bp, Triticum aestivum
  unsure (1)..(530): unsure at all n locations
  Clone ID: PAT_TA_77171
gcaggnaattcggcacgagggctcccccctgcaggaagctcgtcgggatgtcgtccgaggcggcgaaggtggtggtgccggagtcggtgctcctcaagaggaagcgggaggagctctgggccgccgagaagaagtccagcgagaacgtcaaggtcatctacgcccgcgccaagcagtacgccgaggagtacgatgcccaggacaaggagttggttcagcttaagcgtgaggcccggatgaagggtgggttctatgtcagtcctgaggctaagctgctgtttgttgtcagaatcagaggtatcaatgccatgcacccaaagaccaagaagatcttgcagctgttgcgtttgagacagatattcaatggagtgttcctgaaggttaacaaggccaccatcaacatgctccgcagggtcgagccatatgttgcatatgggtacccgaacctgaagagtgtgagggagttgatctacaaaagaggttatggaaagctcaacaagcaaaggattcctctgaccaacaacaaggtc

SEQ ID NO: 77172 - DNA, 641 bp, Triticum aestivum
  Clone ID: PAT_TA_77172
tgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaag

SEQ ID NO: 77173 - DNA, 593 bp, Triticum aestivum
  Clone ID: PAT_TA_77173
attggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttcccttcgtccccatctctgggttcgagggtgacaacatgattgagaggtccaccaaccttgactg

SEQ ID NO: 77174 - DNA, 645 bp, Triticum aestivum
  unsure (1)..(645): unsure at all n locations
  Clone ID: PAT_TA_77174
gcctcgctgccgctgcatctcgtctccaccaccccacttgcccccggnacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgtt

SEQ ID NO: 77175 - DNA, 636 bp, Triticum aestivum
  unsure (1)..(636): unsure at all n locations
  Clone ID: PAT_TA_77175
tcccctgcctcccccagnnnctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgncttcagtatttttgctcttatctatggntg

SEQ ID NO: 77176 - DNA, 593 bp, Triticum aestivum
  unsure (1)..(593): unsure at all n locations
  Clone ID: PAT_TA_77176
gcaagnaccggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgagccatacaagggtattggtgactgctttggccgcaccatcaaggatgaaggctttggctcattgtggagaggaaacactgctaacgtcatccgttacttcccaactcaggctttgaactttgcattcaaggattacttcaagagg

SEQ ID NO: 77177 - DNA, 186 bp, Triticum aestivum
  unsure (1)..(186): unsure at all n locations
  Clone ID: PAT_TA_77177
ccaccgccgccgtacgacatgggtaaggtgcacggnatcgctcgcccgtgccgggtaaggtgcgcggccagacgcccaaggtcgcgaagcaggacaagaagaagcagccccgcggccgcgcccacaagaggatccagtacaaccgccgcttcgtcaccgccgtcgtcggcttcggcaagaagcgcg

SEQ ID NO: 77178 - DNA, 654 bp, Triticum aestivum
  Clone ID: PAT_TA_77178
ttcggcacgaggatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaaga

SEQ ID NO: 77179 - DNA, 651 bp, Triticum aestivum
  Clone ID: PAT_TA_77179
gatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgtt

SEQ ID NO: 77180 - DNA, 640 bp, Triticum aestivum
  unsure (1)..(640): unsure at all n locations
  Clone ID: PAT_TA_77180
ttcggcacgaggcagcagcgatggagggcaaggnaggaggacgtgcggctcggggcgaacaagtactcggagcgtcagcccatcggcacggcggcgcaggggtccgaggacaaggactacaaggagcccccgccggcgccgcttttcgagcccggcgagctcaagtcctggtccttctaccgcgccggcatcgccgagttcatggccaccttcctcttcctctacgtcaccatcctcaccgtgatggggtacagcggcgccgcctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacccgggcggtgttctacatcatcatgcagtgcctgggcgccatctgcggcgcccggcgtggtgaaggggttccagcagggcctgtacatgggcaacggcggcggcgccaacgtggtggcgcccggctacaccaagggctccggcctcggcgccgagatcatcggcaccttcgtcctcgtctacaccgtcttctccgccaccgacgccaagaggaacgccagggac

SEQ ID NO: 77181 - DNA, 604 bp, Triticum aestivum
  Clone ID: PAT_TA_77181
cgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggt

SEQ ID NO: 77182 - DNA, 421 bp, Triticum aestivum
  unsure (1)..(421): unsure at all n locations
  Clone ID: PAT_TA_77182
atggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctganccatacaagggtattggtgactgctttgnncgcaccatnaangatgaangnttng

SEQ ID NO: 77183 - DNA, 549 bp, Triticum aestivum
  unsure (1)..(549): unsure at all n locations
  Clone ID: PAT_TA_77183
ataaacccanctcggnactcgccttcctcctcccccaactactcctcctcgcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactgccatatcccccttactggaccaaattcaattgttggccgtgctgttgtcgtccatggtgacgctgatgatcttggcaagggtggacatgagctgagcaagagcactggaaacgctggtgcccgtgttgcttgcggaatcatcgggctc

SEQ ID NO: 77184 - DNA, 629 bp, Triticum aestivum
  Clone ID: PAT_TA_77184
gggcgtcttcgtactcgcctctctccgcgcaaccgagtccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacagtgtacccatcacccca

SEQ ID NO: 77185 - DNA, 564 bp, Triticum aestivum
  Clone ID: PAT_TA_77185
caggaattcggcacgagggcccgccgccgccgccgcacagccgcagggagagaaggcaagggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaag

SEQ ID NO: 77186 - DNA, 469 bp, Triticum aestivum
  Clone ID: PAT_TA_77186
gccacagtcgcgctcccgagtatccgcagccgaagcccgtgagaaaagcgaagcgcgagaggaaaggcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactgagctcagcaagatctgtgatggcatcctcaagcttctggactcccaccttgtcccctctgccactgcagcagagtcc

SEQ ID NO: 77187 - DNA, 407 bp, Triticum aestivum
  Clone ID: PAT_TA_77187
ggcgcacgaaccccctccgccgccgacctcgcgtcttctcctgcgcatctcggaggtgcttcctagtttccacgatgaagctgatcgctgcctacctcctcgcctatctgggtgggaactcttccccaagtgccgctgacgtcaagaacatcctggactcagttggtgccgaggctgatgaagaaaagcttgagttccttctggctgaactcaaaggcaaggacatcacagaagtgattgcatctggaagggagaagtttgccgctgtgccttcaggtgggggtgccattgctgtgggagctccagctgctgcatctggtggtgccgccgcacctgctgctgagtcaaaggaggagaaggttgaagagaaggaagaatctgatgaagacatgggtttcagtctgttc

SEQ ID NO: 77188 - DNA, 550 bp, Triticum aestivum
  unsure (1)..(550): unsure at all n locations
  Clone ID: PAT_TA_77188
ggacgctcaagncccccagtacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatcc

SEQ ID NO: 77189 - DNA, 559 bp, Triticum aestivum
  Clone ID: PAT_TA_77189
catgtgcaagtatgaaccatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagtt

SEQ ID NO: 77190 - DNA, 565 bp, Triticum aestivum
  Clone ID: PAT_TA_77190
ggttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttga

SEQ ID NO: 77191 - DNA, 540 bp, Triticum aestivum
  Clone ID: PAT_TA_77191
gccgtcccaatcctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactg

SEQ ID NO: 77192 - DNA, 353 bp, Triticum aestivum
  unsure (1)..(353): unsure at all n locations
  Clone ID: PAT_TA_77192
agcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctccgcggnggcatcatctgagccctcgctccaggccctcgcccgcaagtacaaccaggagaagatgatctgccgcaagtgctacgccaggctgcatccaagggccgtcaactgccgcaagaagaagtgtggccacagcaaccagctgaggcccaagaagaagatcangaactagagctcgttcgtaaatttcg

SEQ ID NO: 77193 - DNA, 541 bp, Triticum aestivum
  Clone ID: PAT_TA_77193
gcccctcccctcctccccagcgtcgcctcccgttcggaaccccaagctcccccgccgccggcgaaatggccccgaagcgaggcggcaaggccccggtgccggcgaagaagaaggcggcggacaaggtggtgaacccgctgttcgagaagaggccgaagcagttcggcatcggcggggcgctgccgcccaagaaggacctccaccggttcgtcaagtggcccaaggtcgtccgcattcagcgccagcgccgcatcctcaagcagcgcctcaaggtgcccccggcgctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcatcgagcagagcaaggctcagctggtcgtcatcgctcatgatgttgacccaattgagct

SEQ ID NO: 77194 - DNA, 680 bp, Triticum aestivum
  Clone ID: PAT_TA_77194
gccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccccaggtctccacctctgttgttgagccatacaacagtgtcctgtccacccactcactccttgagcacactgatgtctctatccttcttga

SEQ ID NO: 77195 - DNA, 512 bp, Triticum aestivum
  Clone ID: PAT_TA_77195
gaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaag

SEQ ID NO: 77196 - DNA, 600 bp, Triticum aestivum
  unsure (1)..(600): unsure at all n locations
  Clone ID: PAT_TA_77196
gagggccgtagtntatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagtt

SEQ ID NO: 77197 - DNA, 618 bp, Triticum aestivum
  Clone ID: PAT_TA_77197
ggtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccc

SEQ ID NO: 77198 - DNA, 574 bp, Triticum aestivum
  Clone ID: PAT_TA_77198
ggatacatccataaaaggtttttagctgacataattcctacaaaaatttattctcagaagaaaggctttgaacactcctctggggcaaaccactctccccagtaacttcatgcctctcatttacttggagctgtgcatgtgacggatgaggtcgaccacacgggtgctgtatccccactcgttgtcgtaccaggagacaagcttgacaaagttgtcgttcagagcaatcccggccttggcatcaaagatgctggacctgttgtcaccctggaagtcagtggaaacaaggtcctcatccacgtaacccaaaatgcccttgaggtttccctcagactcctccttgatagcagccttaatctgatcataggttgctggcttcgcaagtctaacagtcagatcaacaacagaaacatcaacagtaggaacacggaaggccattccagtcaactttccgttaagctctgggagcaccttgccaacagcctttgcggcaccagtgctgcttggaatgatgttgaagctggcagcccttccacctctccagtccttgctggaaggaccatcaacagtcttc

SEQ ID NO: 77199 - DNA, 174 bp, Triticum aestivum
  unsure (1)..(174): unsure at all n locations
  Clone ID: PAT_TA_77199
gtaggtagtacaaacaatanntnattaagctgaaatcaacaatgagccaaaacatgcatcattgcattgtttacgacactgatgctacagaccaaaagtacaacaaaacttccagcccaggtgatatgattggcacccaggactgaatcaaatggcgtatatgaaagcgactaa

SEQ ID NO: 77200 - DNA, 172 bp, Triticum aestivum
  unsure (1)..(172): unsure at all n locations
  Clone ID: PAT_TA_77200
acggcgctaacagtancaaaccttgcactaaactactagagatctcaaaagcagacatagatggattcaggggaacgcctcanttcttcttgatggcagccttggtcaccttggcgccggttgggtccttcttctccacacccttgatgacnccaacagccacagtttgcct

SEQ ID NO: 77201 - DNA, 520 bp, Triticum aestivum
  Clone ID: PAT_TA_77201
ggttcttacaacacaacaggttgtaaaacaaacaccacaaagcaaacgttcaaacagacagataacagataaagccactcgggcagatcataggatagcagtagcaagccttgggaaagcaccaggaggcaggcttaatactcatcgccctcatcaccgtcctcaccctcgtcgaactcagcaccaacttcttcatagtccttctccagggcagcgagatcctcacgggcctcagagaactctccctcctccatgccctcaccgacgtaccagtggacgaaggcacgcttggcgtacatcaggtcaaacttgtggtcgatgcgggagaagacctcgacgacactggtggagttggagatcatgcacacagccctctggaccttggcaaggtcaccgcctgggacgacacctggtggctggtagttgataccacacttgaagccagtggggcaccagtcaacaaactgaatagtgcgcttggtcttgatggtggccacagcagcgttgacgtcctttggca

SEQ ID NO: 77202 - DNA, 526 bp, Triticum aestivum
  Clone ID: PAT_TA_77202
taaacatgcacataacaagatgaaacgaaaccgctacaggaacaccaccggaccactacgaagaacactacgacatggaacgcatcgatctaagccttggtggtcttcttgggggacttggtcgtcttcttaggagacttgggctccttgccctccttctccgcggtcctcttggggaggagcaccgggttgatcttggggatcacgccaccgtgcgcgatggtgacgccggccagcagctttccgagctcctcgtcgttcctgacagcgagcagcaggtggtgcccttccgtcaattcctttaagtttcagccttgcgaccatactccccccggaacccaaagactttgatttctcataaggtgccggcggagtcctataagcaacatccgccgatccctggtcggcatcgtttatggttgagactaggacggtatctgatcgtcttcgagcccccaactttcgttcttgattaatgaaaacatccttggcaaatgctttcgcagttgttcgtctttcataaatc

SEQ ID NO: 77203 - DNA, 646 bp, Triticum aestivum
  unsure (1)..(646): unsure at all n locations
  Clone ID: PAT_TA_77203
ttaaaacgtatatagttnacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggcctccgtgctgagcggtggcaggtaagacagggtctcgaacttcttgatgccctcgatgggccacacctgcatgcacctgatccttccaccgttg

SEQ ID NO: 77204 - DNA, 494 bp, Triticum aestivum
  unsure (1)..(494): unsure at all n locations
  Clone ID: PAT_TA_77204
tatgcttgcacactactcaaggatgnggaatagatatggttcaacaatgctaaacttagttcatccgctgcgcagcctcctttgcgataagcctttccctggccttggtcttcgcttgcgacttggagcccatgacaccaccaccccacttcttcctaacctcgtcgaatttgtcgttgttnttcgccttaatagcctcaaggatcttgctgaactcaagcttatcctcattcttcactgtggtcaggcacagaacagaggcagtcttcttgtgaacaatcgatccaaggcgagattttcccttgacaatgcagtaagggacctccattttcctgcaaagagcagggagccacacaaccagctcaatcggatcaacatcatgagctatgacaaccagctgggctttactctgctcgattaggtaggtaacatggttaaggccatacttcacaactattggcttnttggcctnaacagttttaccttcagcttca

SEQ ID NO: 77205 - DNA, 627 bp, Triticum aestivum
  unsure (1)..(627): unsure at all n locations
  Clone ID: PAT_TA_77205
tattgtatattttgcgtccgttntatacatagccccgatagcattctcatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgtgtggcgtcggtgcacccgaacataggcagcttccacattgtccagtaccggccatcatagtacccaggggatgcgttgtgctcacggaagatgaacccaaccttgctgaactcgaggcaaggcacccacttggagcggatcaggtagtcgacctgcttgaggagggcctccgtgctgagcggtggcaagtaggacagggtctcgaacttcttgatgccctcaatgggccacacctgcatgcacctgatccttccaccgttgctgacgc

SEQ ID NO: 77206 - DNA, 573 bp, Triticum aestivum
  unsure (1)..(573): unsure at all n locations
  Clone ID: PAT_TA_77206
acgattacnttacaaagcaaatcccacaattatcagaaagttttaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatnatcaccaccaccctcagcagagggatttggcttcaatgtccacatcaactgctccttgaacgacccaatggccgtcgactt

SEQ ID NO: 77207 - DNA, 359 bp, Triticum aestivum
  Clone ID: PAT_TA_77207
caaacagtaagatagcagcagacacaggaagataaccatggccgccggacacagatccagcggccaaaagagtccacctaaaaccctcctaaaccaaccacggagatctcatcggacggacaaggggaagacacgacacgacacacgactctcttatttagatcgacgacacgggacacggggcgacgacgacaggcgaccggcgggcggacggatctagagctggccgcagtcggcgatgacgacttgcttggagcaggtgccgctgcgggagcccaccttctcgatgttcttgacgacgtccatgccctcgacgacctcgccgaagaccacgtgcttgccgtcgagccaattgcagc

SEQ ID NO: 77208 - DNA, 644 bp, Triticum aestivum
  Clone ID: PAT_TA_77208
acaattatagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagagcacgccgttctccagctccctgtacgggaacgaatccgacagaagctcgtcgccggaaagcttgtcctggtacacgagcatggtgccgcc

SEQ ID NO: 77209 - DNA, 633 bp, Triticum aestivum
  Clone ID: PAT_TA_77209
gaaagttttaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcctggtacacgagcatggtgccg

SEQ ID NO: 77210 - DNA, 737 bp, Triticum aestivum
  Clone ID: PAT_TA_77210
gcatgcatattaacctaggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtacttgccgtggcgggggtcacacttggccatcatagatgaaggctcaaaggcgctgttggtgatctcagcaacagacagctgctcatggtaggccttctcagctgagatcactggggcataggaggaaagcatgaag

SEQ ID NO: 77211 - DNA, 635 bp, Triticum aestivum
  Clone ID: PAT_TA_77211
atccgatagaataacagggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgact

SEQ ID NO: 77212 - DNA, 644 bp, Triticum aestivum
  Clone ID: PAT_TA_77212
catgcatattaaccaggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtactttgccgtggcgggggtcacacttggccatcatagatgaaggct

SEQ ID NO: 77213 - DNA, 453 bp, Triticum aestivum
  unsure (1)..(453): unsure at all n locations
  Clone ID: PAT_TA_77213
attaattgcctgaacaagtaggtnggcacatcacacgtacacatctcggctagactggagtacagcaaggaactgacagttcactcacgcatacggacgtgtgcatacatgtcgcataaatatatatgcacacacagtgtgtgtgcaaggtacagacatagacacactactgaaataacacatgcaggcaactttattttatttttttagtagctcatcagtatcgtatgagcactccatcaacatagacattaagctccacacaagcgcgtccatgcatgcacgtaggaagggttatatattgaactagttgacagtgtcgcagttggtggacatgctgatggggaagggcacactgacgccgcacttgccgggcacgccggagaccttgcccatgttgatggacttgatgctggtggcgaggctcttgaggcacctgcacgctatcttgcc

SEQ ID NO: 77214 - DNA, 478 bp, Triticum aestivum
  unsure (1)..(478): unsure at all n locations
  Clone ID: PAT_TA_77214
caaatgtgagccgctagcccaccacctaggatacatccataaaaggnttttagctgacataattccatacaaaaatttattctcagaagaagaggctttgaacactcctctggggcaaaccactctcccctgtatgcctctcatttacttggtgctgtgcatgtgacggatgaggtcgaccacgcgggtgctgtatccccactcgttgtcgtaccaggagacaagcttgacaaagttgtcgttcagagcaatcccggccttggcatcgaagatgctggacctgttgtcaccctggaagtcagtggaaacaaggtcctcatcaacgtaacccaaaatgcccttgaggtttccctcagactcctccttgatagcagccttaatctgatcataggttgctggcttcgcaagtctaacagtcagatcaacaacagaaacatcaacagtgggaacacggaaggccattccagtcaactttccc

SEQ ID NO: 77215 - DNA, 710 bp, Triticum aestivum
  Clone ID: PAT_TA_77215
taaaaatttataccctgtccttacagcatcagaatctctaggctctagctccggaagaacgttgcatgcatcaacgctttagaagaggaaaggtaaaataaaatcaaacaacagtattatcagtttctaaaattctgaaccaaggcttctcttcatctccttgattagcagataggcaggggctcgccgttcgtgcccagctcctcgcgcacgaaccggtatagagggtatgaccggcagtctacgatacggtttggttctgcagcggtgccattctccactgcacctctagcagcctcaacctcctgaggtagtgttgcacagagctcctgttcaaatttggcaaccttggcaaacaccgaggtttccacggtgcactcagcctcgccgttggccagggcgtgctcaaccaacaccgcgcgcatcttcttcatgagagggtagttggcgctgcaagggtcgtccgcatacgcgaacaccgcctcacggtcgatagtctggagcaggtccttctcacaaaaacgtgtgttgtggaggccacccatgtcatttgtaatcagggtcttcctagccactcttgtgacacaattcttgacggcgttcttgacattctcctcaaggtggcgcaggtcaatggcttggcacaacgcaaccaaaaatgtagaggacatgagcttcagaatgtcgatggcctcggcagtcttccggga

SEQ ID NO: 77216 - DNA, 606 bp, Triticum aestivum
  unsure (1)..(606): unsure at all n locations
  Clone ID: PAT_TA_77216
cacgnngttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttggg

SEQ ID NO: 77217 - DNA, 421 bp, Triticum aestivum
  Clone ID: PAT_TA_77217
tcctgcgcatctcggggtgcttcctagtttccacgatgaagctgatcgcagcctaccttctcgcctatctgggcgggaactcttccccaagtgccgctgacgtcaagaacatccttgactcagttggtgctgaggctgatgaagaaaagcttgagttccttcttgctgaactcaaaggcaaggacatcacagaagtgattgcatctggaagggagaagtttgccgctgtgccttcaggtgggggtgccattgctgtgggagctccagctgctgcatctggtggtgccgcagcacctgctgctgagtcaaagaaggaggagaaggttgaagagaaggaagaatctgatgaagacatgggtttcagtctgttcgactaagcgcttcagttcctcccccctaccctctgtttaccctagtatct

SEQ ID NO: 77218 - DNA, 514 bp, Triticum aestivum
  Clone ID: PAT_TA_77218
gactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgtt

SEQ ID NO: 77219 - DNA, 447 bp, Triticum aestivum
  Clone ID: PAT_TA_77219
ggtcccctctctcctttccccaacccaaaccaggagcgccctccctccctccccacccaggtgagcctcgattctccgtcgatccgccgccgatccgccgccggtccgcccgattccggcccgccccgcgcggatccggcccgtgcgctcgctgatttcgtgtttttcggcgcagggaaacccaccagccatgaagggggccaaatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcga

SEQ ID NO: 77220 - DNA, 303 bp, Triticum aestivum
  Clone ID: PAT_TA_77220
cgccgcccactccctcccccatccgcttctccaagttcttccaggccaacatgcggatcctggtcaccggcggagctggcttcatcggctcgcacctcgtcgacaagctcatggagaacgagaagaacgaggtcattgttgctgacaactttttcactgggtcaaaagacaacctgaagaagtggatcggacacccaagatttgaactcatccgtcacgatgtcaccgaaccactgctcgtggaggttgaccaaatctaccaccttgcttgccctgcctcaccaatcttctacaagcacaacc

SEQ ID NO: 77221 - DNA, 638 bp, Triticum aestivum
  Clone ID: PAT_TA_77221
ggaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccc

SEQ ID NO: 77222 - DNA, 737 bp, Triticum aestivum
  unsure (1)..(737): unsure at all n locations
  Clone ID: PAT_TA_77222
ggacaagggcaacagccaggnacaatggcaacaaccaggtacaagggcaaccaggatactacccaacttctccgttgcagccaggacaagggcaaccagggtacgacccaacttctccgcaacagccaggacaagggcagcaaccaggacaattgcaacaaccagcacaagggcaacaagggcagnaactagcacaagggcaacaagggcancaaccagcannagtgcaacaagggcagcagccagctacaagggcaacaaggtcancagctaggacaagggcnncaaggtcagcagccaggacaagggcagcaaccagcacaagggcaacaaggtcagcagccaggacaagggcaacaaggtcattcagccaggacaagggnttncaacctgggacaagggcagccatggtactacccaacttctccgcatgagtnaggacaagggcaacagccaggacaatggcaacaaccnaggacaatggcaacaaccaggacaagggcaaccagggtactacctaacttctccgttgcagctaggacaagggcaacaagggtactacccaacttttntgcaacaaccaggacaagggcagcaaccaggacnatggcaacaatcgggacaagggcaacatgggtactacccaanttttccgcaattgtcaggacaagggcaacggccagggacaattggcttgnaacccaggacaaggggcaanaagggtactaacccaactt

SEQ ID NO: 77223 - DNA, 886 bp, Triticum aestivum
  unsure (1)..(886): unsure at all n locations
  Clone ID: PAT_TA_77223
ggtcaggacaaggnacaacaatcaggnacaaggacaacaagggtactacccaacttctccgcaacagtcaggacaagggcaacaaccgggacaagggcaatcggggtacttcccaacttctcggcagcagtcaggacaagggcagcagccaggacaaggacaacagtcgggacaagggcaacaaggtcatgcaaccaggacaaggacancaagcgtactacccaacttattcgcaacagtcaagacaaaggcancaggcnggacaatggcaacgaccgggacaagggcaaccagggtactacccaacctctccacancanncaggacaagagcancaatcaggacaagcgcatcantcaggacaatggcaactagtgtactacccaacttctccgcaacagccaggccaattgcancaaccagcacaagggcaacaaccagcacaagggcaacaatcagcacaagagcaacagccaggacaagcgcaacatatcaggacaatggcaacttagtgtactacccaacttctccgcaacagccaggacaattgcaacaaccagcacaagggcaacaagggtactacccaacttctccacaacagtcaggacaagggcaacaagggtactacccaacttctncgcaacagtcaggacaagggcaacaagggtactacccaacttctccgcaacagtcaggacaagggcagcagccaggacaaggacaacagccaagacaagggcaaccaagggtactacccaattttttcgcagcagtcaggacaangggcaacaaccaggacaaggggcaacaagggtacttacccaacttttttcgcagcagtcaggacaagggcaacaaccaggacattgagcaacagccaggacna

SEQ ID NO: 77224 - DNA, 654 bp, Triticum aestivum
  Clone ID: PAT_TA_77224
ttcggcacgaggcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacagtgtacccatcaccccaggtctccacctctgttg

SEQ ID NO: 77225 - DNA, 563 bp, Triticum aestivum
  Clone ID: PAT_TA_77225
gcatatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaatt

SEQ ID NO: 77226 - DNA, 312 bp, Triticum aestivum
  Clone ID: PAT_TA_77226
ttcggcacgaggcagcctcaacaactgccccagttcgaggaaataaggaacctagcgctacagacactacctgcaatttgcaatgtctacatccctccatattgcaccatcgcgccatttggcatcttcggtactaactgagaagaaaataactctagtactagatatatgaaacaccgttttctcagtccatggtttggtcgttgtagcggtgaaaaaataatgtggcatgcactatcatgtaagaacccaaactatactagttcaaacttgggaataaaagacaaacacaggtcttgtctaaaaaaaaaa

SEQ ID NO: 77227 - DNA, 494 bp, Triticum aestivum
  Clone ID: PAT_TA_77227
tcggcacgagggttttgcaacaaagtacttaccagctgttgcaagaattgtgttgtcagcacctatggcagatccctgagcagtcgcagtgccaggccatccacaatgttgttcatgctattattctgcgtcaacaacaaaaacaacaacaacaaccatcgagccaggtctccttccaacagcctcagcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatctttggtactaactaagaagaaaataactctagtactagatatatgaaacaccgttttctcagtccatggtttggtcgttgtagcggtgaaaaaataaagtgacatgcactatcaaaaaaaaaa

SEQ ID NO: 77228 - DNA, 709 bp, Triticum aestivum
  Clone ID: PAT_TA_77228
cgaggagacccaagcatcaaaggcaagcaagcagtagtaaccacaaatccaagatgaagaccttcctcatctttgtcctccttgccatggcgatgaagatcgccactgccgctagggagttaaaccctagcaacaaagagttacaatcacctcaacaatcattttcccatcaacaacaaccatttccacagcagccatatccacaacaaccatatccatcacagcaaccatatccatcgcaacaaccatttcccacaccccaacaacaatttccccagcaatcacaacaaccatttacccagccccaacaaccgacccccttacaaccacaacaaccattccccctacgaccgcaacaaccatttccccagcaaccccaacaatcacaacaatcatttccccagccccaaccccagcaaccccaacaaccatccatccttcaaccacaacaaccattaccccaacaaccacaacaaccatttcaacagccccaacaacaattatcccagcaaccagaacaaacaatttcccagcaaccccaacaaccattcccccagcaaccacaccaacctcaacaaccatatccacaacaacaaccatatgggagtagtcttacaagcatcggtggccaatgaaatgaacacctgtaatacaagacggatggatcatcgttgtttagtcaatgagcgttcaatgtaacgatgataaa

SEQ ID NO: 77229 - DNA, 910 bp, Triticum aestivum
  unsure (1)..(910): unsure at all n locations
  Clone ID: PAT_TA_77229
gcaggnaattcggcacgaggnaacttctccgcaacagtcaggnacaagggcaacaactgggacaagggcaaccagggtactacccaacttctccacagcagtcaggacaaggacaacaatcaggacaaggacaacaagggtactacccaacttctccgcaacagtcaggacaagggcaacaaccgggacaagggcaataggggtacttccgaacttatcnncagcagtcaggacaagggcagcagccaggacaaggacaacagncggnacaagggcaacaaggtctgcaaccaggacaaggacancaagcgtactacccaanttcttcgcaacagncnagacaanggnancangcnggacaanggcancgaccggnacaagggnaaccngggtactacccaacctctccacancaancnggacangagcancaatcaggacaagcgcatcaancaggacaatggnntctngtgtantacccaacttctncgcaacagccaggccaattgcancaaccagcacaagggcancaaccagcacaagggcaacaatcagcacaagagcnnacagccaggacaagcgcaacaatcaggacaatggcaactagtgtactacccaacttctccgcaacagccaggacaattgcaacaaccagcacaagggcaacaagggtactacccaacttctccacaacagtcaggacaagggcaacaagggtactacccaactttntccgcaacagncaggacaagggcaacaagggtactacccaacttntccgnacagncaggacaagggcannanccaggacaaggacancagccnanacaagggcaacaagggtactacccanttntccgcacanncagggananggncannaccnggncagggcnacaagggttctacc

SEQ ID NO: 77230 - DNA, 122 bp, Triticum aestivum
  Clone ID: PAT_TA_77230
attgttaagaacaaaataaaatgactagcctccttccatgtgtttcttttatcatggatcttgtatggcaactattttgtgctcatcagctagttcatcgtttacatttactaaaaaaaaaa

SEQ ID NO: 77231 - DNA, 621 bp, Triticum aestivum
  unsure (1)..(621): unsure at all n locations
  Clone ID: PAT_TA_77231
cggcacgagggctctcctcctcctcctgccccgatcccgaaccgggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgnggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacat

SEQ ID NO: 77232 - DNA, 616 bp, Triticum aestivum
  unsure (1)..(616): unsure at all n locations
  Clone ID: PAT_TA_77232
caacaaatcccccaacaacaacaaatcccccagcaaccaaaacaattcccccaacaacaattcccgcaacaacaatttccccaacagcaattaccgcaacaggaattcccacaacaacaacanttnccgcaacaacnaatcgcccagcnaccacaacgactccnccancaacaacaaatnncgccaacaaccannactgtttccccaacancagcanttgnccgccagcangcaatcaccccancaacagnagatttccncaacaacagatgtaccccaacaacagnanttnccngnaacaacanttgccccaaccacnngggntaccncngcaacaacaaattcntncagcaaccacancagttcccccagcagcanttccccctaacaacagcaatttccccaacaacaagaattgccccaacagcaattcccgcaacaacanttgcaccaacaacaattaccacaacaacagttnccccaacaacanttnccccaacagcaattnccccaacaacaacagttcccncancancaacaattaacgcaacaacanttcccccggccacaacaatcccctgaacaacaacaattttcnccaacaacaattncccca

SEQ ID NO: 77233 - DNA, 866 bp, Triticum aestivum
  unsure (1)..(866): unsure at all n locations
  Clone ID: PAT_TA_77233
gcagggtactacccaacttcacagcagccaggnacaaaagcagcaggcaggacaagggcaacaatcaggacaaggacaacaagggtactacccaacttccccgcaacagtcaggacaagggcaacaaccgggacaagggcaaccagggtactacccaacttctccgcagcagncaggacaatggcagcaaccaggacaagggcaacaaccaggacaagggcagcaatcaggacaagggcaacaaggncatnanccaggacaagggcaacaaccangacaaggncaacaagggtantacncnattnntgcgcatcagccngnanangggcnacantnacgacaagggcaacnagggtactanncnnnttatntgcntcaancaggacantgncatcanccanganaagggcatcanccnngtcaagggcnncatggncatcaagcaggacaaggncatcaancangacaaggncatcanggatactancnaanttntntgcancaagcaggacaagggnatcaantnggacaagggcntccagggtactacccaacttntnngcantnagcacaangtnngcatccaggacnangannacanccaggacaaggacancatggtnnctanncancttntcctcnncattcaggacaanggcaacatctnggacaangggnacctngggnctacccaacttttncacagcantnaggncaangaccncaatcaggacaangacnacaanggtnctanccancttttncgnacattnaggacanggcnacatccgggacaagggnaatctgggnnctttccnantttttnnggnacantnnggacangggcngcatncgggananggnca

SEQ ID NO: 77234 - DNA, 608 bp, Triticum aestivum
  unsure (1)..(608): unsure at all n locations
  Clone ID: PAT_TA_77234
ttcggcacgaggcacgcttctcctccgctccccgccccgcctcgagcagctcaggnaacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccaacacgctcacgatcgtcgacagcggcattggcatgaccaagtcggacctcgtcaacaacctcgggaccatcgccaggtcggggaccaaggagttcatggaggccctcgccgccggcgccgacgtgtccatgattgggcagtttggtgtcggtttctactccgcctacctcgtcgccgagagggttgtcgtcaccaccaagcacaacgacgacgagcagtacgtgtgggagtcccaggccggtggctccttcaccgtcactcgtgatacgtctggggagcagctcggcaggggtaccaagatggtcctctacctcaa

SEQ ID NO: 77235 - DNA, 791 bp, Triticum aestivum
  unsure (1)..(791): unsure at all n locations
  Clone ID: PAT_TA_77235
aacttctctgcatcagtcagcacaagggcaacaagggcactacccagcttctcagcagcagccaggacaagggcaacaagggcactacccagcttctcagcagcagccaggacaagggcaacaagggcactacccagcttctcagcaagagccaggacaagggcaacaagggcaaatcccagcttctcagcagcagccaggacaagggcaacaagggcactacccagcttctctgcagcaaccaggacaacaagggcattacccaacttctctacagcagctaggacaagggcaacaaataggacagccaggacaaaagcaacaaccaggacaagggcaacaaacaggacaagggcaacagccagaacaagagcaacaaccaggacaagggcaacaaggatactatccaacttctctgcagcagccaggacaaggacaacagcaaggacaagggcaacaagggtactacccaacttctctccagcagccaggacaagggcaacaagggcactacccagcttctctgcagcagccaggacaaggacagccaggacaaaggcaacaaccaggacaagggcaacatccagaacaagggcaacaaccaggacaagggcaacaagggtactatccaacttctccacagcagccaggacaagggcaacaactaggacaagggcaacaagggtactacccaactttttccgcagcagccaggacaagggcaacaaccaggacaagggcaacaagggcactgnccaatgtccccgcagcagacaggacaagcgcaacaa

SEQ ID NO: 77236 - DNA, 605 bp, Triticum aestivum
  Clone ID: PAT_TA_77236
gcccgaaccgggaggaacccggcgcgaggagggcaaaggaagagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctgaaatcactgacaagcttggcctgcattccctgcgccagcgacactggtacatccagagcacatgtgctacctctggggagg

SEQ ID NO: 77237 - DNA, 486 bp, Triticum aestivum
  unsure (1)..(486): unsure at all n locations
  Clone ID: PAT_TA_77237
agtagtagcnacacaaatccccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaa

SEQ ID NO: 77238 - DNA, 673 bp, Triticum aestivum
  Clone ID: PAT_TA_77238
tgaggaattcggacgaggagaaaataaagtcgtagtagttaacgcaaatccccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggcc

SEQ ID NO: 77239 - DNA, 506 bp, Triticum aestivum
  unsure (1)..(506): unsure at all n locations
  Clone ID: PAT_TA_77239
gaggaattcggcacgaggccggcgcctcccttctctgctccctcctctcctcgcgcgcagggcccgnngaaagggaagcaagatgtacaccgccaggaagaagatccagaaggacaagggcgtcgagccctncgagttcgaggacaccgtcgcgcaggctttntttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgtggtctttgttgcancaagaaggattgtgaggccacccaagaagggttctgctgttcancgccctcgcaccaggaccctgacagntgntcatgatggtatcttggaggatgtcgtgtacccagctgagattgtggggaagcgtgtca

SEQ ID NO: 77240 - DNA, 875 bp, Triticum aestivum
  unsure (1)..(875): unsure at all n locations
  Clone ID: PAT_TA_77240
cagccnggnacaagggcaacgactcaggnacanggacaacangggtactacccaatttctccgnaacagccgggacaagggcaacaatcaggacaagggcaaccagggtactacccaacttctttgcggcagccaggacaatggcagcaaccaggacaagggcagcaaccaggacaagggcaacaaggtcagcagccaggacaaggacaacaatcaggacaaggacaacaaggatactacccaacttctctgcnacagccangacaagggcaacaactgggacaagggcaaccagggtactaccnaacttagcagcattcggaacaagggcagcagccaggacaaggaaaacanccaggacaaggacnacaaggnnactacccaacttttcctnaacagtcaggacaanggcancanctgggacaaggncaaccnggtgtactacccaacttntccacagcatgtcaggacaaggacaacattcaggacaaggacnacnagggtactacccaacttttccgnancagtcaggacaagggcaacanccggnncaagggcaatntgngtacttancaacttttcggnagcanncnggacacgggcaggagccaggacanggactacagttggtcaagggcaacanggtcagcaaccaggacaaggacaacaagcgtactacccaacttnttcgcaacagtcaagacaaaggcaacangcaggacaatggcaacgaccgggacaagggcaaccagggtactacccancctttccccannaacccnggacaaggagcacaattnnggacaagcgcnacattcagggcnatgggcactagggtactacccaactttttccgcacaaccaggccaattgca

SEQ ID NO: 77241 - DNA, 640 bp, Triticum aestivum
  Clone ID: PAT_TA_77241
gcagcaaatccagtacgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattcccccagactcaacaaccacaacaaccatttccccagttccagcaaccacaccaaccttttccccagccccaacaacaattcccgcagccccaacaaccgcaacaatcattcccccagcaacaacgaccgttcattcagc

SEQ ID NO: 77242 - DNA, 593 bp, Triticum aestivum
  Clone ID: PAT_TA_77242
tgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggcatgggc

SEQ ID NO: 77243 - DNA, 646 bp, Triticum aestivum
  Clone ID: PAT_TA_77243
gcaggaacggaaccacaaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttcgctgggaagcagctggaggatggccgtaccctcgctgactacaacatccagaaggagtccaccctccaccttgtcctgcgtctgcgtggtggcatgcagatcttcgtgaagaccctcactggaaagactatcacccttgaggttgagagctctgacaccatcgacaatgtcaaggccaagatccaagacaaggagggcattcccccggaccagcagcgcctgatctttgctggcaagcagctggaggatggtcgcaccctcgccgactacaacatccagaaggagtccacccttcacctggtgctccgcctccgtggtggtcagtaattgccctctcactcgacctgctgctgctgctgtaccctgtgtcgtcctgtgggtgcgcctttgttcaagtgctgtctcgtttgtgtgaagtcgtactgtg

SEQ ID NO: 77244 - DNA, 566 bp, Triticum aestivum
  Clone ID: PAT_TA_77244
gcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagc

SEQ ID NO: 77245 - DNA, 551 bp, Triticum aestivum
  Clone ID: PAT_TA_77245
cctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacaacaatgcaaccctgtgtcattggtgtcatccctcgtgtcaatgatattgccacgaagtgattgccaggtgatgcagcaacaatgttgcc

SEQ ID NO: 77246 - DNA, 597 bp, Triticum aestivum
  unsure (1)..(597): unsure at all n locations
  Clone ID: PAT_TA_77246
ggctgaggaattcggcacgaggcctcgtgccgcagatctcccagcaaccacaacaactcccccagcaataacaaatcccccagcaaccacaacaatttctccaacaacaacaattcccccagcaacaacccccccaacaacatcaatttccccaacaacaattgccccagcaacaacaaatcccccaacaacaacaaatcccccagcaaccacaacaaatncccaacaacaacaaatnccccagnngncacaacaattcccncaacaacaattgccgnaacaacaatttccccaacagcaattgccgcaacaggaattcccacaacaataacaattgccgcaacaaaaaatcgcccagcaaccacaacaactccccgcaacaacaacaagatcccccagcaaccacnncnatttccccaacaacaacaattncccnagcaanaatcaccccaacaacagcaatttccccaacaacaattnccncaacaacaacanttnccacaanaacaattgccggcnaccacaacaaatncccgancaacaacaaatnccncaggaaccacancgnttnncccagcagcaatnnccccancaaca

SEQ ID NO: 77247 - DNA, 509 bp, Triticum aestivum
  unsure (1)..(509): unsure at all n locations
  Clone ID: PAT_TA_77247
tttccccagttccagcaaccacaccaaccttttccccagccccaacaacaattcccgcagccccaacaaccgcaacaatcatttnccctgcaaccgcaacaaccattcccccagcaaccgcaacaaccattcccccagcaaccgcaanaatcatttcccgagnaaccacaacaaccattnccccagcaaccgcaacaaccattcccccaanagcnacaacaaccatttccctnaacaaccacaacaaccattccncctacgaccggaacaaccatttgcccagcaaccccaacaatcacaacaatcatttncncagncccaaccccagcaaccccancaaccatgcatncttcaaccacagncaaccattanccntaacaaccacaacaacnaatttcaanagcgncnaacgaacaattatcccagcaaccagaacaaacaatttnccagnaaccccaacaaccattgncccccagcanccacaccaaccttnancaaccatatncaca

SEQ ID NO: 77248 - DNA, 915 bp, Triticum aestivum
  unsure (1)..(915): unsure at all n locations
  Clone ID: PAT_TA_77248
gaacaactgggacaagggcaaccagggtactacccaacttcacagcagccaggacaaaagcagcaggcaggacaagggcaacaatcaggacaaggacaacaagggtactacccaacttccccgcaacagtcaggacaagggcaacaaccgggacaagggcaaccagggtactacccaacttctccgcagcagtcaggacaatggcagcaaccaggacaagggcaacaaccaggacaagggcagcaatcaggacaagggcaacaaggtcagcagccaggacaagggcaacgaccaggacaaggacaacaagggtactacccaatttctccgcaacagccgggacaagggcaacaatcaggacaagggcaaccagggtactacccaacttctttgcggcagccaggacaatggcagcaaccaggacaagggcagcaaccaggacaagggcaacaaggtcagcagccaggacaaggacaacaatcaggacaaggacaacaaggatactacccaacttctctgcaacagccaggacaagggcaacaactgggacaagggcaaccagggtactacccaacttcncagcagtcggaacaagggcagcagccaggacaaggaaaacaaccaggacaaggacaacaagggtactacccaactttctncgcaacagtnaggacaagggcaacaactggggacaagggcaaccagggntactacccnacttcttcacagcagtcangacanggacaacaattacggacaaggacaacaagggtactatcccaacttttccggaacanntaaggacaagggcanaaccgggacaagggcnatccggggtacttttccaacttnttngcgcanntaaggnaagggcagcagccaggcnanggnacattcggganangggncacnngg

SEQ ID NO: 77249 - DNA, 644 bp, Triticum aestivum
  Clone ID: PAT_TA_77249
gcccgccacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaacgaggacaagtacacctcagacgttaacattgtctcaaatgctagctgcaccactaactgccttgctcccctagctaagatcattaatgacaacttcggtattattgagggtttgatgaccactgttcatgccatcactgccacacagaagaccgttgatggtccctcgagcaagg

SEQ ID NO: 77250 - DNA, 696 bp, Triticum aestivum
  Clone ID: PAT_TA_77250
agtcgaccccggctaccaagtacattggcccaacaacaaccattcccccagccccaacaaccattctgccagcaaccacaacaaactattccccaaccccatcaaacgttccaccatcaaccacaacaaacatttccccaaccccaacaaacatacccccatcaaccacaacaacaatttccccagacccagcaaccacaacaaccatttccccagccccaacaaacattcccccaacaaccccaactaccatttccccaacaaccccaacaaccattcccccagcctcaacaaccccaacaacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaagtgattgccaggtgatgcagcaacaatgttgccaacaactggcacagattcctcagcagctccagtgtgcagccatccatagtgtcgtgcattccatcatcatgcagcaagaacaacgacaaggcgtgcagatccggcggccactgtttcagctcgttcagggtcagggcatcatc

SEQ ID NO: 77251 - DNA, 544 bp, Triticum aestivum
  unsure (1)..(544): unsure at all n locations
  Clone ID: PAT_TA_77251
gcaccagncccgacacctnangnctcaacncccgatcgatggcgcccaaggccgagaagaagcccgcggagaagaagccggccgccgaggtcgcggagaaggccgagaagacccccgccggcaagaagcccaaggcggagaagcggctgccggcgtccaagtccgccaaggagggcggcgacaagaaggggcggaagaagaacaagaagagcgtggagacctacaagatctacatcttcaaggtgctcaagcaggtgcacccggacatcggcatctcctccaaggccatgtccatcatgaactccttcatcaacgacatcttcgagaagctcgccggcgaggcggccaagctggccaggtacaacaagaagcccaccatcacgtccagggagatccagacctccgtccgcctcgtcctccccggcgagctcgccaagcacgccgtctccgagggcaccaaggccgtcaccaagttcaccagcaactagggagggaaggtgtatctctagggttccgtcgccgtgttctcctctagcttctgtgt

SEQ ID NO: 77252 - DNA, 200 bp, Triticum aestivum
  unsure (1)..(200): unsure at all n locations
  Clone ID: PAT_TA_77252
agccgccgagctcgtctcgccgtcgtcgcgctctaggcttttgggatggaggccgagacggcggcgaagagggcgcgggagaacgagggcgctgcggcggcggacggagccggggagcaggcggggatctccgccgtcatccccggatggttctccgagatcagccccatgtggcccggcgaggcgcactcnctcaaggt

SEQ ID NO: 77253 - DNA, 617 bp, Triticum aestivum
  unsure (1)..(617): unsure at all n locations
  Clone ID: PAT_TA_77253
tacgtagtagtnacgcaaatcgacctgaagaccttactcatcctgacgatccttgcgatggcaataacctcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattcccccagactcaacaaccacaacaaccatttccccagttccagcaaccacaccaaccttttccccagccccaacaacaattcccgcagccccaacaaccgcaacaatcattcccccagcaacaacgaccgttc

SEQ ID NO: 77254 - DNA, 169 bp, Triticum aestivum
  unsure (1)..(169): unsure at all n locations
  Clone ID: PAT_TA_77254
tgggagatctcgaccgcacaattaantgttacacacgaatgctttgggatgaagctgcctgaggaaaagagatgtnccanaagagaantacaccaatgcgtttcttggatatgggcctgaggatactaattttgcacttgagctgacttacaattatggtgttgacaag

SEQ ID NO: 77255 - DNA, 559 bp, Triticum aestivum
  Clone ID: PAT_TA_77255
gaggaattcggacgaggcgttgcacaagaattcctccccccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgc

SEQ ID NO: 77256 - DNA, 553 bp, Triticum aestivum
  Clone ID: PAT_TA_77256
tgaagacctttctcatccttgccctccttgctatcgtggcgaccaccaccacaactgcagttagagttccagtgccacaattgcagccacaaaatccatctcagcaacaaccacaagagcaagttccattggtgcaacaacaacaatttctagggcagcaacaacaacaatttccagggcaacaacaaccatttccaccacaacagccatatccgcagccgcaaccatttctgccacaactaccatatccgcagccgcaaccatttccaccacaacaatcatatccacaaccacaaccacaatatccgcaaccacaacaaccaatttcgcagcaacaagcacaactacaacaacaacaacaacaacaacaacaacaacaacaacaaatccttcaacaaattctgcaacaacaactgattccatgcagggatgtcgtcttgcaacaacccaatatagcacatgcaagctcaaaagtatcgcaacaaagttaccaactgttgcaacaattatgttgtctgcaactgtggcagacccccgagcagtcacggtgcca

SEQ ID NO: 77257 - DNA, 576 bp, Triticum aestivum
  Clone ID: PAT_TA_77257
acacaaatccccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacacacatttccccaaccccaacaaacattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgt

SEQ ID NO: 77258 - DNA, 434 bp, Triticum aestivum
  unsure (1)..(434): unsure at all n locations
  Clone ID: PAT_TA_77258
ccccaacaatcccaacaatcacaacaaccttttgcccagccccaacaattatttcctgaactccaacaaccaattccccagcaaccacaacaaccattccccctgcaaccgcaacaaccattcccccagcaaccgcaacaaccattcccccagcaaccgcaacaatcatttccccagcaaccacaacaaccattcccccagcaaccgcaacaaccattcccccaacaaccacaacaaccattccctcaacaaccacaacaaccattccgcctacgaccgcaacaacnatttncncagcnacccnaacaatcacaacaatnatttccccagccccnacccgagcaaccccaacaaccatccatcnttgaacnacnacaacgattactnccaacaaccacnacaaccattnttaacagccccnacnacaattatnc

SEQ ID NO: 77259 - DNA, 695 bp, Triticum aestivum
  Clone ID: PAT_TA_77259
gagaaaataaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgc

SEQ ID NO: 77260 - DNA, 584 bp, Triticum aestivum
  Clone ID: PAT_TA_77260
catctttgctctccttgccttgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacaacaacaacaacaacaacaacaaccaccattttcgcagcaacaacaaccagttctaccacaacaaccaccattttcacaacaacaacaaccccaacagtcgggccaaggtgtctcccaacaccaacagcagtcgcagcagcagcagcaactcggacagtgttctttccaacaacctcaacaactacaacaattgggtcagcagccctcaacaacaacagataccacagggtatattcttgcagccacaccagatatctcaacttgaggtgatgactt

SEQ ID NO: 77261 - DNA, 574 bp, Triticum aestivum
  Clone ID: PAT_TA_77261
cgtgctgcagttcacggtgaagcatgagcagaagcttgactgcggtggtggttacgtcaagttgcttggaggtgatgttgaccagaagaaatgctgtagggcgtgtcaccacgaaggttcacactatccttaccaaggatggcaagaaccatttgatcaagaaggacgtgccttgcgagactgatcagctgtcgcacgtgtacactttgatcatccgccctgatgctacatacagcattctcattgacaacgaagagaagcaaactggaagcatctacgagcactgggatattcttcctcccaaggaaatcaaggacccagaagctaagaagccagaggactgggatgacaaggagtacattcctgaccctgaggatgtcaagccagagggctacgatgatattcccagggaggtcaccgatcctgatgctaagaagcctgaggattgggatgatgaggaagatggtgaatggactgccccaaccatccccaacccagagtacaagggcccatggaagcaaaagaaaatcaagaaccctaactaccagggcaaatggaaggcacctatgattgc

SEQ ID NO: 77262 - DNA, 327 bp, Triticum aestivum
  unsure (1)..(327): unsure at all n locations
  Clone ID: PAT_TA_77262
ctacaacaacaggtgaacccatgcaagaatttcctcttgcagcaatgcaaacctgtgtcactggtgtcatccctctggtcaatgatctggccacaaagcgattgccaagtgatgcggcancaatgctgccaacaactagcacagattcctcagcagctccagtgtgcagccatccataccgtcatacattccatcatcatgcancangaacaacaacaaggcatgcatatcctgctgccactatatcagcagcaacaggtgggtcaaggtactctcgtncagggncagggcatcatccaaccccaacaaccagctcaattggaggcg

SEQ ID NO: 77263 - DNA, 709 bp, Triticum aestivum
  unsure (1)..(709): unsure at all n locations
  Clone ID: PAT_TA_77263
gcttctccgcagcaactcaggnacaagggcagcagccaggacaattgcaacaaccagcacaagggcagcaaccagaacaagggcaacaaggtcagcagccaggacaagggcaacaaggccagcagccaggacaagggcagcaaccgggacaagggcaaccagggtactacccaacttctccgcagcagtcaggacaagggcaaccagggtactacccaacttnttcgcancagccaacacaatcgcagcaaccaggacaagggcaacaaggtcagcaggtaggacaagggcaacaagctcagcanccaggacaagggcagcaaccgggacaagggcagccagggtactacccaacttatncgctgcagtcaggacaagggcaaccagggtactacctaacttctccgcagcaatnaggacaagggcagcagccaggacaattgcnncaatcagtacaagggcaaaaaggacancaaccaggacaaggtcaacagntagggcaagggcaacaaggtcagcaancaggacaagggcancaaggtcancaaccggntcaagggcattaagggttttacncnactttctncgnacaatcaggacaagggcannnnccaggacaatggcnncaaccnggncaagggcnaccagggtttctncccnacttcttcgttncatcnnggacaagggcnaccngggnctnacccnactt

SEQ ID NO: 77264 - DNA, 484 bp, Triticum aestivum
  Clone ID: PAT_TA_77264
ggttttgcaacaaagtacttaccagctgttgcaagaattgtgttgtcagcacctatggcagatccctgagcagtcgcagtgccaggccatccacaatgttgttcatgctattattctgcgtcaacaacaaaaacaacaacaacaaccatcgagccaggtctccttccaacagcctcagcaacaatatccattaggccagggctccttccggccatctcagcaaaacccacaggcccagggctctgtccagcctcaacaactgccccagttcgaggaaataaggaacctagcgctacagacgctacctgcaatgtgcaatgtctacatccctccatattgcaccatcgcgccatttggcatctttggtactaactaagaagaaaataactctagtactagatatatgaaacaccgttttctcagtccatggtttggtcgttgtagcggtgaaaaaataaagtgacatgcactatcaaaaaaaaaa

SEQ ID NO: 77265 - DNA, 593 bp, Triticum aestivum
  Clone ID: PAT_TA_77265
gaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggcatgggcg

SEQ ID NO: 77266 - DNA, 622 bp, Triticum aestivum
  Clone ID: PAT_TA_77266
gccggagctcgttagggttttctgttttttcgggggagaaatctcaagaggcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaggagcaacctgcttttgacaagaagcagtttatctctcacatgaagcgctacatcaagaacctcactgccaagcttgaaggggatgacctagatgttttcaagaagaatgttgagtctgccacgaagtatcttcttagcaagctcaaggaccttcagttctttgttggcgagagcatgcatgatgatggcggcgtggtgttcgcgtactacaaggagggagctgctgatccaactttcctgtactttgcacatgggctgaaagaggtcaagtgctaatggcacagtatgctaaaatctttggggtcgtcagtatttttgctctgctctatgtat

SEQ ID NO: 77267 - DNA, 631 bp, Triticum aestivum
  unsure (1)..(631): unsure at all n locations
  Clone ID: PAT_TA_77267
gcctctctcccccgccccctccccccaggnaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagcttgctgtgcgagaacggacctgagctgtgtgcggtggtgtcataaggagcctatccatct

SEQ ID NO: 77268 - DNA, 631 bp, Triticum aestivum
  unsure (1)..(631): unsure at all n locations
  Clone ID: PAT_TA_77268
caacaattcccgcaacaacaatttccccaacagcaattcccgcaacagcaattcccacaacaacaacaattcccgcaacaaaaaatcgcccggcaaccacaacaactcccccaacaacaacaaatcccccagcaaccacaacantttccccaacaacaacaattcccccagcaacaatcaccccaacaacagcaatttccccaacaacaattgcccccaacnacaacaattacngcaacaacaattgcnccaaccacnacaaatacccgaacaacaacaattccnccagcaacantnaccccaacaacagcngatttccccaacancnanttcccccaacancaananttaccgcaacatcanttccggccaaccacaaaaantncngcaacaacaacanatcccccaacangngancanttnccccagcaacaatttccgcaacaacagcaatttccncaacaacaagaatttccccaacagcaattcccgcancaacaattncaccaacaacaattaccacaacancaatttccccaacaacaattnccccaacagcaattcccccaacaacaacagttcccccaacaacaacaattaacgcaacaacaattccccccggccacaacaa

SEQ ID NO: 77269 - DNA, 585 bp, Triticum aestivum
  Clone ID: PAT_TA_77269
tacgtagtagttaacgcaaatcgaccatgaagaccttactcatcctgacgatccttgcgatggcaataaccatcagcaccgccaatatgcaggtcgaccctagtggccaagtacaatggccacaacaacaactagtcccccaaccccaacagccattatcccagcaaccgcaacaagcatttccccaaccccaacaaacatttccccatcaaccacaacaacaagttccccagcctcagcaaccacaacaaccatttctccagccccaacaagcattcccccaacaaccacaacaaccattccctcagactcaacaaccacaacaaccatttccccagcaaccacaacaaccattcccccagactcaacagccacaacaaccatttccccagcaaccacaacaaccatttccccagcaatcacaacaaccattcccccagactcaacaaccacaacaaccatttccccagcaaccacaacaaccattcccccagactcaacaaccacaacaaccatttccccagttccagcaaccacaccaaccttttccccagccccaacaacaattcccgcagccccaacaac

SEQ ID NO: 77270 - DNA, 564 bp, Triticum aestivum
  Clone ID: PAT_TA_77270
gccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacagaggaagcaaagaagagcaacaatgtccagaggaagcttgagaagcgccagcagggacgtacactggactcgcacattgaggagcagttcagtggtggaaggctg

SEQ ID NO: 77271 - DNA, 352 bp, Triticum aestivum
  unsure (1)..(352): unsure at all n locations
  Clone ID: PAT_TA_77271
cccacaacaacaacaatttcccgcaacaaaaaatcgcccggcaaccacaacaactcccccaacaacaacaaatcccccagcaaccacaacaatttccccaacaacaacaattcccccagcaacaatcaccccaacaacagnaatttncccaacaacaatttccccaacaacaacaattaccgcnacaacaattgncccaaccacaacaaatacccnngcaacaacanttttttnntgcnacaatnaccccaacaacagcgatttncccaacaacaatttctccaacaacaanaatttccgcgacaacaatttccccaaccacaaaaattacnnnaacaacaacaaatncncc

SEQ ID NO: 77272 - DNA, 440 bp, Triticum aestivum
  unsure (1)..(440): unsure at all n locations
  Clone ID: PAT_TA_77272
aacaaccatttccccctgcaaccgcaacaaccattcccccagcaaccccaacaaccatttccccagccccaacaaccaatccccgtgcnaccacaacaattattcccccaacnntcccaacaatgacaacaaccttttgcccagcgcccgacaattatttgctgaactccaacaaccaattcnccagcaaccacaacaaccattccccctgnangcgnaacaaccattccctcagcaaccgcaacaaccattcccccagcaaccgcaacaatnatttncccagcaaccacaacaaccattcnnncagcaaccgnaacaaccattcccncannaaccacaacaaccattccntcaacaaccacnacaaccattncccctacgaccgnaacaaccatttncccagnaaccccaacaattacaacaatgattttcccagcccc

SEQ ID NO: 77273 - DNA, 549 bp, Triticum aestivum
  Clone ID: PAT_TA_77273
gccctcccctgcctgccaacccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaatgttgagaacgttgaggacaaccgccgtgccctccgtgagctcctcttctgcacccctggtgccctccagtacctcagcggtgtgatcctcttcgaggagaccctgtaccagagcaccaagggtggcaagcccttcgtcgacatcctcaaggcgggcaatgtcctccccggaatcaaggtggacaagggtaccatcgagcttgctggaaccaacggtgagaccaccacccagggctttgatgaccttggcaagcgctgcgccaagtactatgaggctggtgcccgcttcgccaagtggcgtgcagtccttaagatcggcgccaccgagccatcacagctctccatcgaccag

SEQ ID NO: 77274 - DNA, 596 bp, Triticum aestivum
  Clone ID: PAT_TA_77274
tgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggcatgggcggc

SEQ ID NO: 77275 - DNA, 926 bp, Triticum aestivum
  unsure (1)..(926): unsure at all n locations
  Clone ID: PAT_TA_77275
gaggaattcggcacgagggagaaatctcctccgatcgaagcgaagccaggctctctcgtccccctcctcaagatgcagatctttgtgaagaccctcaccggcaagaccatcacccttgaggtcgagtcctccgacaccatcgacaacgtcaaggctaagatccaggacaaggagggcatccctccggaccagcagcgcttgatcttcgctggcaagcagctcgaggatggccgcaccctggcagactacaacatccagaaggagtccacccttcacctggtgctcaggctccgtggtggcatgcanatatttgtgaagacactcaccggcaagaccatcaccctggaggttgagtcctcggacaccatcgacaacgtnaaggctaagatccaggacaaggagggcatccctccggaccagcagcgtctnatctttgctggcaagcagctcgaggatggccgcacccttgctgactacaacatccagaaggagtccaccctncacctggtgctcaggctccgtggtggcatgcagatatttgtgaagaccctcacnggcaagaccatcaccctggaggttgagtcttnnggacaccatcgacaacgtgaaggctaagatccaggacaaggagggcattcctccggaccagcagcgcttgatctttgctggcaagcagctngaggatggccgcacccttgcagactacaacatccagaangagtccacccttcaccttggtgctcaggcttcgtgggnggcatgcaaatatttgggaagaccctcacnggcaagancatcaccctcgagggtggtcccnnnggaccccattgnaaaagggaagggcaagatccaggacaaggaggggattcccccggaccaaaanngttttattttttgctgcaagcacnttgnggagggcccaccct

SEQ ID NO: 77276 - DNA, 460 bp, Triticum aestivum
  unsure (1)..(460): unsure at all n locations
  Clone ID: PAT_TA_77276
tcccccccgagcatcgaccatgtcggcctactgcggaaagtacaaggatgagctcatcaagaacgctgcctacatcggcacccctggcaagggtatcctcgctgctgatgagtccaccggcaccatcggcaagcgctttgccagcatcaatgttgagaacgttgaggacaaccgtcgtgccctccgtgagctcctcttctgcacccctggtgccctccagtacctcagcggcgtgatcctgtttgaggagaccctgtaccagagcaccaagggtggcaagcccttcgtcgacatcctcaaggcgggcaatgtcctccctggcatcaaggtggacaagggtaccattgagcttgctggaaccaacggtgagaccaccacccagggctttgatgaccttggcaagcgctgcgccaagtactatgaggctggtgcccgcttcgccaagtggngtgcagtcctc

SEQ ID NO: 77277 - DNA, 561 bp, Triticum aestivum
  unsure (1)..(561): unsure at all n locations
  Clone ID: PAT_TA_77277
caggncaagggcaacgacgcggtacaagggacaacaagggtactacccaatttctccgcaacagccggggacaagggcaacaatcaggacaagggcaaccagggtactacccaacttctttgcggcagccaggacaatggcagcaaccaggacaagggcagcaaccaggacaagggcaacaaggtcagcagccaggacaaggncaacaatcaggacaaggacaacaaggatactacccaacttntctgnancanncaggacaagggcatcaactgggacaagggcaaccagggtactacccaacttancngtattcggtcaagngnngcatncangtacaangcaaaacnaccnggacaangacaacaaggnttntantccanctttttcctgnncattnaggacaagggcaacatcttggacaagggcaacctggtgtnctattccancttntntncngcattcaggacaaggacngcttttcaggacaangacancanggnttctanncaacttttttntgtncatttcaggacaagggctncataccaggacaagggc

SEQ ID NO: 77278 - DNA, 408 bp, Triticum aestivum
  unsure (1)..(408): unsure at all n locations
  Clone ID: PAT_TA_77278
tgtcggcctactgcggaaagtacaatggatgagctcatcaagaacgctgcctacatcggcacccctggcangggtatcctcgctgctgatgagtccaccggcaccatcggcaagcgctttgccagcatcaatgttgagaacgttgaggacaaccgtcgtgccctccgtgagctcctcttctgcacccctggtgccctccagtacctcagcggcgtgatcctgtttgaggagaccctgtaccagagcaccaagggtggcaagcccttcgtcgacatcctcaaggcgggcaatgtcctccctggcatcaaggtggacaagggtaccattgagcttgctggaaccaacggtgagaccaccacccagggctttgatgaccttggcaagcgctgcgccaagtactatgaggct

SEQ ID NO: 77279 - DNA, 595 bp, Triticum aestivum
  unsure (1)..(595): unsure at all n locations
  Clone ID: PAT_TA_77279
tgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccangttccacatcaaaagttgaacccatgcagggatgccctcctacaacagtgtagcccagttgctgatatgtcgttcctccggtcacaggtggtgcaacatagcagctgcttggtaatgtgggagcagtgttgtcagcaactaaaagcgatccccaagcagtcaagatgtgaggccatccacaacgtcgtgcacgccatcgttttgcaacagcaacaacaattggtacaaggtatttccacccaacctcagcagcaacaacaacaaggtcaacaacaacaaggtcagggttctagccagccacaacaacaaacacaactggatcagggttggattgcggtgatagggacatgggtgattcagaccattccggcaatgtgcgacgtgcatgttccaccatactgctacaccaccatatcaccatccattgacgtcactaccggcatgggcg

SEQ ID NO: 77280 - DNA, 387 bp, Triticum aestivum
  unsure (1)..(387): unsure at all n locations
  Clone ID: PAT_TA_77280
cattaattgcctgaacaagtaggtcaggcacatcacactccactagcttaaccacaccgccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcangagcctcgccaccagcatca

SEQ ID NO: 77281 - DNA, 881 bp, Triticum aestivum
  unsure (1)..(881): unsure at all n locations
  Clone ID: PAT_TA_77281
acaattgcaacaaccagcacaagggcagcaaccagaacaagggcaacaaggtcagcagccaggacaagggcaacaaggccagcagccaggacaagggcagcaaccgggacaagggcaaccagggtactacccaacttctccgcagcagtcaggacaagggcaaccagggtactacccaacttcttcgcagcagccaacacaatcgcagcaaccaggacaagggcaacaaggtcagcaggtaggacaagggcaacaagctcagcagccaggacaagggcagcaaccgggacaagggcagccagggtactacccaacttntccgctgcagtcaggacaagggcaaccagggtactacctaacttctccgcagcagtcaggacaagggcatcagccaggacaattgcaacaatcagcacaagggcaaaaaggacagcaaccaggacaaggtcaacagccagggcaagggcaacaaggtcagcagncaggacaagggcaacaaggtcagcaaccggggcaagggcagccagggtactacccaacttctgcgcagcaatcaggacaagggcaacagccaggacaatggcaacaaccaggacaagggcaaccaggatactacccaacttntccgttgcagccaggacaagggcaaccagggtaccacccaacttatncgcaacagncaggacaagggcagtaaccaggacaattgcaacaaccagcacaagggcaacaagggcagcaactagcacaagggcaacaagggcagcaaccagcacaagngcaacaagggcannagncagcacaagggcaacaagggcagcagntnggacaagggcnacnaggtcagctaaccaggacaagggcagnaacccgcacaangg

SEQ ID NO: 77282 - DNA, 781 bp, Triticum aestivum
  unsure (1)..(781): unsure at all n locations
  Clone ID: PAT_TA_77282
gcacgaggcagcaaccaggnacaagggcagcaaccaggnacaagggcaacaaggtcagcagccaggacaaggacaacaatcaggacaaggacaacaaggatactacccaacttctctgcaacagccaggacaagggcaacaactgggacaagggcaaccagggtactacccaacttcgcagcagtcggaacaagngcagcanccaggacaaggaaaacaaccaggacaaggacaacaaggntnctacccaacttctccgcancantcaggacaagggcaacanctgggacaagggcaaccaggntactacccancttctccncngnatncaggacaaggacaacaatcaggacaaggacaacaaggntnctacccaacttntccggaacattcaggacaagggcancanccngnacaagggcaatntggtgtacttcccaacttctcngcagcatgtcaggacaagggcatnatccaggacaaggacnacatgncggnacaagggcaacaaggtcngcaaccaggacaaggacatcaagcgtactacccaanttcttcgcaacagtcaagacaaaggcaacaagcaggacaatggcaacgaccgggacaagggcaaccagggtactacccaacctctccacagnaaccaggacangagcaacaatcaggacaagcgcatcaatcaggacaatggcnnctagtgtactacccaacttntncgcaacagccaggncaattgcnacaaccagnacaagggcaacaaccagnacaagggcaacaa

SEQ ID NO: 77283 - DNA, 539 bp, Triticum aestivum
  Clone ID: PAT_TA_77283
cattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacaacaatgcaaccctgtgtcattggtgtcatccctcgtgtcaatgatattgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagatcctccggccactgtttcagctcgtccaaggtcagggcatcatc

SEQ ID NO: 77284 - DNA, 633 bp, Triticum aestivum
  Clone ID: PAT_TA_77284
tggagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgtcgtgcacgccattattttgcaacaacaacaacaattggtacaagctacttccacccaacctcagcagcagcaacaacaaggtcaacaacaacaacagggtctgagttctagccagccacaacaacaaacacaactggatcagggttggattgcggtgatagggacatgggtgattcagaccatcccggcaatgtgcgacgtgcatgttccaccatactgctacaccaccatatcaccatccagtgacgtcactaccgacatgggcggc

SEQ ID NO: 77285 - DNA, 646 bp, Triticum aestivum
  Clone ID: PAT_TA_77285
ggcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgt

SEQ ID NO: 77286 - DNA, 524 bp, Triticum aestivum
  unsure (1)..(524): unsure at all n locations
  Clone ID: PAT_TA_77286
ggnctgcaggnaattcggcacgaggcacaacaacaacaattcccgcaacaacaaatcgcccagcaaccacaacaactcccccaacaacaacaaatcccccaacaaccacaactatttccccaacaacaacaattcccccagcaacaatcaccccaacaacagcaatttnnccaacaacaattcccccaacancancaattaccgcnacaacaattncnccaannacgncaaatacncgaacagcancaggtggccccagcaactnacagatattnccccagcgacaattaccctaacaacagcaatttctgncagnaacangaattccnnnaacagcnattcccggaacancanttgcancaacaacaattaccacaacancngnnnggncancagcaattcccccaacagcanttgcnccaacaacaacagttccnccaacaacancaattaacgcaacaacaattcccccggcnacaacaatcccctgaacaacancaattcntccnacaacaattccccca

SEQ ID NO: 77287 - DNA, 557 bp, Triticum aestivum
  Clone ID: PAT_TA_77287
gcatccccaggtcataaacccaagtcggactcgccttcctcctccccaactactcctctcctctcctccgcgcatcgcaccggggtcacctgagatcacacacacaatggtgaaggctgtggctgtgcttaccggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccctgctggtcatgtgcatggggcacccgaagatgaaatccgccatgctggtgatcttggaaatgtgacagctggagtggatggtgttgctagcatcaatattactgactgccatatcccccttactggaccaaattcaattgttggccgtgctgttgtcgtccatggtgacgctgatgatcttggcaagggtggacatgagctgagcaagagcactggaaacgctggtgcacgtgttgcttgcggaatcatcgggctcc

SEQ ID NO: 77288 - DNA, 557 bp, Triticum aestivum
  unsure (1)..(557): unsure at all n locations
  Clone ID: PAT_TA_77288
tcggcacgaggcaacnttcccccagcactcaacaacgcccaacaaccattttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcaacaacaacaacaacaacaaggcatgcatatctttctgccactatctcagcagcaacaggtgggtcaaggttctctagtccaaggccagggcatcatccaaccacaacaaccagctcaattggaggcgatcagatcattggtattgcaaactcttccatccatgtgcaacgtgtatgtcc

SEQ ID NO: 77289 - DNA, 622 bp, Triticum aestivum
  unsure (1)..(622): unsure at all n locations
  Clone ID: PAT_TA_77289
gctctcctcctcctcctgccccgatcccgaaccgggnaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctc

SEQ ID NO: 77290 - DNA, 610 bp, Triticum aestivum
  Clone ID: PAT_TA_77290
ggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctg

SEQ ID NO: 77291 - DNA, 630 bp, Triticum aestivum
  Clone ID: PAT_TA_77291
gctctcctcctttctctcctcctcctgccccgatcccgaaccgggaggaacccggcgcgaggagggcaaaggaagagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctgaaatcactgacaagcttggcctgcattccctgcgccagcgacactggtacatccagagcacatgtgctacctc

SEQ ID NO: 77292 - DNA, 645 bp, Triticum aestivum
  Clone ID: PAT_TA_77292
tggtgtagataacccgatagcatgcatattaaccaggtgcataacaggttaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtacttgccgtggcgggggtcacacttggc

SEQ ID NO: 77293 - DNA, 282 bp, Triticum aestivum
  Clone ID: PAT_TA_77293
ctgtgtttgtcttttatttccaagtttgaactagtatagtttgggttcttacatgatagtgcatgccacattattttttcaccgctacaacgaccaaaccatggactgagaaaacggtgtttcatatatctagtactagagttattttcttctcagttagtaccgaagatgccaaatggcgcgatggtgcaatatggagggatgtagacattgcaaattgcaggtagtgtctgtagcgctaggttccttatttcctcgaactggggcagttgttgaggctgc

SEQ ID NO: 77294 - DNA, 443 bp, Triticum aestivum
  unsure (1)..(443): unsure at all n locations
  Clone ID: PAT_TA_77294
cacaattatcagaaagttttgagggacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgnagtaggcgaacaccacgccgccatcatcatgcatgctctcgccaacaaagaactgaaggtccttgagcttgctaagaagatactttgtggcggactcaacattcttcttgaaagcatctangtcatccccttcaagcttggcaganaggntnttgatgtanngcttnatgtgagagataaactgnttnttgnnaaaagcannntgntnctnaanacnganngnnnnaannntnnnnnnnnnnt

SEQ ID NO: 77295 - DNA, 235 bp, Triticum aestivum
  unsure (1)..(235): unsure at all n locations
  Clone ID: PAT_TA_77295
acatgatganggngaagctgcaggtgatgctnagggtggnnactctgaggtagaaggctgacatatccatcatcagttatgtcaatcagctgataatcttggcggtcaacatgggggacgtcacagntgngggatgaaggaacgatatnctcaagcttntttncattaaagatgtnaatggcaacaaagngacactntgcntgaccatgcttnccannnttgnangngnanacct

SEQ ID NO: 77296 - DNA, 285 bp, Triticum aestivum
  Clone ID: PAT_TA_77296
actaataacagcagtctccgcgtaacaaacccgaccacccccgaccacaacacaaagtaagtagagcaccaattatccatgtctcctcccccctacgaaccaattttaaaccatctacagctcatcatggtcctcgtcgtcgacgccgccgtcggcgccctcgccgccgggagctccgccggacctctggtacaccgccgacacgatggggttgcacacggcctccacctccttgagcttctcctcgtagtcctccttctcggccgtctggttctcatccagcca

SEQ ID NO: 77297 - DNA, 161 bp, Triticum aestivum
  unsure (1)..(161): unsure at all n locations
  Clone ID: PAT_TA_77297
agctcccaccgcggatggtttngnggaatgggttgcgatagcgcctagtgcgagtggttctgagaattgcgaggaagagcagccaaaggtagactcttgtagcgattatgttatggatcggngtgngatgaaggatatgccgctctnttggttctttcctc

SEQ ID NO: 77298 - DNA, 689 bp, Triticum aestivum
  unsure (1)..(689): unsure at all n locations
  Clone ID: PAT_TA_77298
ctggcaaacaagnaactttgtttgtcttttattccaagncttgaactagcactggccggtgtcacacatgatggtgcactccactttatttgtcatcgttacatcgattggtgcatcagctaagcaacgatgatccatctacctattagtatagctcttcagtttttcattggccaccaatgcccgcgactatgctggcaaatggtgccctcatgatggagcactctggtgggacatacacgttgcacatggatggaagagtttgcaataccaatgatctgatcgcctccaattgagctggttgttgtggttggatgatgccctggccttggactagagaaccttgacccacctgttgctgctgagatagtggcagaaagatatgcatgccttgttgttgttgttgttgttgctgctgctgcatgatgatggaatgcacgacgctatggatggctgcgcactggagctgttgaggaatctgtgctagttgttggcagcattgttgccgcatcacttggcaatcgctttgtggccagattattgaccagagggatgacaccaatgacgcaggtttgcattgttgcaagaggatattcttgcatgggttcaactgttgttgtagagatggttgaatgaatgacccgttgttgttgggggaatgattgttgccggttgttggggcctgcggt

SEQ ID NO: 77299 - DNA, 713 bp, Triticum aestivum
  Clone ID: PAT_TA_77299
gtaatgctggcaaacaagaactttgtttgtcttttattccaagcttgaactagcactggccggtgtcacacatgatggtgcactccactttatttgtcatcgttacatcgattggtgcatcagctaagcaacgatgatccatctacctattagtatagctcttcagtttttcattggccaccaatgcccgcgactatgctggcaaatggtgccctcatgatggagcactctggtgggacatacacgttgcacatggatggaagagtttgcaataccaatgatctgatcgcctccaattgagctggttgttgtggttggatgatgccctggccttggactagagaaccttgacccacctgttgctgctgagatagtggcagaaagatatgcatgccttgttgttgttgttgttgttgctgctgctgcatgatgatggaatgcacgacgctatggatggctgcgcactggagctgttgaggaatctgtgctagttgttggcagcattgttgccgcatcacttggcaatcgctttgtggccagattattgaccagagggatgacaccaatgacgcaggtttgcattgttgcaagaggatattcttgcatgggttcaactgttgttgtagagatggttgaatgaatgaccgttgttgttgggggaatgattgttgcgggttgttggggctgcggtaattgttgttggggctggggaa

SEQ ID NO: 77300 - DNA, 193 bp, Triticum aestivum
  unsure (1)..(193): unsure at all n locations
  Clone ID: PAT_TA_77300
ggtcggggtacacatgatggngnacgccactttattngaatcgntacatcgattggtgcatctgctaagtaacgatgatccatctatctattagtatagatcttgcttttttcattggccaccaatccccgcgactatgctggcaaatggtgccctgatgatgccctgatnnttttaaatggtgccctgatga

SEQ ID NO: 77301 - DNA, 287 bp, Triticum aestivum
  unsure (1)..(287): unsure at all n locations
  Clone ID: PAT_TA_77301
tcattggccaccaatgcccgcgactatgctggcaaatggtgccctcatgatggagcactctggtgggacatacacgttgcacatggatggaagagtttgcaataccaatgatctgatcgcctccaattgagctggttgttgtggttggatgatgccctggccttggactagagaaccttgacccacctgttgctgctgagatagtggcagaaagatatgcatgccttgttgttgttgttgttgttgctgctgctgcangatgatggaatgcacgacnctntggatgg

SEQ ID NO: 77302 - DNA, 210 bp, Triticum aestivum
  unsure (1)..(210): unsure at all n locations
  Clone ID: PAT_TA_77302
aacggggcaccaaaagggaacgaacanttggaggaaacggctccaattattacgcacagagggggggatggcttnagtnaagaagttcttattcgncttgctgataaaaaaaaacattgacatgcatatggtcacacagctaggtgaggnagntgatgaactcaatggcggtcgcnatggcacctncggtgatggnntncttggcganct

SEQ ID NO: 77303 - DNA, 702 bp, Triticum aestivum
  Clone ID: PAT_TA_77303
aatgctggcaaacaagaactttgtttgtcttttattccaagcttgaactagcactggccggtgtcacacatgatggtgcactccactttatttgtcatcgttacatcgattggtgcatcagctaagcaacgatgatccatctacctattagtatagctcttcagtttttcattggccaccaatgcccgcgactatgctggcaaatggtgccctcatgatggagcactctggtgggacatacacgttgcacatggatggaagagtttgcaataccaatgatctgatcgcctccaattgagctggttgttgtggttggatgatgccctggccttggactagagaaccttgacccacctgttgctgctgagatagtggcagaaagatatgcatgccttgttgttgttgttgttgttgctgctgctgcatgatgatggaatgcacgacgctatggatggctgcgcactggagctgttgaggaatctgtgctagttgttggcagcattgttgccgcatcacttggcaatcgctttgtggccagattattgaccagagggatgacaccaatgacgcaggtttgcattgttgcaagaggatattcttgcatgggttcaactgttgttgtagagatggttgaatgaatgaccgttgttgttgggggaatgattgttgcggttgttggggctgcggtaattgttgttgggg

SEQ ID NO: 77304 - DNA, 401 bp, Triticum aestivum
  unsure (1)..(401): unsure at all n locations
  Clone ID: PAT_TA_77304
atacatagccccgatagcattcacatacgagcatgctttctcgagcctgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagnttccacattgtccaataccggtcatcntactacccag

SEQ ID NO: 77305 - DNA, 516 bp, Triticum aestivum
  Clone ID: PAT_TA_77305
ccatacgagcatgctttctcgagacatgttggtacatgaacatggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacgtacgcgtcagggtactccttcttgacctcttccacctcgttgatcacctgtgtggcgtcggtgcacccgaacataggcagcttccacattgtccagtaccggccatcgtagtacccaggggatgcgttgtgctcacggaagatgaacccaaccttgctgaactcgaggcaaggcacccatttggagcggatcaggtagtcgacctgcttgaggagggcctccgtgctgagcggtggcaggtaggactagttctc

SEQ ID NO: 77306 - DNA, 340 bp, Triticum aestivum; identical to SEQ ID NO: 68433
  Clone ID: PAT_TA_77306

SEQ ID NO: 77307 - DNA, 911 bp, Triticum aestivum
  unsure (1)..(911): unsure at all n locations
  Clone ID: PAT_TA_77307
gctcatctttgctgggaagcagcttgaggacggccgcacccttgctgactacaacatccagaaggagtccaccctccacttggtgctccgcctgcgtggtgggatgcagatcttcgtcaagaccctcaccggcaagaccatcacgctcgaggtcgagtcttcggacaccatcgacaacgtgaaggcgaagatccaggacaaggagggcatccccccggaccagcagcgcctcatctttgccggcaagcagcttgaggacggccgcaccctcgctgactacaacatccagaaggagtccaccctccacctggtgctccgcctgcgtggtgggatgcagatcttcgtcaagaccctcaccggcaagaccatcacgcttgaggttgagtcttcggacaccatcgacaacgtgaaggcgaagatccaggacaaggagggcatccccccggaccagcagcgcctcatctttgccggcaagcagcttgaggacggccgcaccctcgctgactacaacatccagaaggagtccacccttcacctggtgctncgcctgcgtggtgggatgcagatcttcgtcnagacccttaccggcaagaccatcacgctcgaggtcgagtcctcggacaccatcgacaacgtggaaggcgaagatccaggacaaggagggcattcccccggacagcagcggcttattttttgccggaagcagcttgaggatggccgacccnttgttgactacaacattcagaangagtccaccctttcacctggggcttcgncttaagggggggnatgcaaaatctttggggaaganccttacccgcaagacccttaccgcttggnggncgagncnccgnccccatcccatnnggnaaggcnaaaatccccgncanggggggnnttncncgggacna

SEQ ID NO: 77308 - DNA, 440 bp, Triticum aestivum
  Clone ID: PAT_TA_77308
tcggcacgagggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaag

SEQ ID NO: 77309 - DNA, 510 bp, Triticum aestivum
  Clone ID: PAT_TA_77309
gaggaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccgaccccgacgcgcctcc

SEQ ID NO: 77310 - DNA, 194 bp, Triticum aestivum
  Clone ID: PAT_TA_77310
gaggccgacccatcctcatcgtctccacctcggcgaaaccctagcctagccccgccgaatcgcgagtccccccgaagccggagcaagccgagatgtcccgcaccggaccgatcgcccaggactgggagccggtggtcgtgcgcaagaagctgcccaacgccgccgccaagaaggacgagaaggccgtcaacgcc

SEQ ID NO: 77311 - DNA, 624 bp, Triticum aestivum
  Clone ID: PAT_TA_77311
gctcctctccgccgataatacaataccatggcccccgccgtgatggcttcgtcggctaccaccgtcgcacccttccaggggctcaagtccacggccggtctgcccgtcagccgccgctccagcggcagcctcggcagcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtctttcgtgagcacaacagctcccccgggtactacgacggccgatactggacaatgtggaagctgcctatgttcgggtgcaccgacgccacgcaggtgctcaacgaggtggaggaggtcaagaaggagtaccctgacgcctatgtccgcgtcatcggcttcgacaacctgcgccaggtgcagtgcgtcagcttcatcgcattcaggccaccgggttgcgaggagtctggcaaggcctaaactacgagttgaagcaatggcctatgtatgattgtcttttgtgaacttcacttttgtccaggactctgcttt

SEQ ID NO: 77312 - DNA, 573 bp, Triticum aestivum
  Clone ID: PAT_TA_77312
tggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcatttgtgaacttc

SEQ ID NO: 77313 - DNA, 567 bp, Triticum aestivum
  Clone ID: PAT_TA_77313
ggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcataaggagcctatcca

SEQ ID NO: 77314 - DNA, 647 bp, Triticum aestivum
  Clone ID: PAT_TA_77314
gccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctg

SEQ ID NO: 77315 - DNA, 621 bp, Triticum aestivum
  Clone ID: PAT_TA_77315
gctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccctctcc

SEQ ID NO: 77316 - DNA, 697 bp, Triticum aestivum
  unsure (1)..(697): unsure at all n locations
  Clone ID: PAT_TA_77316
gtgccagtaggcatatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattccagctctttacatagcagggggcagttctgatgcacctagtcaagcaccaatgcaacatcatggtcatcacggccatcatcaccatcaccatggtcatgaaagcaacaggcatttggctnctg

SEQ ID NO: 77317 - DNA, 612 bp, Triticum aestivum
  unsure (1)..(612): unsure at all n locations
  Clone ID: PAT_TA_77317
ggtccgcccgattccggcccgccccgcgcggatccggcccgtgcgctcgctgatttcgtgtttttcggcgcagggaaacccaccagccatgaagggggccaaatncaagggcgccgccaaggccgacaccaagttggcggtgaagagcaagggggcggagaagccggcggccaaggggaagaagggcanggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcgga

SEQ ID NO: 77318 - DNA, 574 bp, Triticum aestivum
  Clone ID: PAT_TA_77318
gcagcggcggcgccatggactcgtctcgtgtcggagaagacgtcgggggcctactccgccaacgcgttcccgtggagcaacgccatgctgcagtggcagcgcaccggcttccatttccagccggacaagtactaccagaacgatcccaacggtccggtatattatggcggatggtaccacttcttctaccaatacaacccgtcgggctccgtctgggaaccacaaatcgtgtggggccacgccgtgtccaaggacctcatccactggcgccacctcccgccggccttggtgcccgaccagtggtacgacatcaagggcgtcctcaccggctccatcaccgtgctccccgacggcaaggtcatcctcctctacaccggcaacaccgagaccttcgcgcaggtgacctgcctcgcggagcccgccgacccgagcgacccccttctcagggaatgggtcaagcaccccgccaaccccgtcgtgttcccgccccccggcatcggcatgaaggacttccgtgacccgaccaccgcgtggtacgacgagtccgacggcacgtggcgcaccatcatcggct

SEQ ID NO: 77319 - DNA, 597 bp, Triticum aestivum
  unsure (1)..(597): unsure at all n locations
  Clone ID: PAT_TA_77319
gctgtcctacttgccccgctcagcacggnaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggctatgtatatgcacggacgcataatattatacaatatgtcgactatatacgttttaatggtnaaaaaaaaa

SEQ ID NO: 77320 - DNA, 497 bp, Triticum aestivum
  Clone ID: PAT_TA_77320
cgtcgactctggcaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccagacacgtgagcacgccctccttgctttcactcttggagtgaagcagatgatctgctgctgcaacaagatggacgccaccactcccaagtactcgaaggctcgttacgaagaaattgttaaggaggtctcctcgtacctgaagaagg

SEQ ID NO: 77321 - DNA, 911 bp, Triticum aestivum
  unsure (1)..(911): unsure at all n locations
  Clone ID: PAT_TA_77321
ggttagcagatctggtccgatccgcccccctccgatctcgccgagaaatctcctccgatcgaagcgaagccaaggctctctcgtccccctcctcaagatgcagatctttgtgaagaccctcaccggcaagaccatcacccttgaggtcgagtcctccgacaccatcgacaacgtcaaggctaagatccaggacaaggagggcatccctccggaccagcagcgcttgatcttcgctggcaagcagctcgaggatggccgcaccctggcagactacaacatccagaaggagtccacccttcacctggtgctcaggctccgtggtggcatgcagatatttgtgaagacactcaccggcaagaccatcaccctggaggttgagtcctcggacaccatcgacaacgtcaaggctaagatccaggacaaggagggcatccctccggaccagcagcgtctcatctttgctggcaagcagctcgaggatggccgcacccttgctgactacaacatccagaaggagtccaccctccacctggtgctcaggctccgtggtggcatgcagatatttgtgaagaccctcaccggcaagaccatcaccctggaggttgagtcctcggacaccatcgacnaacgtnaaggctaagatccaggacaaggagggcattcctccgggaccagcagcgcttgatctttgctggcaagcagctcgaggatgggccgcaccctggcagactacaacatncagaaggagtccaccctttacctggngctcaggctncgtggtggcatgcaaattttttgnnaaaaaccctcaccgggcaagancatcaccctcgaggttgagtcctcngacacattgnnaaantgngaagggccagaatccaggacaagggnggggtnttcccnccggacca

SEQ ID NO: 77322 - DNA, 552 bp, Triticum aestivum
  Clone ID: PAT_TA_77322
tgtgcaagtatgaaccatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatattt

SEQ ID NO: 77323 - DNA, 574 bp, Triticum aestivum
  unsure (1)..(574): unsure at all n locations
  Clone ID: PAT_TA_77323
gnctgcaggnaattcggcacgaggccgacgctcaagcccccagnacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatcc

SEQ ID NO: 77324 - DNA, 587 bp, Triticum aestivum
  unsure (1)..(587): unsure at all n locations
  Clone ID: PAT_TA_77324
gcatatgcttgtctaaagattaagcctgcatgtgcaagtatgaaccaatttgaactgtgaaactgcgaatggctcattaaatcngttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagt

SEQ ID NO: 77325 - DNA, 973 bp, Triticum aestivum
  unsure (1)..(973): unsure at all n locations
  Clone ID: PAT_TA_77325
aggaattcggacgagggacagatcgaagccaggctttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctcgaggatggtcgtacccttgctgactacaacatccagaaggagtccaccctccacctggtgctccgccttcgcggtggtatgcagatcttcgtgaagaccctgacgggcaagaccatcacgcttgaggtggagtcctcggacaccatcgacaacgtcaaggccaagatccaggacaaggagggcatccccccggaccagcagcgcctcatcttngccggcaagcagcttgaggatggccgcactctggcagactacaacatccagaaggagtccaccctccacctggtgctccgccttcgcggtggtatgcagatcttngtgaagaccctgacgggcaagaaccatcacgntggaggtggagtcctcggacaccatcgacaacgtnaaggccaagatccaggacaaggagggcattcccccggaccagcagcgcctcatctttgccggcaagcagctcgaggatggccgtacccttgctgactacaacatccagaangagtccacccttcacctggngctccgccttcgcggnggtatgcanatntttgngaagaccctgacngnaaanaaacaaaaagctggagggnggaggcctcgggacaccatcnacaacgtnaagggcaanatncaggacaagggngggnattccccccggnccannagggggccttattttttntccggcaagcancttngaggatnggnccgaacctttggctggatacaaatncaaaaaggngnccncccttcccccggggctccnccttc

SEQ ID NO: 77326 - DNA, 570 bp, Triticum aestivum
  unsure (1)..(570): unsure at all n locations
  Clone ID: PAT_TA_77326
gaggaattcgncacgaggcgcaaactcgttgcacaagaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgcc

SEQ ID NO: 77327 - DNA, 626 bp, Triticum aestivum
  unsure (1)..(626): unsure at all n locations
  Clone ID: PAT_TA_77327
gccccgacgctcaagcccccagnacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagttcat

SEQ ID NO: 77328 - DNA, 534 bp, Triticum aestivum
  Clone ID: PAT_TA_77328
ggtcccaatcctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccacta

SEQ ID NO: 77329 - DNA, 496 bp, Triticum aestivum
  unsure (1)..(496): unsure at all n locations
  Clone ID: PAT_TA_77329
taggggatcgccggagaggaatcgcgacgagggcttcctcctatcagttaaatcnaagccatggagcacaaggagaccggctgccagtctcgggagggcgatggagaaccccaaaggcccaagccggtgcagnacctgcagaaagagggtcgggctgaccggattcaactgccggtgtgggaacctgtactgcgcaacgcaccgttactcggacaagcacgagtgcaagtttgactaccgcgccgcggccatggacgccatcgccaaggccaacccagtggtgaaggcggagaagcttgacaagatctaggaagggtcccccctacggtcggcagaacataaggtcccaaatcaaatctgcgctacctcgtcatcgtgcgtcttgctgcattatcctttcatcatgttggcttctgcaatcttagttgttgggcaatcgtgatgcatggcacacgcgcctcggcggcagccccaggtccgaacggtctccttgttg

SEQ ID NO: 77330 - DNA, 643 bp, Triticum aestivum
  unsure (1)..(643): unsure at all n locations
  Clone ID: PAT_TA_77330
ggnctgcaggnaattcggcacgaggcaatcctcgatnctgttctcaacctcccctccgtccgtcgcagctccagnatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactgccttgctcctcttgctaaggttatcaatgacaggtttggcattgttgagggtttgatgaccacagttcatgccatgactgcaa

SEQ ID NO: 77331 - DNA, 629 bp, Triticum aestivum
  Clone ID: PAT_TA_77331
gccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaacgaggacaagtacacctcagacgttaacattgtctcaaatgctagctgcaccactaactgccttgctcccctagctaagatcattaatgacaacttcggtattattgagggtttgatgaccactgttcatgccatcactgccacacagaagaccgttgatggtccctcgagcaaggac

SEQ ID NO: 77332 - DNA, 685 bp, Triticum aestivum
  Clone ID: PAT_TA_77332
aggaattcggcacgaggggctcgtctaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataatccttccgacgtgcatgcaaggacgcgctttgtgtggagcttaatgtctacgttgatggagtgctcatacgatattgagctactaaaaataaaataaaagctgccctgcgtacggcacgaagctctgctgcatgtgtatttcagtactatgtctttgtctgcacgttgcacacacactgtgtgcatacagtatatttttacgcgacatgcatgcacgcgttcgtatgcgtgagtgaaccgtcaactccttgctgtactctagccgatgtgtacgtgtcatgtgtatgacc

SEQ ID NO: 77333 - DNA, 642 bp, Triticum aestivum
  Clone ID: PAT_TA_77333
attcggcacgaggatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaacgaggacaagtacacctcagacgttaacattgtctcaaatgctagctgcaccactaactgccttgctcccctagctaagatcattaatgacaacttcggtattattgagggtttgatgaccactgttcatgccatcactgccacacagaagaccgttgatggtccctcgagcaag

SEQ ID NO: 77334 - DNA, 626 bp, Triticum aestivum
  Clone ID: PAT_TA_77334
gtcgcgccccgtgcccgctcctccaccatcgtcgccagcctcggcacccccgcgccctccaactcctcctccttccgccccaagctcatcaggaacacccccgtccaggccgcccccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccctcctactgcaagaacaagtacgccggtgttggatcggccatcgaatacgccgtctgtgctctcaaggttgaggtcatcgtggtgattggccacagccgctgcggtggaatcaaggctctgctctcactcaaggatggcgcagacgactccttccacttcgtcgaggactgggtcaggatcggcttcccggccaagaagaaggtgcagactgagtgcgcctccatgcctttcgatgaccagtgcaccgtcctcgaaaaggaggcagtgaacgtgtccct

SEQ ID NO: 77335 - DNA, 464 bp, Triticum aestivum
  unsure (1)..(464): unsure at all n locations
  Clone ID: PAT_TA_77335
gctagcttagcttccttcctctcgatctagctagagccatggctgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttattggcagaaggtttgctgatgcccctgtccagagtgatattaagatgtggccgtacaaggttattcctggccccgcagacaagcctatgattgtagtgcagtacaagggtgaggacaagcagttctcanctgaagaaatttcttccatggncctcatcaagatgcgngagatcgctgaggcttacctangagt

SEQ ID NO: 77336 - DNA, 642 bp, Triticum aestivum
  unsure (1)..(642): unsure at all n locations
  Clone ID: PAT_TA_77336
agaattcctcccacccccaccgtctcgccgccgccnccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccctctc

SEQ ID NO: 77337 - DNA, 482 bp, Triticum aestivum
  Clone ID: PAT_TA_77337
gggaagctcctagtcaacaccaatcaaagcctccatccaatcccaagcaacctcgaagatgtcttgctgcggaggaagctgcggctgcggcagcgcctgcaagtgcggcaatggctgcggcggctgcaacatgtacccggaggtcgaggccgccggcgccaccctcctcgtctccgccactgccacccacaaggcgagctccggcgggatggagatggcggcggagaacggcggctgcggctgcacccagtgcaagtgcggcaccagctgcggctgctcctgctgcagctgctagatcattgatcatgcatgcgccgcgtgcatcatatctatggtctatctaccatctactaccatgtaacgctgcctgatcgagggtctttgtatgtatgtacgcacctgcctgcatgagcagagcgggtgccatgccatgcatgtaaacccctaaataaaatctcccgtggttttgcttaaaaaaaaaa

SEQ ID NO: 77338 - DNA, 521 bp, Triticum aestivum
  Clone ID: PAT_TA_77338
gcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactcctaaatcgctaaaaaaaaaa

SEQ ID NO: 77339 - DNA, 623 bp, Triticum aestivum
  Clone ID: PAT_TA_77339
gccgcagcgccgccactccacccgcagcggcaaccatggcggtcggcaagaacaagcgcatctccaaggggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgattggaaaggag

SEQ ID NO: 77340 - DNA, 529 bp, Triticum aestivum
  unsure (1)..(529): unsure at all n locations
  Clone ID: PAT_TA_77340
gccggcgaacccaccgcggnatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttgacctgcactccc

SEQ ID NO: 77341 - DNA, 794 bp, Triticum aestivum
  unsure (1)..(794): unsure at all n locations
  Clone ID: PAT_TA_77341
ggnctgcaggnaattcngtacgaggcggaacctacaaatccccagtccaatctcgtctccgatcgactccaggctcgtcggatcctcctcccccaccgcctcaagatgcagatcttcgtgaagaccctcaccggcaagaccatcacccttgaggttgagagctccgacaccattgacaacgtcaaggccaagatccaggacaaggagggaattcccccggaccagcagcgcctgatctttgctggcaagcagctggaggatggccgtaccctcgccgactacaacatccagaaggagtccaccctccatcttgtcctgcgtctgcgcggtggcatgcagatcttcgtgaagactctcaccggcaagaccatcacccttgaggttgagagctccgacaccatcgacaatgtcaaggccaagatccaggacaaggagggcattcctccggaccagcagcgccttatcttcgctggcaagcagctagaggatggccgtacccctcgcagactacaacatccagaaggagtccaccctccacctggtgctgcgcctgcgtggtggcatgcagatcttcgtgaagaccctcactggcaagaccatcactctggaggttgagagctccgacaccattcgacaatgtcaaggccangatccanggacataggagggcatttcccccggaccagcagcggcctgatctttgctggcaagcagnctggagggatggtccgnaccctagcaggactacnacattcccagaanggagtccacccctttcanctggtgcttcgnct

SEQ ID NO: 77342 - DNA, 190 bp, Triticum aestivum
  unsure (1)..(190): unsure at all n locations
  Clone ID: PAT_TA_77342
ttgggagtgctcgagatctgtgtcgggagagggggaattcttgagatcggaatcggaacaagcgggcgcgctcgggatcgnggttaccatacaatttttnccaggaacctttagtgaatgtgctaatggagtcaaagggtggcaaaaagtctagcagtagtagntncctgatgtacgaagctcccctngg

SEQ ID NO: 77343 - DNA, 530 bp, Triticum aestivum
  Clone ID: PAT_TA_77343
gctcgatctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgc

SEQ ID NO: 77344 - DNA, 390 bp, Triticum aestivum
  unsure (1)..(390): unsure at all n locations
  Clone ID: PAT_TA_77344
gatcnttccccctcccggcgccgcctccagcctagggtttcctcccgccgcccgtccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcagggcatggctttcggtactggaagtgccatggcgcacagggctgttgatgctgtgatgggtccccgtaccattcagcatgagactgttgtcggtgaggctgctgcatctatgactccaatggacaatgctgctgatgacaagtgtggcaacccttccaag

SEQ ID NO: 77345 - DNA, 318 bp, Triticum aestivum
  unsure (1)..(318): unsure at all n locations
  Clone ID: PAT_TA_77345
ttcggcacgaggacaccaacagnacgcagccaacagcgctccctctgaaaaaaaaaagagaacagcancgggaataatctcctttcctcctcgtccgcgtgcgatcgacgcggaggcgccgcccgtccccctcccctccgctccgacccgaccccatggccttcatgcgcacctcctccaatgcatcctntggcatgggagttgctcctgatatcagggagacattcctggagcttcagatgaagaaggcatttcgctatgttatcttcaaaatcgaagaaaagcaaaaacaggttgttgtggagaagacaggggcta

SEQ ID NO: 77346 - DNA, 669 bp, Triticum aestivum
  Clone ID: PAT_TA_77346
gctcccctccgttcgttcttcttcttcgggttgggtagtttacgtctacccaccagccatgggtaaggagaagactcacatcaacatcgtggtcattggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttcccttcgtccccatctctgggttcgagggtgacaacatgattgagag

SEQ ID NO: 77347 - DNA, 651 bp, Triticum aestivum
  Clone ID: PAT_TA_77347
gatagcatgcatattaaccaggtgcataacaggttaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtactttgccgtggcgggggtcacacttggccatcatagatgaaggctcaa

SEQ ID NO: 77348 - DNA, 490 bp, Triticum aestivum
  unsure (1)..(490): unsure at all n locations
  Clone ID: PAT_TA_77348
ccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggcccgtcgtagtacccgggagacgcattgtgctcacggaagatgaacccgaccttgctgaactcaaggcaaggcacccacttggagcggatcaaggtagtccacctgcttganga

SEQ ID NO: 77349 - DNA, 646 bp, Triticum aestivum
  Clone ID: PAT_TA_77349
aatccccaattatcagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagagcacgccgttctccagctccctgtacgggaacgaatccgacagaagctcgtcgccggaaagcttgtcctggtacacgagcatggtgc

SEQ ID NO: 77350 - DNA, 362 bp, Triticum aestivum
  unsure (1)..(362): unsure at all n locations
  Clone ID: PAT_TA_77350
attaaaacgtatatagtncgacatattgtataatattatgcgtccgtgcatatacatagccccgatagcattcacatacgagcatgctttctcgagccatgttcgtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacataggcgtcagggtactccttcttgacc

SEQ ID NO: 77351 - DNA, 478 bp, Triticum aestivum
  Clone ID: PAT_TA_77351
ccgatagcattcacatacgagcatgctttctcgagccatgttcgtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacataggcgtcagggtactccttcttgacctcctccacctcgttgatcacctgcgtggcgtcggtgcatccgaacataggcagcttccacattgtccagtaccggccatcgtagtacccaggggatgcgttgtgctcacggaagatgaacccaaccttgctgaactcgaggcaaggcacccacttggagcggatcaggtagtcgacc

SEQ ID NO: 77352 - DNA, 558 bp, Triticum aestivum
  Clone ID: PAT_TA_77352
acctaggactcgaacagtttacagaaaatggtgttcagtatgtctgcaaacatgacatggacgcaacatctaagaaaatccaacaagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccgctgaactgctcctcaatgtgagagtccagtgtacgtccctggtggagggccgttgcgatgctgctgaggaaggtcttctaagagctatggcaccaggatcttctttgggcacacgtttggttcttcccgtggtgccaatcacattggtggttgctgcttttggattccgcaatgattgaatatttccaggcttggttttctgatttatcacaatgggcttggctgattcaggacccttactgacaactgtgtgatcaggattataactagaagtcatcttgaccgtctttggaataatttttgaagcttg

SEQ ID NO: 77353 - DNA, 173 bp, Triticum aestivum
  unsure (1)..(173): unsure at all n locations
  Clone ID: PAT_TA_77353
tgaacatggncatncacatattcttaggnacnaatnagaaagataaatggggaaggnaaacccaaagcaatgncagagntgacaaaactgnaatggcactttatatatggnctgtcgtgagtgagctgtttaggccttgccggactcctcgcagcccggtggcttgaaggcga

SEQ ID NO: 77354 - DNA, 647 bp, Triticum aestivum
  Clone ID: PAT_TA_77354
atgcatattaaccaggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtactttgccgtggcgggggtcacacttggccatcatagatgaaggctcaaa

SEQ ID NO: 77355 - DNA, 671 bp, Triticum aestivum
  unsure (1)..(671): unsure at all n locations
  Clone ID: PAT_TA_77355
tttacgattncnttacaaagcaatcccacaattatagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcctggtacacgagcatggtgccgc

SEQ ID NO: 77356 - DNA, 530 bp, Triticum aestivum
  unsure (1)..(530): unsure at all n locations
  Clone ID: PAT_TA_77356
ttggttacnttaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagc

SEQ ID NO: 77357 - DNA, 255 bp, Triticum aestivum
  unsure (1)..(255): unsure at all n locations
  Clone ID: PAT_TA_77357
atgagggtagcagtaactgcatgcntaacaaaggtttaccaaccagaatngtactatcagagttaccaaactacttaaaatacgacagaggtttcccaaaactgatggcgcacgaaagctctgatatctcttagtatttgatcggagccaggatctccagctgagttcccaacttctcctaggctgccttntcggccttgacgcggancttggccagntgctttctcctgtcgtaggagaccttggncttctcct

SEQ ID NO: 77358 - DNA, 304 bp, Triticum aestivum
  unsure (1)..(304): unsure at all n locations
  Clone ID: PAT_TA_77358
agataaatggngaaggaaaacccaaagcaatgtcagagttgacaaaactgcactggcactttatatatggcctgtcgtgagtgagctgtttaggccttgccggactcctcgcagcccggtggcttgaaggctatgaagctgacgcactgcacctgacgcatgttgtcgaatccgatgatgcggacatacgcgtcagggtactccttcttgacctcctccacctcgttgatnacctgtgtggcagtcagtgcacccgaacataggcagnttccacattgtccaataccggccatcgtagtaccca

SEQ ID NO: 77359 - DNA, 592 bp, Triticum aestivum
  Clone ID: PAT_TA_77359
aatcccacaattatagaaagttttaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacg

SEQ ID NO: 77360 - DNA, 195 bp, Triticum aestivum
  unsure (1)..(195): unsure at all n locations
  Clone ID: PAT_TA_77360
ctaaagcaacagaaccagctacagncgctactagatngatngatagatacaagcaatgcagatgcaatctaggaggaggtgaacttggtgacggccttggtgccctcggagacggcgtgcttggcgagctccccggggaggacgaggcggacggaggnctggatctcccgggaggngatggtgggcttcttgntg

SEQ ID NO: 77361 - DNA, 211 bp, Triticum aestivum
  unsure (1)..(211): unsure at all n locations
  Clone ID: PAT_TA_77361
acaggaagataactatggccgccggacacagatccagcggccaaatgagtccacctaaaaccctcctaaaccaaccacggagatctcatcggacggacaaggggaagacacgacacgacacacgactgtctagatttagatcgacgacacgggacacggggcgacgacgacaggcgaccggngggcggacggatctagagctggccgcagt

SEQ ID NO: 77362 - DNA, 560 bp, Triticum aestivum
  unsure (1)..(560): unsure at all n locations
  Clone ID: PAT_TA_77362
cgataattnttgatttagaaaatacgactgattttacaatgtttgtataggggggtctaaccccctgcgattgttgacacacgaacaaacgaaaccaaactgacaagagactcggtgggcggcaggcaatctaagaggaggtaaacttggtgacggccttggtgccctcggagacggcatgcttggcgagctcgccgggaaggacgaggcgcacggcggtctggatctcccgggaggtgacggtatctgatcgtcttcgagcccccaactttcgttcttgattaatgaaaacatccttggcaaatgctttcgcagtttgttcgtctttcataaatccaagaatttcacctctgactatgaaatacgaatgcccccgactgtccctattaatcattactccgatcccgaaggccaacacaataggaccggaatcctatgatgttatcccatgctaatgtatccagagcgatggcttgctttgagcactctaatttcttcaaagtaacgatgccggaaacacgacccgnccaattaaggctaggagcgcgatgccggccgaa

SEQ ID NO: 77363 - DNA, 517 bp, Triticum aestivum
  unsure (1)..(517): unsure at all n locations
  Clone ID: PAT_TA_77363
gctctttnttggagatcgatgatctgtactgtacaaaaatggacaaggccntaggctcttgaacaaccgcgcaccaaacccaacagggcacaaacccgaaagaaacagcgagaaagacgccggattagacgagcaggtganccatccatccacgtaggctccgctttggatcngcgcaggcacgacccaggaaaccaagcttcatcctggtcatggatagatcacccaggttcgggtccataagcagtgacaatcgccctattaagactcgctttcgctacggctccggngggttccgttcccttaaccaagccactgcctatgagtcgccggctcattcttcaacaggcacgcggtcagagatcactttcccctcccactgcttgggagctcagcacggtttcacgttctatttcactacccactgggggttcttttcacctttccctaacggtactacttcgctatcggtcacccaggagtatttagccttgcaaggtggtccttgctgattcac

SEQ ID NO: 77364 - DNA, 578 bp, Triticum aestivum
  unsure (1)..(578): unsure at all n locations
  Clone ID: PAT_TA_77364
aggttctncacacaacaggttgtaaaacaaacaccacaaagcaaatgttaaacagacagataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgnctgggacaacaccaggtggctggtagttgataccacacttgaagccagtggggcaccagtcaacaaactggatagtgcgcttggtcttgatggtggccacagnagcgttgacattcttgggcacaacatnaccacngtncatgangcannaggccatgtacttgccgtggcgggggtcacac

SEQ ID NO: 77365 - DNA, 629 bp, Triticum aestivum
  Clone ID: PAT_TA_77365
ccgatagcattcacatacgagcatgctttctcgagcctgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggccctccgtgctgagcggtggcaggtaagacagggtctcgaacttcttgatgccctcgatgggccacacctgcatgcacctgatccttccaccgttgctgacgctgccgaggctagcgccgttggagcggcggctgacgg

SEQ ID NO: 77366 - DNA, 260 bp, Triticum aestivum
  unsure (1)..(260): unsure at all n locations
  Clone ID: PAT_TA_77366
gcacccgaacataggcagcttccacattgtccagtagcggccgtcgtagtacccgggagacgcattgtgctcacggaagatgaacccgaccttgctgaactcaaggcaaggcacccacttggagcggatcangtagtccacctgcttgaggagggcctccgtgctgagcggtggcaggtaagacagggtctcgaacttcttgatgccctcgatgggccacaccctgcatgcacctgatccttncaccgttgctgacgctg

SEQ ID NO: 77367 - DNA, 628 bp, Triticum aestivum
  unsure (1)..(628): unsure at all n locations
  Clone ID: PAT_TA_77367
ctttaccaaaaggtatactncaatatctttatatattaacaaaacatgcccagcaatcgcttggnatgcgatgcggtacttaggtacaaaggataaaacatcagatattaaattggcatgcttaaaaggtgtaaaggcagctgccgtcgtcactcctcgccgttgggtcgaagttcttggcagtctggtcggtgcatcctgccggtacaggcaaagtaccttgctgtgcccctttacctcctcctatgcagcaagagatggtgggtgtgtatggagaatgttctaaccgtagaaggtaccagtcttcatcgcatcctggttagcatcacccagagctgcctggctcatgtaggtgtcagcaagctgcacacgcttgacattgtcctgctcctggacgagcatgtgcccgtactctagcagcttctccactgtcatctttggctgctcaaaggtcactggtccgtcccgcgagttcaccagcttcttgccaatgttctcgataccggtagaggtcacccacttgcgcacctcgtcgtcgtacacccgcccatcctacccgcaccggcgtcaagatcgttgatgaagaggcagcacatcttacccttcttgatcatgtctgcagcctcac

SEQ ID NO: 77368 - DNA, 690 bp, Triticum aestivum
  unsure (1)..(690): unsure at all n locations
  Clone ID: PAT_TA_77368
attaaccangtgcataacaggttcaaacatacaaggttcttacaacacaacaggttgtaaaacaaacaccacaaagcaaatgttcaaacagnacagnataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgcctgggacaacaccaggtggctggtagttgataccacacttgaagccagtggggcaccagtcaacaaactggatagtgcgcttggtcttgatggtggccacagcagcgttgacatccttgggcacaacatcaccacggtacatgaggcagcaggccatgtacttgccgtggcgggggtcacacttggccatcatggaggaaggctcaaaggcgctgttggtgatctcagcaacagacagctgctcatggtaggcctt

SEQ ID NO: 77369 - DNA, 613 bp, Triticum aestivum
  unsure (1)..(613): unsure at all n locations
  Clone ID: PAT_TA_77369
caccaatgncaccgnaattgcagnaacaccaatcgatgtcattagcatcaccatgggnagattgccaacggtgtgtgaggtgaagtgcatgagcggaccaccatcgcagtgaattgtgattaaacttaggtaagggcaatgttgggtctttactctctccgtccagaaatacttgtcggtgaaattgatgtatccagacgtgttttagttctagatacatccatttttattcatttcttcgacaagtatcctcggacgaagggagtagtagcaagcaactctggaacatgaaatttacaggaccaagctctcttggctattttgctgatagcagttggcacaattggctactatgctgatggcaaacgccacatgatgcactgcaggggacactggcgacagaggtggtcacactgctgcctgctgtagcttctaggcagaaaaaggagatggacctggtggggtttcattgggagagacagccaactcttcttgcaggatatgtgggatgccctattaagactcgctttcgctacggctccggtgggttccgttcccttaaccaagccactgcctatgagtcgccggctcattcttcaacaggcacgcggtc

SEQ ID NO: 77370 - DNA, 553 bp, Triticum aestivum
  Clone ID: PAT_TA_77370
agagagcaatagcctggccggctgcttcacagtaaccaaacgacaaaagacatacagtcagagcaaattccacagactgaacattcgacagcaaatcactcgcacagcaccacgccctcctccagagaatcctccgctcgccatgcgaggaggttggcgagcttgccttccttgaccagcgggtggctctccacagtctcggcctcgaagcagtggaagacggacctgggcgacccggcagagacagcaacctcctcagagaagctcctgtggggagcaggctgtgcaccggggaagatgaacatcccacgggagtacttcacagcagcaagcggcatgcacagctcttcagccagctcgagaatccttggaatggtgagcaggagcatggtagtcccacaggtcttgatcacaatcttctgagagtagataaacaagctcgactcggatagcacgtacgagtcaaagtccttgttggagagctcggacacaatggtgcaccgtgcaagatcaagaacagagtcaatctgggccctggagagggcgcgcaggc

SEQ ID NO: 77371 - DNA, 577 bp, Triticum aestivum
  unsure (1)..(577): unsure at all n locations
  Clone ID: PAT_TA_77371
cgcgaggngggcaaaggaagagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactactttcagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaancaagatcttcctaatgccatgaatgctgctgaaatcactgacaagcttggcctgcattccctgcgccagcgacactggtacatccagagcacatgtgctacctctg

SEQ ID NO: 77372 - DNA, 633 bp, Triticum aestivum
  Clone ID: PAT_TA_77372
tgtataatatattatgtgcatgtgcatatacatagccccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggcccgtcgtagtacccgggagacgcattgtgctcacggaagatgaacccgaccttgctgaactcaaggcaaggcacccacttggagcggatcaggtagtccacctgcttgaggagggcctccgtgctgagcggtggcaggtaagacagggtctcgaacttcttgatgccctcgatgggccacacctgcatgcacctgatccttccaccgttgctgacgctg

SEQ ID NO: 77373 - DNA, 341 bp, Triticum aestivum
  unsure (1)..(341): unsure at all n locations
  Clone ID: PAT_TA_77373
tgccttccttgtcctgnatcttggccttgacgttgtcaatggtgtcagagctctcaacctccatagtgatggncttgncggtaagggtcttcacaaagatctgcataccaccacggagacgcaggacaaggtgaagggtggactccttctggatgttgcagtcagcaagggtgcggccatcctccagntgcttnccagcaaagatgacgcgctgctggtccgggggaatgccctccttgtcctggatcttggnncttgacgttgtcgatggngtccggangattccacctcaagtgntatggncttgccagtgagggtcttcactaagatctgcatgccnc

SEQ ID NO: 77374 - DNA, 451 bp, Triticum aestivum
  Clone ID: PAT_TA_77374
cacgtacacatctcggctagactggagtacagcaaggaactgacagttcactcacgcatacggacgtgtgcatacatgtcgcataaatatatatgcacacacagtgtgtgtgcaaggtacagacatagacacactactgaaataacacatgcaggcaactttattttatttttttagtagctcatcagtatcgtatgagcactccatcaacatagacattaagctccacacaagcgcgtccatgcatgcacgtaggaagggttatatattgaactagttgacagtgtcgcagttggtggacatgctgatggggaagggcacactgacgccgcacttgccgggcacgccggagaccttgcccatgttgatggacttgatgctggtggcgaggctcttgaggcacctgcacgctatcttgcggtccgagctgctgcgggccatgccgttcagc

SEQ ID NO: 77375 - DNA, 598 bp, Triticum aestivum
  Clone ID: PAT_TA_77375
gaatgtgacgattattcttcgacggtcttaactaaaccgtgccaaatataatagcaaacaaaatttggggaataaaaaagagaaagaaagagcaaggggtggtgctcaatcagatattcagatatgaccgcaaactgcttttgtgtagtctgacgtcgatgacttgcccttccgtcaattcctttaagtttcagccttgcgaccatactccccccggaacccaaagactttgatttctcataaggtgccggcggagtcctataagcaacatccgccgatccctggtcggcatcgtttatggttgagactaggacggtatctgatcgtcttcgagcccccaactttcgttcttgattaatgaaaacatccttggcaaatgctttcgcagttgttcgtctttcataaatccaagaatttcacctctgactatgaaatacgaatgcccccgactgtccctattaatcattactccgatcccgaaggccaacacaataggaccggaatcctatgatgttatcccatgctaatgtatccagagcgatggcttgctttgagcactctaatttcttcaaagtaacgatgccggaaacacgacccg

SEQ ID NO: 77376 - DNA, 489 bp, Triticum aestivum
  unsure (1)..(489): unsure at all n locations
  Clone ID: PAT_TA_77376
atgtggttggacttgacttttcnagagctgcatgcatacgtagtccaatcgtcagtcaactgaactggatctgagatggtataatacacgtaactaaccacttggctttgtttttatattactactaaagtaaagcaaagagagaagaagacttgttagttagtcgtcctggacgcagaagatggtaggcttgacggggtcggtgatctcgacggtgctcgccgtgaggcggaccggccgacccggcccaaggtccaactacgagctttttaactgcaacaacttaaatatacgctattggagctggaattaccgcggctgctggcaccagacttgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgt

SEQ ID NO: 77377 - DNA, 635 bp, Triticum aestivum
  Clone ID: PAT_TA_77377
gagatagcaccgtcgtcgtcgccgtcatcgttcgttcgttcgttcgttcacagaggagtggcggtgttggcagtgagagagggtgagaggagggaggaaggaaggttcaggggaggggagtgagagacgaaatccatttattcccccgtctatcggaggcaaacccgcggcctcctttcccgagccggctggatggagagggacttcctgggcaccataggccacgagcagctgcagcagcgccagcgcgccgccgccgaggacgccgccgccagaaaggagtcagcttactttgggggaggaggagtgccgcccatggattggtccttcgctggcagggccggggccgcgccggcggtcatgtccttcaggtcggcgccgagggaggagcttatgttcttggctagcagaggatctcttccaaccgcacccactactgttactcgcagcccagatgcaacctttttcactccggctaaactcgccgcccctgaggcttcacctgcaaagcagatgctagctcagataccacagcgtgtttcacctcctttgccagccatttccaaaccgatgtccatcatgtctcaagctgcatgtctccccaagagcacatctagctccaacaccgattccgc

SEQ ID NO: 77378 - DNA, 412 bp, Triticum aestivum
  Clone ID: PAT_TA_77378
gctcccctcccccaacccaccggcggcggcgcagcgcagcttgaggaaggaagcgaagatggtgaagttcctgaagcccggcaaggcggtgatcctgctgcagggcaggtacgcggggaagaaggcggtgatcgtgcgcgtgttcgaggagggcacccgcgaccgcccgtacgggcactgcctcgtcgccgggctggccaagtacccgaagaaggtgatccgcaaggactcggccaagaagacggccaagaagtcccgcgtcaaggtgttcctcaagctcgtcaacttcacccatctcatgcccacccgctataccctcgacgtcgacctcaaggaggtggcctccggcgcgcccgactccctcacctccaaggacaagaaggtgggcgccgccaaggccgccaaggccaag

SEQ ID NO: 77379 - DNA, 573 bp, Triticum aestivum
  Clone ID: PAT_TA_77379
gaggaattcggcacgaggaaggagcggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctg

SEQ ID NO: 77380 - DNA, 571 bp, Triticum aestivum
  Clone ID: PAT_TA_77380
gcgagcagcgaccaccttccggcgagggcagtgggcagcagcgatggagggcaaggaggaggacgtgcggctcggggcgaacaagtactcggagcgtcagcccatcggcacggcggcgcaggggtccgaggacaaggactacaaggagcccccgccggcgccgcttttcgagcccggcgagctcaagtcctggtccttctaccgcgccggcatcgccgagttcatggccaccttcctcttcctctacgtcaccatcctcaccgtgatggggtacagcggcgccgcctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacccgggcggtgttctacatcatcatgcagtgcctgggcgccatctgcggcgccggcgtggtgaaggggttccagcagggcctgtacatgggcaacggcggcggcgccaacgtggtggcgcccggctacaccaag

SEQ ID NO: 77381 - DNA, 599 bp, Triticum aestivum
  Clone ID: PAT_TA_77381
tggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagtttagcaaggttggcttcgtcttccgtgagcacaacagctctcccgggtactacgacggtcgatactggacaatgtggaagctgcctatgttcgggtgcaccgacgccacgcaagtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcatttgtgaacttcacttttgtccacgactctgctttccg

SEQ ID NO: 77382 - DNA, 514 bp, Triticum aestivum
  Clone ID: PAT_TA_77382
gcatgtgcaagtatgaaccatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcccatcctgcacgttcattcatcccaagatcccctcgcatgaacctccctatcttgccatcgaccgcactactcgccttctctaggattgcaccacccatcacctggtcagatctg

SEQ ID NO: 77383 - DNA, 877 bp, Triticum aestivum
  unsure (1)..(877): unsure at all n locations
  Clone ID: PAT_TA_77383
gctcactggcaagnaccattacgcttgaggtggagtcatccgacaccatcgacaatgtgaaggcaaagatccaggacaaggagggcattcccccggaccagcagcgtctcatcttcgctggcaagcagctggaggacggcaggacccttgctgactacaacatccagaaggagtccaccctccaccttgtgctgcgtcttcgaggaggcatgcagatctttgtgaagaccctcactggcaagaccattacacttgaggtggagtcctcggacaccatagacaatgtcaaggcgaagatccaggacaaggagggcattcccccggaccagcagcgcctcatctttgctggcaagcagctggaggatggccgtacccttgctgattacaacatccagaaggagtctacccttcaccttgtcctgcgtctccgaggtggtatgcagatctttgtgaagaccctcaccggcaagaccatcactctggaggttgagagctcagacaccattgacaacgtcaaggccaagatccaggacaaggagggcatncccgccggaccagcagcgcctcatctttgctggtaagcagctgggaggatggcaggacccttgctgactacaacattcagaaggagtccacccttcaccttgtcctgcgtctccgaggtgggtatgcagatctttgtgaagacccttaccggcaagaccatcactctggaggttgagagcttaaaancccatcgacaacgtcaaggccaagatccaggacaaggaggggcattccccccggaccagcagcgtttcatntttgccggcagcnaattggagngatggncncaccctcnctgacttcaacatccagaaaggaatccnctctccnc

SEQ ID NO: 77384 - DNA, 499 bp, Triticum aestivum
  unsure (1)..(499): unsure at all n locations
  Clone ID: PAT_TA_77384
ctctcctcctcctacctgcaagtatgcaggatcttcgtgaagacccttaccggcaagaccatcacacttgaggtcgagtcctctgacaccatcgacaatgtcaaggcaaagatccaggacaaggagggcattcccccggaccagcagcgtctcatctttgctggcaagcagctcgaggatggccgcacccttgcagactacaacatccagaaggagtccaccctccacttggtgcttaggctccgtggtggtatgcagattttcgncaagaccctgaccggcaagaccatcaccctggaggttgagtcctcggacaccatcgacaacnnnaaggccaagatccaggacanggagggcattcccccggaccagcnncgtnttattcttngccggcaaagcagcttgaggatgggcgcaccccttgcggattacaacatnccannaagggaatccaccccttccacntggtncntnngncttnntggnggangcaaatntt

SEQ ID NO: 77385 - DNA, 384 bp, Triticum aestivum
  unsure (1)..(384): unsure at all n locations
  Clone ID: PAT_TA_77385
aaacgcaccgcttcctngtgtncgaactaagccccaatcccgtcaccaccgccgctggtgctcggcgcgatggcgcagaaggacgccgccaatggcaacggcgccaccacgcgcccgccgcccactccctcccccatccgcttctccaagttcttccaggccaacatgcggatcctggtcaccggcggagctggcttcatcggctcgcacctcgtcgacaagctcatggagaacgagaagaacgaggtcattgttgctgacaactttttcactgggtcaaaagacaacctgaagaagtggatcggacacccaagatttgaactcatccgtcacgatgtcaccgaaccactgctcgtggaggttgaccaaatctaccaccttgct

SEQ ID NO: 77386 - DNA, 611 bp, Triticum aestivum
  Clone ID: PAT_TA_77386
gggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctctggagagggggttgtacgagggc

SEQ ID NO: 77387 - DNA, 676 bp, Triticum aestivum
  unsure (1)..(676): unsure at all n locations
  Clone ID: PAT_TA_77387
aggaattcggacgaggcttcgtactcgcctctctccgcgcatcctagccttcgccctcctccttcccatttcgccagcggcgcagcccaccaaccncccccacccgccgccatgagggagtgcatctcgatccacatcggccnggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagangtccaagcttgggttcacggtgtacccatctccccaggtctccacctctgttgttgagccatacaacagtgtcc

SEQ ID NO: 77388 - DNA, 628 bp, Triticum aestivum
  Clone ID: PAT_TA_77388
cgccgcagcgccgccactccacccgcagcggcaaccatggcggtcggcaagaacaagcgcatctccaaggggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgattggaaaggagattg

SEQ ID NO: 77389 - DNA, 626 bp, Triticum aestivum
  Clone ID: PAT_TA_77389
gcatttctctcctcctcctcctgccccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacct

SEQ ID NO: 77390 - DNA, 874 bp, Triticum aestivum
  unsure (1)..(874): unsure at all n locations
  Clone ID: PAT_TA_77390
gcagccccctccgatccccaccgaanaatctccgacagatcgaagccaaggctttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctcgaggatggtcgtacccttgctgactacaacatccagaaggagtccaccctccacctggtgctccgccttcgcggtggtatgcagatcttcgtgaagaccctgacgggcaagaccatcacgcttgaggtggagtcctcggacaccatcgacaacgtcaaggccaagatccaggacaaggagggcatccccccggaccagcagcgcctcatcttngccggcaagcagcttgaggatggccgcactctggcagactacaacatccagaaggagtccaccctccacctggtgctccgccttcgcggtggtatgcagatcttngtgaagaccctgacgggcaagaccatcacgntggaggtggagtcctcggacaccatcgacaacgtnaaggccaagatccaggacaaggagggcatccccnccggaccagcagcgcctcatctttgccggcaagcagctcgaggatggccgtacccttgctgactacaacatccagaaggagtccaccctncacctggtgctccgccttcgcggnggtatgcagatcttngtgaagaccctgacnggcaagaccatcacgctngaggnggagtnctcggacaccatcgacaacgttaanggccaagatncaggacaaggagggcattcccccgg

SEQ ID NO: 77391 - DNA, 639 bp, Triticum aestivum
  Clone ID: PAT_TA_77391
gcttcgtccccatctctgggttcgagggtgacaacatgattgagaggtccaccaaccttgactggtacaagggcccaaccctgcttgaggcgcttgaccagatcaatgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaggcgatctggtaaggagatagaggccgcgcccaagttcctcaagaatggtgatgctggcatagtgaagatgattcccaccaagcccatggttgtggaga

SEQ ID NO: 77392 - DNA, 670 bp, Triticum aestivum
  Clone ID: PAT_TA_77392
ggaattcggcacgagggccgctactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactc

SEQ ID NO: 77393 - DNA, 610 bp, Triticum aestivum
  unsure (1)..(610): unsure at all n locations
  Clone ID: PAT_TA_77393
gaccttctccggctccggcgccggcgaacccaccgcggatcgagcgattcctccgatcnggagaggccagccgggaggaagagcacctacgcgggaggagaggagatggggctcacgttcaccaagctgttcagccgcctgttcgcgaagaaggagatgcggatcctgatggtgggtctcgacgccgcgggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacagggggagggactgtatgaa

SEQ ID NO: 77394 - DNA, 568 bp, Triticum aestivum
  Clone ID: PAT_TA_77394
acgacttcgacaacaccatgggaggcttctacatcgctcctgctttatggacaagcttgttgtccatctctccaagaacttcatgaccctgcccaacatcaagatgggcatcaacccaatcatgatgagtgccggagagctggagagtggcaacgccggagagccagccaagctcatcaggcagcggtaccgtgaggctgcagacatgatcaagaagggtaagatgtgctgcctcttcatcaacgatcttgacgccggtgcgggtaggatgggcgggaccacacagtacaccgtcaacaaccagatggtgaacgccaccctcatgaacatcgccgatgcccccaccaatgtgcagctcccaggcatgtacaacaaggaggagaacccacgtgtgcccatcgtcgtcactggtaacgatttctcgacgttgtacgcccctctgatccgtgatggtcgtatggagaagttctactgggctcccacccgcgacgaccgtatcggtgtctgcaagggtatcttccagaccgacaatgtcagcgacgagtccgtcgtcaagatcgtcgacacc

SEQ ID NO: 77395 - DNA, 660 bp, Triticum aestivum
  Clone ID: PAT_TA_77395
gcttccctccctccttcggttcctcggcctcccgatcgagcagtagaagcagcgcaagggttgattagtcgtcggcaggcggctccggtgtttctcctcgacgtggtcgaccggggacttcggatctgaggctcgttgggcagggggtggcccccagacgatgtgccacagtgagatgtgtcccgccgcccgcgggcggcgggtcttcggcccgaagctctcgccgctccttcctccgatggcggcttagacggcggcagatgcaggatggttgaccaatcaaccccctccgggacatatttgttatttttcttgttttggggtgctttttgctgctctggcttatttccaggctgtgaggcgtgtgctgctgtatattggtcatcagagcgtctatattctctgtacttgggacagtaccgtgattttagtcgccttttctgactaatggaaaaatacacggggtaatttctcgttggagtttcattctaattgtcggaatttcttctatttgcagggcaccgctagcactaaaggaatggcggccgagacgttcctcttcacgtccgagtctgtgaatgagggccatcccgacaagctctgtgaccaggtctccgacgccgtcttggatgcctgcttggcgcaggatgccgacagcaa

SEQ ID NO: 77396 - DNA, 624 bp, Triticum aestivum
  Clone ID: PAT_TA_77396
agcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcataaggagcc

SEQ ID NO: 77397 - DNA, 600 bp, Triticum aestivum
  Clone ID: PAT_TA_77397
ccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagt

SEQ ID NO: 77398 - DNA, 606 bp, Triticum aestivum
  Clone ID: PAT_TA_77398
taatacaataccatggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagcaaggttggcttcgtcttccgtgagcacaacagctctcccgggtactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcagcttcatcgccttcaggccaccaggttgcgaggagtccggcaaggcctaaactacaagttgaaacaatggcctatgtatgatggtcatttgtgaacttcacttttgtccacgactctgc

SEQ ID NO: 77399 - DNA, 648 bp, Triticum aestivum
  unsure (1)..(648): unsure at all n locations
  Clone ID: PAT_TA_77399
gcagacggcaggtaagggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccgaaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggcgaagcgcgccaagagcaaggctagcagggagaggaagcatgccaggagggaggagagattggctcagggccccagagatcatgcaccagcaccagcggctgcagctncagctncggcagcagcggca

SEQ ID NO: 77400 - DNA, 389 bp, Triticum aestivum
  unsure (1)..(389): unsure at all n locations
  Clone ID: PAT_TA_77400
tacaataccatggcgccccgccgtgatggcttcgtgcggctaccaccgtcgcacccttccaggggctcaagtccacagcgcggtctgcccgtcagccgccgctccagcggcagcctcggccgcgtcagcaatggcggaaggatcaggtgcatgcaggtgtggccgattgagggtatcaagaagttcgagaccctgtcttacttgccacccctgtgcacagaggccctcctaanncaggtagactacctgatccgctccaagtgggtgccctgnctngagtttagcaaggttggcttcgtcttccgtgagcacaacagctctcccgggtactacgacggtcgatactggacaatgtggaagctgnctatgttcgggtgcaccgacgccac

SEQ ID NO: 77401 - DNA, 577 bp, Triticum aestivum
  Clone ID: PAT_TA_77401
aggaattcggacgaggcaccttccctcctccacaccatggcccccactgtgatggcttcctcggcccctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtctggcaaggcctaaactacgagttgaaa

SEQ ID NO: 77402 - DNA, 594 bp, Triticum aestivum
  Clone ID: PAT_TA_77402
aggaattcggcacgagggtcgaccgccgcggctaactggtgctacgcaaccgtagtcgcgccccgtgcccgctcctccaccatcgtcgccagcctcggcacccccgcgccctccaactcctcctccttccgccccaagctcatcaggaacacccccgtccaggccgcccccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccctcctactgcaagaacaagtacgccggtgttggatcggccatcgaatacgccgtctgtgctctcaaggttgaggtcatcgtggtgattggccacagccgctgcggtggaatcaaggctctgctctcactcaaggatggcgcagacgactccttccacttcgtcgaggactgggtcaggatcggcttcccggcc

SEQ ID NO: 77403 - DNA, 583 bp, Triticum aestivum
  unsure (1)..(583): unsure at all n locations
  Clone ID: PAT_TA_77403
atgtgcaagtatgaacnatttgaactgtgaaactgcgaatggctcattaaatagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattccagctccacctgcatgcacaagtgcgacaacagcagctgcggcgacgtcca

SEQ ID NO: 77404 - DNA, 669 bp, Triticum aestivum
  unsure (1)..(669): unsure at all n locations
  Clone ID: PAT_TA_77404
tcggcacgagggccgctactcccctgcctcccccagnactcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgncttcagtatttttgctcttatctatggntgtcagtcgactctcca

SEQ ID NO: 77405 - DNA, 768 bp, Triticum aestivum
  unsure (1)..(768): unsure at all n locations
  Clone ID: PAT_TA_77405
gggaactnacaaatccccagccaatctcgtctccgatcgactccaggctcgtcggatcctcctcccccaccgcctcaagatgcagatcttcgtgaagaccctcaccggcaagaccatcacccttgaggttgagagctccgacaccattgacaacgtcaaggccaagatccaggacaaggagggaattcccccggaccagcagcgcctgatctttgctggcaagcagctggaggatggccgtaccctcgccgactacaacatccagaaggagtccaccctccatcttgtcctgcgtctgcgcggtggcatgcagatcttcgtgaagactctcaccggcaagaccatcacccttgaggttgagagctccgacaccatcgacaatgtcaaggccaagatccaggacaaggagggcattcctccggaccagcagcgccttatcttcgctggcaagcagctagaggatggccgtaccctcgcagactacaacatccagaaggagtccaccctccacctggtgctgcgcctgcgtggtggcatgcagatcttcgtgaagaccctcactggcaagaccatcactctgggaggntgagagctccgacaccatcgacaatgtcaaggccaagatncaggacaanggagggcatttccccccggaccagcagcgcctgatctttgctggcaagcagctggagggatnggncgcacccttagccagactacaacatccagaaggagtccacccttcacctgggggctccgnctccgngg

SEQ ID NO: 77406 - DNA, 917 bp, Triticum aestivum
  unsure (1)..(917): unsure at all n locations
  Clone ID: PAT_TA_77406
gatccaatccgtccccctctgatctcaccgagnaaatcgacgcgaaggctctctccccgtcctcaagatgcagatctttgtgaagaccctcaccggcaagaccatcacccttgaggtcgagtcctcggacaccattgacaacgtcaaggctaagatccaggacaaggagggcatccctccggaccagcagcgtctcatcttcgctggcaagcagctcgaggatggccgcaccctggctgactacaacatccagaaggagtccaccctccatctggtgctcaggctcaggggtggcatgcagatctttgtcaagaccctcacgggcaagaccatcacccttgaggtcgagtcctctgacaccatcgacaatgtcaaggctaagatccaggacaaggagggcattcctccggaccagcagcgcctcatcttcgctggcaagcagctcgaggatggccgcacccttgctgactacaatatccagaaggagtccaccctccacctggtgctcaggctccgtggtggcatgcagatttttgtgaagaccctcaccggcaagaccatcacacttgaggttgagtcctcggacacaattgacacgtggaaggctaagatccaggacaaggagggcatccctncggaccagcagcgtctcatctttgctggcaagcagctcgaggatggccgcaccctggctgactacaacatncagaaggagtccacccttcatcttggtgctcaggctcaagggggggcatgcagatctttgngaagaccctgaccggcaagacatcaccctggaggttgagtcctctgacacatgnacnnggnnaagggnaanattcaggacagggggggcatttccccggacancagngcctgatntttgntggcagcannttgaggatggncgnccctgg

SEQ ID NO: 77407 - DNA, 603 bp, Triticum aestivum
  Clone ID: PAT_TA_77407
gatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagt

SEQ ID NO: 77408 - DNA, 908 bp, Triticum aestivum
  unsure (1)..(908): unsure at all n locations
  Clone ID: PAT_TA_77408
gccgcctcaggggtggtatgcagatctttgtcaagaccctcaccggcaagaccatcaccttggaggttgagtcatccgacaccattgacaacgtgaaggcaaagatccaggacaaggagggcatccctccggaccagcagcgcctcatcttcgctggcaagcagcttgaggatggtcgcaccctcgctgactacaacatccagaaggagtccaccctccacctggtgctccgcctgcgtggtggcatgcagatcttcgtcaagaccctcactggcaagaccatcacccttgaggtcgagtcctctgacacgatcgacaacgtcaaggcgaagatccaggacaaggagggcatccccccggaccagcagcgcctcatctttgccggcaagcagcttgaggacggccgcacccttgctgactacaacatccagaaggagtccaccctccacctggtgctccgnctgcgtggtgggatgcagatcttcgtcaagaccctcactggcaagaccatcacccttgaggtcgagtcctctgacacaatcgacaacgtcaaggcgaagatccangacaaggagggcatccccccggaccagcagcgcctcatcttngccggcaagcagcttgaggacgggcgcacccttgctgactacaacatncagaaggagtccacccttcacctggtgctncgnctcaggggtggtatgcagatcttcgncaagaccctcaccggcaagaccatcaccttggaggttgagtcattccgacaccnttgacaacgtgaaggcgaagatncaggacaaggaggcatnccccgggaaccaaaagngccttatttttgccgggaagcaanttgaggaccggccgcaccctttnttgnctccanattcanaangggtncccccttcncc

SEQ ID NO: 77409 - DNA, 608 bp, Triticum aestivum
  unsure (1)..(608): unsure at all n locations
  Clone ID: PAT_TA_77409
gccgatcccgaaccgggnaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctctggag

SEQ ID NO: 77410 - DNA, 611 bp, Triticum aestivum
  Clone ID: PAT_TA_77410
gcatcctccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgctt

SEQ ID NO: 77411 - DNA, 558 bp, Triticum aestivum
  unsure (1)..(558): unsure at all n locations
  Clone ID: PAT_TA_77411
ggctaactggtgctacgcaaccgtagtcgcgccccgtgcccgctcctccaccatcgtcgccagcctcggcacccccgcgccctccaactcctcctccttccgccccaagctcatcaggaacacccccgtccaggccgcccccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccctcctactgcaagaacaagtacgccggtgttggatcggccatcgaatacgccgtctgtgctctcaaggttgaggtcatcgtggtgattggccacagccgctgcggtggaatcaaggctctgctctcactcaaggatggcgcagacgactccttccacttcgtcgaggactgggtcangatcggctt

SEQ ID NO: 77412 - DNA, 465 bp, Triticum aestivum
  Clone ID: PAT_TA_77412
ggctaactggtgctacgcaaccgtagtcgcgccccgtgcccgctcctccaccatcgtcgccagcctcggcacccccgcgccctccaactcctcctccttccgccccaagctcatcaggaacacccccgtccaggccgcccccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccctcctactgcaagaacaagtacgccggtgttggatcggccatcgaatacgccgtctgtgctctcaaggttgaggtcatcgtggtgattggcca

SEQ ID NO: 77413 - DNA, 613 bp, Triticum aestivum
  Clone ID: PAT_TA_77413
ggcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctg

SEQ ID NO: 77414 - DNA, 785 bp, Triticum aestivum
  unsure (1)..(785): unsure at all n locations
  Clone ID: PAT_TA_77414
ttcggcacgaggccagaacggaacgaacgaaaaatccccaaccaatctcgtcgccgatcaaccctaggctcgtcgaatcctcctcccccaccgcataagatgcagatctttgtgaagacattgactggcaagaccatcacccttgaggtggagtcgtctgacaccattgacaacgtcaaggccaagatccaggacaaggagggcatccctccggaccagcagcgcctcatctttgctggcaagcagctcgaggatggcaggacccttgctgactacaacatccagaaggagtccacccttcaccttgtcctccgccttagaggaggcatgcagatcttcgtgaagaccctcactggcaagaccataacacttgaggtggaatcctccgacaccatcgacaacgtcaaggccaagatccaggacaaggagggcattcccccggaccagcagcgcctcatctttgctggcaagcagctggaggatggccgcacccttgctgactacaacatccagaaggagtccacccttcaccttgtcctgcgtctccgtggtggtatgcagatctttgtgaagacccttaccggcaagaccatcactctgggaggttgagagctctgacaccattgacaacgtcaaggncaagatccaggacaaggaaggcattccccctgaccagcagcgcctgatctttgctggcaagcagctggaggatggncgnaccctttgncgactacaacattcagaaggagtccacccttcacctggngctccgnctncgnggnggt

SEQ ID NO: 77415 - DNA, 516 bp, Triticum aestivum
  Clone ID: PAT_TA_77415
gaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaagggtg

SEQ ID NO: 77416 - DNA, 537 bp, Triticum aestivum
  Clone ID: PAT_TA_77416
ggtatatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatccacgcgcccgagaacagccccaacacg

SEQ ID NO: 77417 - DNA, 540 bp, Triticum aestivum
  Clone ID: PAT_TA_77417
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgacccactggccatggcaagcaagg

SEQ ID NO: 77418 - DNA, 656 bp, Triticum aestivum
  Clone ID: PAT_TA_77418
ttaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggcctccgtgctgagcggtggcaggtaagacagggtctcgaacttcttgatgccctcgatgggccacacctgcatgcacctgatccttccaccgttgctgacgctgc

SEQ ID NO: 77419 - DNA, 394 bp, Triticum aestivum
  Clone ID: PAT_TA_77419
tacaacacaacaggttgtaaaccaaacaccacacagcaaacattcaaacaggcagacaacagataaagccgcttgggcagatcacaggatagtagtagacgaaggcacgcttgacgtacatcaggtcgcaaactcatctgctctagtactcatcaccctcatcaccgtcctcgccctcgtcgaactcagcgccaacttcttcatagtccttctccagggcagcaagatcctcacgggcctcagagaactcaccctcctccatgccctcacccacgtaccagtggacgaaggcacgcttagcgtacatcaggtcgaacttgtggtcgatgcgggagaagacctcgacaacgctggtggagttggagatcatgcacacggccctctggaccttggc

SEQ ID NO: 77420 - DNA, 644 bp, Triticum aestivum
  Clone ID: PAT_TA_77420
atagtcgacagattgtataatatattatgtgcatgtgcatatacatagccaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggccgtcgtagtacccgggagacgcattgtgctcacggaagatgaacccgaccttgctgaactcaaggcaaggcacccacttggagcggatcaggtagtccacctgcttgaggagggcctccgtgctgagcggtggcaggtaagacagggtctcgaacttcttgatgccctcgatgggccacacctgcatgcacctgatccttccaccgttgctgacgc

SEQ ID NO: 77421 - DNA, 437 bp, Triticum aestivum
  unsure (1)..(437): unsure at all n locations
  Clone ID: PAT_TA_77421
tgccagtcgcgcccacgtcccacacacggctcagnattcagnatcagatcagaatgtacattgccaagggaaagaaaaacaagtaaaatgcaataagcccaagcccaacgaggccacgacggagagcactctaatttcttcaaagtaacgatgccggaaacacgacccggccaattaaggntaggagcgcgatgccggccgaagggtcgagtaggtcggtgctcgccgtgaggcggaccggccgacccggcccaaggtccaactacgagctttttaactgcaacaacttaaatatacgctattggagctggaattaccgcggctgctggcaccagacttgccctccaatggatcctngttnagggatttagattgtacttattncaattaccanacactaatgcncccggnnttgttatttattgtnactacctnnc

SEQ ID NO: 77422 - DNA, 345 bp, Triticum aestivum
  Clone ID: PAT_TA_77422
tcgctcgctcgatcatggtacaaataaacacacaaagtacgtgcagctacacgttgatccacgacgtacaagtacacatgcatatctcgtccgatggacggacggacggacggacggctaaacacatttagcttccgggggcgaagttggtggcgaaggcccaggcgttgttgttgaccgggtcggcgacgtggtcgaagaggttctcaactggccccttcccggtgacgatggcctgcacgaagaagccgaacatggagaacatggcgaggcggccgttcttgagctccttcaccttgagctcggcggcggtgtcagggtcgtcggcgaggccaagtgggtcga

SEQ ID NO: 77423 - DNA, 220 bp, Triticum aestivum
  unsure (1)..(220): unsure at all n locations
  Clone ID: PAT_TA_77423
ggactcgancagtnttacagaaaatggtgttcagtactgtctgcnaacatgacatggncgcaacatctaaganaatccaacagagtacacatgcagcagctcttcagcctaagctgtggcacccttgcccttcttcttctggagcttcctcatgtagaactccagctccttgccctncaggatgtacccatcagntctgccacactgtccagggcgagac

SEQ ID NO: 77424 - DNA, 310 bp, Triticum aestivum
  unsure (1)..(310): unsure at all n locations
  Clone ID: PAT_TA_77424
tgcatatacatagccccgatagcattcacatacgagtcatgctttctcgagcctgttggtacatgaacatggtacatacacatattcttaggaacaaataagaaagataaatggagaaggaaaacccaaagcaatgtcagagttgacaaaactgcaatggcactntatatatggcctgtcgtgagtgagctgtttaggccttgccggactcctcgcagcccggtggcttgaaggcgatgaagctgacgcactgcacctgacncatgttgnngaatncgatgatgcggacatacgcgtcagggtactnctt

SEQ ID NO: 77425 - DNA, 658 bp, Triticum aestivum
  unsure (1)..(658): unsure at all n locations
  Clone ID: PAT_TA_77425
agaggggttattatatnncataaattgtccgcatgttcactagaacgcaagagatgcactttgttttgatgtcacgagcactctaatttcttcaaagtaacgatgccggaaacacgacccggccaattaaggctaggagcgcgatgccggccgaagggtcgagtaggtcggtgctcgccgtgaggcggaccggccgacccggcccaaggtccaactacgagctttttaactgcaacaacttaaatatacgctattggagctggaattaccgcggctgctggcaccagacttgccctccaatggatcctcgttaagggatttagattgtactcattccaattaccagacactaatgcgcccggtattgttatttattgtcactacctccccgtgtcaggattgggtaatttgcgcgcctgctgccttccttggatgtggtagccgtttctcaggctccctctccggaatcgaaccctaattctccgtcacccgtcaccaccatggtaggcccctatcctaccatcgaaagttgatagggcagaaatttgaatgatgcgtcgccggcacgaaggccgtgcgatccgtcgagttatcatgaatcatcggatcagcgagcagagcccgcgtcagccttttatctaataaatgcgcccctccc

SEQ ID NO: 77426 - DNA, 566 bp, Triticum aestivum
  unsure (1)..(566): unsure at all n locations
  Clone ID: PAT_TA_77426
atntattatgtgcatgtgcatatacatagccaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggccgtcgtagtacccgggagacgcattgtgctcacggaagatgaacccgaccttgctgaactcaaggcaaggcacccacttggagcggatcangtantccacctgcttgaggagggcctncntgctnancgnnggcannnaanacangntctnnaactt

SEQ ID NO: 77427 - DNA, 485 bp, Triticum aestivum
  unsure (1)..(485): unsure at all n locations
  Clone ID: PAT_TA_77427
tattatgccgcccnagcatatacatagccaccgatngcnttcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggnctngncggactcctcgcagnccggtggcttgaaggcgatgaagctgacgcactgcacctgacgcatgttgtcgaatccnatgatgcggacatacgcgtcagggtactccttcttgacctcctncacctcgttgatcacctgtgtggcgtcagtgcacccgaacatangcagnttncacattgtncaataccgnncatnntannacccanganatgcnttnngctnacnnaanatnaaccnaanctnnntganntnnnnnnnnngnannnnnt

SEQ ID NO: 77428 - DNA, 519 bp, Triticum aestivum
  unsure (1)..(519): unsure at all n locations
  Clone ID: PAT_TA_77428
cacttaacancntgatagttactgacaccaacattggagagtcgactgacaaccatacatagagcagagcaaaaatactgacgaccccaaagattttagcatactgtgccattagcacttgacctctttcagcccatgtgcaaagtacaggaaagttggatcagcagctccctccttgtagtacgcgaacaccacgccgccatcatcatgcatgctctcgccaacaaagaactgaaggtccttgagcttgctaagaagatacttcgtggcagactcaacattcttcttgaaaacatctaggtcatccccttcaagcttggcagtgaggttcttgatgtagcgcttcatgtgagagataaactgcttcttgtcaaaagcaggttgctcctgaagacggaaggtgtnaacaatgtcaaccaccttcacngnctggncatngacaccctcatcgtnaccaccaccctcancananggattggctncaatgtccacatnaactgctccttgaacgacccaatg

SEQ ID NO: 77429 - DNA, 643 bp, Triticum aestivum
  Clone ID: PAT_TA_77429
agttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggccctccgtgctgagcggtggcaggtaagacagggtctcgaacttcttgatgccctcgatgggccacacctgcatgcacctgatccttccaccgttgctgacgctg

SEQ ID NO: 77430 - DNA, 633 bp, Triticum aestivum
  Clone ID: PAT_TA_77430
ttgtataatatattatgtgcatgtgcatatacatagccccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggccgtcgtagtacccgggagacgcattgtgctcacggaagatgaacccgaccttgctgaactcaaggcaaggcacccacttggagcggatcaggtagtccacctgcttgaggagggccctccgtgctgagcggtggcaggtaagacagggtctcgaacttcttgatgccctcgatgggccacacctgcatgcacctgatccttccaccgttgctgacgct

SEQ ID NO: 77431 - DNA, 563 bp, Triticum aestivum
  Clone ID: PAT_TA_77431
attattaattacccgaatacatagtcgacagattgtataatatattatgtgcatgtgcatatacatagccccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcacccgaacataggcagcttccacattgtccagtagcggccgtcgtagtacccgggagacgcattgtgctcacggaagatgaacccgaccttgctgaactcaaggcaaggcacccacttggagcggatcaggtagtccacctgcttgaggagggcc

SEQ ID NO: 77432 - DNA, 631 bp, Triticum aestivum
  unsure (1)..(631): unsure at all n locations
  Clone ID: PAT_TA_77432
gaaagttttaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctngccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcctggtacacgagcatggtgc

SEQ ID NO: 77433 - DNA, 666 bp, Triticum aestivum
  unsure (1)..(666): unsure at all n locations
  Clone ID: PAT_TA_77433
gattacnttacaaagcaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcctggtacacgagcatggtgccg

SEQ ID NO: 77434 - DNA, 614 bp, Triticum aestivum
  unsure (1)..(614): unsure at all n locations
  Clone ID: PAT_TA_77434
cgtccgttntatacatagccccgatagcattctatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgtgtggcgtcggtgcacccgaacataggcagcttccacattgtccagtaccggccatcatagtacccaggggatgcgttgtgctcacggaagatgaacccaaccttgctgaactcgaggcaaggcacccacttggagcggatcaggtagtcgacctgcttgaggagggcctccgtgctgagcggtggcaagtaggacagggtctcgaacttcttgatgccctcaatgggccacacctgcatgcacctgatccttncaccgttgctgacgctg

SEQ ID NO: 77435 - DNA, 610 bp, Triticum aestivum
  unsure (1)..(610): unsure at all n locations
  Clone ID: PAT_TA_77435
aaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgangcaaggcacccacttggagcggatcangtagtcgacctgcttgaggagggcctccgtgctgagcggtggcaggtaagacagggtctcgaacttcttgatgccctngatggg

SEQ ID NO: 77436 - DNA, 205 bp, Triticum aestivum
  unsure (1)..(205): unsure at all n locations
  Clone ID: PAT_TA_77436
ctcatgtagaacnccagctncttgccctacaggatgtacccatcagntctgccacactgnccagggcgagacgaaatgcaggccagtagccttncaccactgaactgctnctcaatgtgcgagtccagtgtacgtccctgctggcgcttctcaagcttcctctggacattgttgctcttntttgcttcctctgtggcagcancag

SEQ ID NO: 77437 - DNA, 439 bp, Triticum aestivum
  unsure (1)..(439): unsure at all n locations
  Clone ID: PAT_TA_77437
acactactattatttcagttnaccaccagcgcccctcgcaccctccggcgaaccaccgcacctntccccggcgaagcagcagcgtccgatggcccccaaggcggagaagaagccggcggccgcggngaagacccctgcggcggagaagaccacggtggggaagaagcccaaggccgagaagcggncgncgaagtccaaggagggcggcgccgacangaagaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctggcccgctacaacaagaagcccaccatcacgtccagggagatgcanacctccgtccgc

SEQ ID NO: 77438 - DNA, 610 bp, Triticum aestivum
  unsure (1)..(610): unsure at all n locations
  Clone ID: PAT_TA_77438
tatacatagnccaccgatagcattctnatacgancctgctttctacgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgtgtggcgtcggtgcacccgaacataggcagcttccacattgtccagtaccggccatcatagtacccaggggatgcgttgtgctcacggaagatgaacccaaccttgctgaactcgaggcaaggcacccacttggagcggatcaggtagtcgacctgcttgaggagggccctccgtgctgagcggtggcaagtaggacagggtctcgaacttcttgatgccctcaatgggccacacctgcatgcacctgatccttccaccgttgctgacgctg

SEQ ID NO: 77439 - DNA, 673 bp, Triticum aestivum
  unsure (1)..(673): unsure at all n locations
  Clone ID: PAT_TA_77439
gtgagccgctaagcccaaccaaccatgcaggnatacatccaataaaaggtttttagctgacataattccatacaaaaatttattctcagaagaagaggctttgaacactcctctggggcaaaccactctcccctgtatgcctctcatttacttggtgctgtgcatgtgacggatgaggtcgaccacgcgggtgctgtatccccactcgttgtcgtaccaggagacaagcttgacaaagttgtcgttcagagcaatcccggccttggcatcgaagatgctggacctgttgtcaccctggaagtcagtggaaacaaggtcctcatcaacgtaacccaaaatgcccttgaggtttccctcagactcctccttgatagcagccttaatctgatcataggttgctggcttcgcaagtctaacagtcagatcaacaacagaaacatcaacagtgggaacacggaaggccattccagtcaactttccgttaagctctgggagcaccttgccaacagcctttgcggcaccagtgctgcttggaatgatgttgaagctggcagcccttccacctctccagtccttgctggaaggaccatcaacagtcttctgggttgcagtcatggcatgaactgtggtcatcaaaccctcaacaatgccaaacctgtcattgataacctta

SEQ ID NO: 77440 - DNA, 623 bp, Triticum aestivum
  Clone ID: PAT_TA_77440
tattatgtcgtccgtgcatatacatagccccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggcctccgtgctgagcggtggcaggtaagacagggtctcgaacttcttgatgccctcgatgggccacacctgcatgcacctgatccttccaccgttgctgacgct

SEQ ID NO: 77441 - DNA, 430 bp, Triticum aestivum
  Clone ID: PAT_TA_77441
ccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgagggacaagaggctgaggttgctgctgctgc

SEQ ID NO: 77442 - DNA, 272 bp, Triticum aestivum
  unsure (1)..(272): unsure at all n locations
  Clone ID: PAT_TA_77442
tccgctcccctctcgccgccgattgttctgcctgcgggnaaccatctcatatctcggcgaagatgagggaaatcctgcacatccagggtgggcaatgtggcaaccagatcggtgccaagttctgggaggtggtgtgtgatgagcatggcattgacccaactgggcgctacaccggtacctctgacctgcagttggagcgtgtcaatgtctactacaatgaggcctcgtgtggtcgctttgtgccccgtgctgttcttatggaccttgagccc

SEQ ID NO: 77443 - DNA, 457 bp, Triticum aestivum
  unsure (1)..(457): unsure at all n locations
  Clone ID: PAT_TA_77443
ggcaaggccggcaaggnaccccaacaagncccaanaggcgccatnccgccttcttcgtncttcatgggcgagttccgcgnaggagttcaagcagnaagaaccccaagnaacaagtccgtcgccgccgtcggcaaagcggccggtgagnaggtggnaagagcttggagcgaatcggaaaaggccccctatgtggccaaggccaacaagctcaaggggcgagtacaacaaggccattgctgcctacaacaagggcgagagcgctgctgctgctgccccaaagaaggctgcggccaaggnaggtagagggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcg

SEQ ID NO: 77444 - DNA, 187 bp, Triticum aestivum
  unsure (1)..(187): unsure at all n locations
  Clone ID: PAT_TA_77444
atgggtacccacccggtggccaggggggataccctccggcagggtacccgccgcagcagggnaggttaccctccacagcaaggaggttaccctccacagcaagggatacccgcctgcacctgggagcttacccacctgcacctggggcataccctcctgcacctggggcgtaccctcctgcacctgg

SEQ ID NO: 77445 - DNA, 452 bp, Triticum aestivum
  Clone ID: PAT_TA_77445
gcgcttcctggtgacaatgtcggcttcaacgtgaagaacgttgctgtcaaggtatctgaagcgtgggtttgttgcatccaactccaaggatgaccctgccaaggaggcagccaacttcacctctcaggtcatcatcatgaaccaccctggtcagtatcggcaacggctacgccccagtgctggactgccacacctcccacattgctgtcaagtttgctgagctggtgaccaagattgacaggcgatctggtaaggagattgaggctgcgcccaagttcctgaagaacggtgacgctggtatcgtgaagatgattcccaccaagcccatggttgtggagacctttgccacctaccctcctcttggccgcttcgctgtgcgtgacatgagacaaacggttgctgttggtgtcatcaagggtgtggagaagaaggaccccaccggcgccaaggtt

SEQ ID NO: 77446 - DNA, 599 bp, Triticum aestivum
  Clone ID: PAT_TA_77446
gtggtctaacctatagcccgatcatgtgctagcgaccaatggggctaagcaatgcactacacacgctgttcttgatgttctctcatgtggtgacgaggtaaatttgaagcctaaggtgccaacaaaggtagtttgtgctgaacatcttgagttacagaacgagatactcacactgcttaacatacagtggtggttgcgaatctcaggctttgcgtgtctgtctgtgacatccttgctgtcgaaggcggattcacctttccatgatagggctgctcgacgtataaagtatgtacacgctatttaagagggccaagaaggcggaatagcctcgctgatacagtttctgactgctaacagtgccatcatcaatgagcttcactctaaagtctgttcatgggagggttgggcttccttcaatgctagggatgaaattggagaataaacaaggggttgacatgcttgtgaagttctattagtgccatcatcaatgagcttcactctaaagtctgttcatgggagggttgggcttccttcaatgctagggctgaaattggagaataattaaacaaggggttgacatgcttgtgaagttctattag

SEQ ID NO: 77447 - DNA, 476 bp, Triticum aestivum
  unsure (1)..(476): unsure at all n locations
  Clone ID: PAT_TA_77447
ccccatttcgccagcggcgcagnccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggagg

SEQ ID NO: 77448 - DNA, 681 bp, Triticum aestivum
  Clone ID: PAT_TA_77448
cgaggctccctcctctcgatttcgattggaatcggagccagctccgctgcctgattagccggccggccccggccccgtctccgtccccatggcgtccaagcggatcctcaaggagctcaaggacctgcagagggatccccccacctcctgcagcgccggtaattttcgccgccagatctacttatttattgccagctagctctacctatttactgccactttcatggaagatccctcggtgacagatgcatgtgtgatgatttgtcgtttccgtggcctcgttgctagatatatgtatgtcgattaattgagaggatctacttatttgctagaactgtagtcccggggaatcgagcgcttttggaaatttctgtgtatagccgggagaaattgcggtaaccagtaaggatctcaaagggagggcaaaccgttgtggaccaactggtcgctggtcatcctgagccgatacagttagcctactggcacacataaaatggtagttgtactgttcctgcaagaaaaactgtggcaatggaccaaacacctactgcaaatagtcatgctcgccttcatttctttcgtatctgtgctcccggtttaacatagtacttcccccttttgaacacgtaatcagtaattacatttttacatatgcttggacgtgggatgcgtggggtaccc

SEQ ID NO: 77449 - DNA, 627 bp, Triticum aestivum
  Clone ID: PAT_TA_77449
gcctcgtgccgctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcataaggagccta

SEQ ID NO: 77450 - DNA, 261 bp, Triticum aestivum
  unsure (1)..(261): unsure at all n locations
  Clone ID: PAT_TA_77450
tcggaatcaacggtttcggaaggatcgggaggctcgtcgtcagggtcgccctccagagcgacgatgtcgagctcgtcgccgtcaacgacccctttatcaccaccgagtacatganctacatgttcaagtncgacaccgntcacggccactggaagcacagtgacatnaagctcaaggacgacaagacgctgctctttggcgagaagccagntaccgtnttcggcgtcaggaaccctgaggagatnccgtggggtgaggctg

SEQ ID NO: 77451 - DNA, 625 bp, Triticum aestivum
  unsure (1)..(625): unsure at all n locations
  Clone ID: PAT_TA_77451
gaggaattcggacgagggatctgttctaaccctccctccgtccgtcgcagctccagatttccttcccatggctccgatcaagatcggcatcaatggtttcggccggatcggcaggcttgtggccngggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttntcactgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggttatcaatgacaggtttggcattgttgagggtttgatgaccacagttcatgccatgactgcaacc

SEQ ID NO: 77452 - DNA, 875 bp, Triticum aestivum
  unsure (1)..(875): unsure at all n locations
  Clone ID: PAT_TA_77452
tctcgtctccgatcgactccagctccccttcctccggtcctccccgccgccccaagatgcagatctttgtcaagaccctcactggcaagaccatcacccttgaggtcgagtcgtctgataccatcgacaatgtcaaggctaagatccaggacaaggagggcatccccccggaccagcagcgcctcatctttgctggcaagcagctggaggacggcaggacccttgctgactacaacatccagaaggagtccaccctccaccttgtcctccgtcttcgtggaggcatgcagatctttgtgaagaccctcactggcaagaccattacgcttgaggtggagncatccgacaccatcgacaatgtgaaggcaaagatccaggacaaggagggcatccccccggaccagcagcgcctcatctttgctggcaagcagctggaggacggcaggacccttgctgactacaacatccagaaggagtccaccctccaccttgtgctncgtcttcgtggaggcatgcagatctttgtcaagaccctnactggcaagaccattactcttgaggnggagnnattcgacaccatcgacaatgtgaagggcaaagattcaggacaagggagggcattcccccggaccagcagcgtctcatnttttnctggcaagcagcttggaggacggcaggaaccctttgctgactacaacattcagaaggagnccanccttccanctttgggcttgcgtctttcnagggaggcatgcagatctttgtgnagaacctttactgggaagaacattancnttgnngggggngnncttngnaancatanacaatgtcaaggggaanaatccagncaaggangggatttcnccggancagca

SEQ ID NO: 77453 - DNA, 628 bp, Triticum aestivum
  unsure (1)..(628): unsure at all n locations
  Clone ID: PAT_TA_77453
tccccaacccaaaccaggnagcgccctccctcccccagccgcccgccccctccccacccaggaaaccagccatgaagggggccaaatccaagggcgccgtcaaggccgacaccaagttggcggtgaagagcaagggggcggagaagccggccgccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagtgctgctgctgctgccccaaagaaggcggcggccaaggaggtagaggaggacgatgaggaggaatccgacaagtccaagtcggagatcaatgatgacgatgacgatgagggtagcgacgaggacgaggacgatgacgagtgaagcggacaatgcgggagctgctgtgcgagaagcgacctgagctgtgtgcggtggtgtcataaggagcctat

SEQ ID NO: 77454 - DNA, 453 bp, Triticum aestivum
  unsure (1)..(453): unsure at all n locations
  Clone ID: PAT_TA_77454
agcgaagcgcgagaaggaaaggcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactganctcancaagatctgtgatggcatcctcaagcttntggactcccaccttgtncccttntgncactgcagcanantccaangtgttntatntgaaaatgaangntg

SEQ ID NO: 77455 - DNA, 666 bp, Triticum aestivum
  unsure (1)..(666): unsure at all n locations
  Clone ID: PAT_TA_77455
ttcggcacgaggctactcccctgcctcccccagnnctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactctcca

SEQ ID NO: 77456 - DNA, 560 bp, Triticum aestivum
  Clone ID: PAT_TA_77456
ccccatggctccgatcaagatcggcatcaatggtttcggccggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggttatcaatgacaggtttggcattgttgagggtttgatgaccacagttcatgccatgactgcaa

SEQ ID NO: 77457 - DNA, 514 bp, Triticum aestivum
  unsure (1)..(514): unsure at all n locations
  Clone ID: PAT_TA_77457
gaggaattcggcacgagggacaactgaggtnagtccgttgagatgcaccatgagtctctcctggaggcgcttcctggtgacaacgttggcttcaacgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcacacattgctgtcaagtttgctgagctggtgaccaagatcgacaggcggtctggtaaggagctggaggccctgcccaagttcctcaagaatggtgatgctggcatagtgaagatgattcccaccaagcccatggttgtggagacctttgccacttaccctcctcttggtcgttttgctgtccgtgacatgaggcagactgtggctgttggtgtcatcaagggcgttgagaagaaggacccaaccggggccaagg

SEQ ID NO: 77458 - DNA, 508 bp, Triticum aestivum
  unsure (1)..(508): unsure at all n locations
  Clone ID: PAT_TA_77458
ttcggcacgaggaaccgggnaggaacccggcgcgaggagggcaaaggaagagaagaggagatcaccgagcccagcgcgcgcacaggacagcaggcgccgcgatctcggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcct

SEQ ID NO: 77459 - DNA, 646 bp, Triticum aestivum
  unsure (1)..(646): unsure at all n locations
  Clone ID: PAT_TA_77459
gctcccccagnnnctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactctccaat

SEQ ID NO: 77460 - DNA, 466 bp, Triticum aestivum
  unsure (1)..(466): unsure at all n locations
  Clone ID: PAT_TA_77460
ggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcagacgattaacattgtctcaaatgctagctgcaccactaactgccttgctcccctagcaaagatcattaatgacnact

SEQ ID NO: 77461 - DNA, 429 bp, Triticum aestivum
  unsure (1)..(429): unsure at all n locations
  Clone ID: PAT_TA_77461
gcccactgtgattgatgaggtgaggactggcgcttaccgccagctcttccaccctgagcagcttatcagtggcaaggaggatgcatgccaacaacttcgcccgtggtcattacaccattggcaaggagattgttgatctctgccttgatcgtatcaggaagctttcagacaactgcactggtctgcagggattccttgtcttcaacgctgttggaggtggaactggctctggccttggttcgcttctcctggagcgtctctctgttgactatggaaagaagtccaagcttgggttcacagtttacccatctccccaggtctccacttctgttgttgagccatacaacagtgtcctgtccacccactcactccttgagcacaccgatgtctctatccttcttgacantgaggccatctatgacatctgcc

SEQ ID NO: 77462 - DNA, 344 bp, Triticum aestivum
  unsure (1)..(344): unsure at all n locations
  Clone ID: PAT_TA_77462
caagcttagcacagcaccaatggcgtcggagcagaccttcatcatgatcaagcctgatggcgtccagaggggcctcatcggtgaggtcatcagccgcttcgagaagaagggcttctacctcaaaggtctgaagctccagaacgtggagaagtcgttcgccgagcagcactacgccgatctgtcctccaagcccttcttcgctgggctcgtggagtacatcgtctccggccctgtcgtngctatggtctgggagggcaagagcgtcgtctccactggacgcaagataattggcgccaccaaccccctggcctctgagcccggcaccatccgnggcgactttgccg

SEQ ID NO: 77463 - DNA, 544 bp, Triticum aestivum
  unsure (1)..(544): unsure at all n locations
  Clone ID: PAT_TA_77463
acaacacatnaatagnaatctggntagctttagnatcacaaccaaaacaggcaaaacgttctcagttcaacctaggnactcgaacagtttacagaaaatggtgttcagtatgtctgcaaacatgacatggnacgcaacatctaagaaaatccaacgagtaacatgcagcagctcttcggcctaagctgtggcacccttgcccttcttcttctggagcttcctcatgtagaactccagctccttgccctccaggatgtacccatcagctctgccacactgtccagggcgagacgaaatgcaggccagcagccttccaccactgaactgctcctcaatgtgcgagtccagtgtacgtccctgctggcgcttctcaagcttcctctggacattgttgctcttctttgcttcctctgtggcagcagcagcaacctcagcctcttgtccctcagcagctttcttcttcctaccgatttcaactccataatgagtcaaggtaccactgtttgaaaggggctgcatcaacttgcacaatggcattcttgac

SEQ ID NO: 77464 - DNA, 732 bp, Triticum aestivum
  unsure (1)..(732): unsure at all n locations
  Clone ID: PAT_TA_77464
taacaggttnaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtacttgccgtggcgggggtcacacttggccatcatagatgaaggctcaaaggcgctgttggtgatctcagcaacagacagctgctcatggtaggccttctcagctgagatcactggggcataggaggaaagcatgaagtggatccttcgggtagggc

SEQ ID NO: 77465 - DNA, 672 bp, Triticum aestivum
  unsure (1)..(672): unsure at all n locations
  Clone ID: PAT_TA_77465
tgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaantctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtacttgccgtggcgggggtcacactntggccatcatagatgaaggctcaaaggcgctgttggtgatctcagcaacagacagctgctcatggt

SEQ ID NO: 77466 - DNA, 596 bp, Triticum aestivum
  unsure (1)..(596): unsure at all n locations
  Clone ID: PAT_TA_77466
ccgatagcattctcatacgagcntgctttctcgagccntgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgtgtggcgtcggtgcacccgaacataggcagcttccacattgtccagtaccggccatcatagtacccaggggatgcgttgtgctcacggaagatgaacccaaccttgctgaactcgaggcaaggcacccacttggagcggatcaggtagtcgacctgcttgaggagggccctccgtgctgagcggtggcaagtaggacagggtctcgaacttcttgatgccctcaatgggccacacctgcatgcacctgatccttccaccgttgctgacgctg

SEQ ID NO: 77467 - DNA, 569 bp, Triticum aestivum
  unsure (1)..(569): unsure at all n locations
  Clone ID: PAT_TA_77467
atcgatcaagacgatcaaagaagcaaaacagggcaggaagacaccaaacatgaccacatcaacaaggcgtctctcacactctcgcgccggccatcctccatgagcactaccacgacggcactagctactcgaccttgacgtggaagacgtccttgcgctcctcctccttgaccttgagcagggtgacccagagcacgccattcttcatctcggccttgatcttgtccatcttgtacgcgtcagcggcgggcacctcgatgcggcggttgtacctcggcaccgcggagtcgtcgtcgccgtcccagggctgcttctcgccctcgcccttgatcaccaggatgttcttgtccgcgcgcacctccacgtgctccttggtcagccccggcatcggcaccttgaggtacaccgcgtcgtcgtcctccttggccacccaccgtccgagcttttttttttaggattcagagccagacatattacaaacctgctactaanatctcaagttcaccaacaaactgactaccggattaacccgacacagacaaactacacaagcaacaagtccacgacac

SEQ ID NO: 77468 - DNA, 214 bp, Triticum aestivum
  unsure (1)..(214): unsure at all n locations
  Clone ID: PAT_TA_77468
tnctctgnngaggcagaacccaaatgatccgaccggntgaccttgaagactgnccattgaccaagctgnaccaccgacgatgcaacccaaggactgaccctgcttagactgacttgacgactgcttgagaccagaccgacaggacccaacantgactcaaacgacaagacttccncaaatctgactagtcccaancaagtgctaaggtacacgt

SEQ ID NO: 77469 - DNA, 170 bp, Triticum aestivum
  Clone ID: PAT_TA_77469
acagggaagttacattgccggcttccaaatatgaacaaacataaaaggcctgaaagcagcacggccattatgtggatccatctagcctagcttggcgaggacatcgccgagaacagtcttggtctcgccgtagtacttctcggcctcggtggggctcttgatcttggctg

SEQ ID NO: 77470 - DNA, 529 bp, Triticum aestivum
  unsure (1)..(529): unsure at all n locations
  Clone ID: PAT_TA_77470
tcaacctaggnactcgtaacagtttacagaaaatggtgttcagtatgtctgcaaacatgacatggacgcaacatctaagaaaatccaacaagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccgctgaactgctcctcaatgtgagagtccagtgtacgtccctgctggcgcttctcaagcttcctctggacattgttgctcttctttgcttcctctgtggcagcagcagcaacctcagactcttgtccctcagcagcatccttcttggcagctgcagcagntttnttnttnctaccgatttncactccataatgagncangnaccactgnttgaaaggggcannatnaanttgcacantgnnnttnttgacaaggnnntnantnctnacannntnattg

SEQ ID NO: 77471 - DNA, 228 bp, Triticum aestivum
  unsure (1)..(228): unsure at all n locations
  Clone ID: PAT_TA_77471
aacccctatgatagaaaatgttttgagaacgctgccgccaacctacgacaacctctggagttcgatgcctccaccaaaaacgaatgttgggaaaatccaccctctacagaaattattgccttccaacgttaaaaagataaaagttcgccagatcctcgaagggcaggactgggnncagacttntcttgttnttttttatttcttcccgtntaggcaccgcctgagccg

SEQ ID NO: 77472 - DNA, 191 bp, Triticum aestivum
  unsure (1)..(191): unsure at all n locations
  Clone ID: PAT_TA_77472
cagatgcagatgcagaaaccaactgcacgccgtcagtctaggaggatgtgaacttggngacggncttggtgccctcggagacggngtgcttggcgagctccccggggaggacgaggcggacggaggtctggatctncctggaggtgatggtgggcttnttgttgtagcgggcnagcttggccgactccccg

SEQ ID NO: 77473 - DNA, 505 bp, Triticum aestivum
  unsure (1)..(505): unsure at all n locations
  Clone ID: PAT_TA_77473
cgggcagatcataggattgcagcagcatgccttgggaaagcaccaggaggcaggctctagtactcgncgccctcgncaccgtnctnaccctngtcaaactcagcaccaacttcttcatagtccttctccagggcagcaagatccttacggncctcagagaactctccctcctccatgccctnacccacgtaccagtggacgaaggcgcgcttggcgtacatnaggtcaaacttgtggtcgatgcgngagaagacctcgacgacactggtggagttggagatcatgcacacagccctctggaccttggcaaggtcaccgtctgggacaacaccaggtggctggtagttgataccacacttgaagccagtggggcaccagtcaacaaactggatagtgcgcttggtcttgatggtggccacagcagcgttgacatncttgggcacaacatcaccacggtacatgaggcagcaggccatgtacttgccgtggcgggggtcacacttgg

SEQ ID NO: 77474 - DNA, 555 bp, Triticum aestivum
  Clone ID: PAT_TA_77474
gcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatt

SEQ ID NO: 77475 - DNA, 598 bp, Triticum aestivum
  Clone ID: PAT_TA_77475
caatcccctgacattgcccagggtgttacggacacttaccaagcgccctgaagagatcggtgccggtgaccgggcatcatgttcggctacgccacatgctcgccaccaagcttggagctcgccttaccgaggtccgcaagaatggcacctgcgcctggctcaggcctgacggaaagacccaggtcaccattgagtacctaaacgagggtggtgccatggtgcctgttcgtgtgcacaccgtcctcatctccacacagcatgacgagaccgtcaccaacgacgagattgccgcagacctcaaggagcacgtcatcaagccagtgattcctgggaagtacctcgatgagaacaccatcttccacctgaacccgtctggccgcttcgtcatcggcggacctcacggtgatgccggtctcaccggccgcaagatcatcatcgacacctacggtggctggggagcccacggcggcggcgccttctctggcaaggacccgaccaaggtcgaccgcagtggtgcctacattgccaggcaggctgccaagagcatcatcgccagtggtctcgcacgccgctgcattgtgcagatctcatacgccat

SEQ ID NO: 77476 - DNA, 555 bp, Triticum aestivum
  unsure (1)..(555): unsure at all n locations
  Clone ID: PAT_TA_77476
gcgagcagcgacnccttccggcgagggcagtgggcagcagcgatggagggcaaggaggaggacgtgcggctcggggcgaacaagtactcggagcgtcagcccatcggcacggcggcgcaggggtccgaggacaaggactacaaggagcccccgccggcgccgcttttcgagcccggcgagctcaagtcctggtccttctaccgcgccggcatcgccgagttcatggccaccttcctcttcctctacgtcaccatcctcaccgtgatggggtacagcggcgccgcctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacccgggcggtgttctacatcatcatgcagtgcctgggcgccatctgcggcgccggcgtggtgaaggggttccagcagggcctgtacatgggcaacggcggcggcgccaacgtggtggcg

SEQ ID NO: 77477 - DNA, 627 bp, Triticum aestivum
  unsure (1)..(627): unsure at all n locations
  Clone ID: PAT_TA_77477
ggnctgcaggnaattcggcacgagggacgggaggaggagagcggcggcgaanatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctcaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagttcgaggccaagcgcgccaagagcaaggcaagcagggagaggaagattgccaggagggaggagagattggctcagggcccgagagatcatgcaccagcacc

SEQ ID NO: 77478 - DNA, 525 bp, Triticum aestivum
  Clone ID: PAT_TA_77478
gcttggcaaggttcctgttcttgagactcctgatggtgctgtttttgagagcaatgctattgcacgctatgttgctcgctcaaagggtgacaacctgctttggggtggttctcttattgaatatgcgcgtgttgagcaaagccaaagcccaaaaatccccttgatctactgccaccaagcaagatggtacttgatgactggaagaggctatactcaaacactaagagcaacttccatgatgttgctgttaaaggtttctgggagatgtatgacccagagggctactctctctggttctgtgactacaagtaccaggaagagaacaccgtgtcctacgtgaccctgaacaaggtcggcgggttcctgcagcggatggatctgtgccgcaagtacgcttttggcaagatgctcgtgattggttctgaggcgcccttcaaagtcaaggggctgtggctcttccgtgggcaggacatccctgagttcgtcatgaatgaggtctatgacatggagctctacgagtggact

SEQ ID NO: 77479 - DNA, 538 bp, Triticum aestivum
  Clone ID: PAT_TA_77479
ggccgtcccaatcctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaa

SEQ ID NO: 77480 - DNA, 568 bp, Triticum aestivum
  unsure (1)..(568): unsure at all n locations
  Clone ID: PAT_TA_77480
gcgacaccaaanctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactcctaaatcgctaaaaaaaaaa

SEQ ID NO: 77481 - DNA, 599 bp, Triticum aestivum
  unsure (1)..(599): unsure at all n locations
  Clone ID: PAT_TA_77481
gatctcaagnaggcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaggagcaacctgcttttgacaagaagcagtttatctctcacatgaagcgctacatcaagaacctcactgccaagcttgaaggggatgacctagatgttttcaagaagaatgttgagtctgccacgaagtatcttcttagcaagctcaaggaccttcagttctttgttggcgagagcatgcatgatgatggcggcgtggtgttcgcgtactacaaggagggagctgctgatccaactttcctgtactttgcacatgggctgaaagaggtcaagtgctaatggcacagtatgctaaaatctttggggtcgtcagtatttttgctctgctctatgtatggttgtcagtcgact

SEQ ID NO: 77482 - DNA, 525 bp, Triticum aestivum
  unsure (1)..(525): unsure at all n locations
  Clone ID: PAT_TA_77482
gcncgacgctcaagcccccagnacgccgcagcgccgccactccacccgcagcggcaaccatggcggtcggcaagaacaagcgcatctccaaggggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatg

SEQ ID NO: 77483 - DNA, 522 bp, Triticum aestivum
  unsure (1)..(522): unsure at all n locations
  Clone ID: PAT_TA_77483
gcgcacccctcctntcccccactcctccctattcctatccccccagcctccccccacgaacccacagcgcgcacccgagatccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggncgcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgntgcttcaatcaaggagtaccgtaccaggattgaaaccgagctcagcaagatctgtgatggcatcctcaagcttctggactcccaccttgtcccctctgccactgcagcag

SEQ ID NO: 77484 - DNA, 479 bp, Triticum aestivum
  unsure (1)..(479): unsure at all n locations
  Clone ID: PAT_TA_77484
ttcggcacgaggcgcctacgctgcagcagccgcctcctgctacccgccgccgagnatgacaaagcgcaccaagaaggccggaatcgtcgggaagtatggtaccaggtacggtgccagtttgcgtaagcagatcaagaagatggaggtgtctcagcactccaagtacttctgtgaattctgtgggaagtttgctgtgaagaggaaagctgttggaatttggggatgcaaggactgtggcaaggtcaaggcaggcggcgcctataccatgaacactgctagtgcagtcaccgtcaggagcacgatccgtcgcttgagggagcagaccgaagcatgattgcactactgttatcttgagtaatccaggggttctgtagtggagtgaagacttaacaatctctgtattttggctatcgagcgatggatatctgttagtaattttggttctgattttaggatctttgaaacttggaaaaaaaaaa

SEQ ID NO: 77485 - DNA, 316 bp, Triticum aestivum
  Clone ID: PAT_TA_77485
cagcgacgatggccaaggacatcgaggcggcgccccccggaggggagtacggagccaaggactactctgacccgccgccggcgccgctcttcgacgccgaggagctgactaaatggtccctgtaccgcgcggtcatcgccgagttcgtggccacgctgctcttcctctacatcaccgtggccactgtcatcgggtacaagcaccaggcggaccccgccggccccaatgctgccgacgcggcctgcagcggcgtcggcatcctcggcatcgcctgggcgttcggcggcatgatcttcgtgctcgtctactgcactgc

SEQ ID NO: 77486 - DNA, 610 bp, Triticum aestivum
  Clone ID: PAT_TA_77486
atctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaaggacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactgccttgctcctcttgctaaggttatcaatgacaggtttggcattgttgagggtttgatgaccacagttcatgccatgactgcaacc

SEQ ID NO: 77487 - DNA, 885 bp, Triticum aestivum
  unsure (1)..(885): unsure at all n locations
  Clone ID: PAT_TA_77487
gcgatctcgccgggnaaatctctccgatcgaagcgaggcgaaggctctctcgtcctcctcctcaagatgcagatcttcgtgaagacccttactggcaagaccatcacccttgaggttgagtcctctgacaccatcgacaatgtcaaggcaaagatacaggacaaggagggcatccccccggaccagcagcgtctcatctttgctggcaagcagctcgaggatggccgcacccttgcggactacaacatccagaaggagtccaccctccacctggttctcaggctccgtggtggtatgcagatatttgtcaagaccctcactggcaagaccatcaccctggaggttgagtcctcggacaccattgacaatgtgaaggccaagatccaggacaaggagggtatcccaccggatcagcagcgtctcatctttgccggcaagcagcttgaggatggccgcacccttgcagactacaacatccagaaggagtccactctccacttggtgctcaggctccgtggtggtatgcagatcttcgtcaagaccctcacaggcaagaccatcaccctggaggttgagtcctcggacaccatcgacaacgtcaaggccaagatccaggacaaggagggcattcccccggaccagcagcgtcttatttttgnccggcaagcagcttgaggatggccgcaccctttgcggattacaacatccagaaggaatccaccctncacctttgncctcccgncttcgngggggcatgcaaaatntttgttnaagaccttcaccggcaaaancattacccttgggnggttgggtnccttaananccccattgacaatgnggaagggccaaaatnccaggaaangggggggcntcccccgggancag

SEQ ID NO: 77488 - DNA, 585 bp, Triticum aestivum
  Clone ID: PAT_TA_77488
gcgaactccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagaggaaggagaaggccaaggtctcctacgacaggagaaagcaactg

SEQ ID NO: 77489 - DNA, 574 bp, Triticum aestivum
  unsure (1)..(574): unsure at all n locations
  Clone ID: PAT_TA_77489
gctaccctagccgcctcccgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccagcacgctcacgatcgtctctgaccgtgttgtggactccccttgctgtctggtgactggcgagtatgggtggaccgccaacatggagaggatcatgaaggcccaggccttgagggactcgagcatggctggctacatgtcaagcaagaagaccatggagatcaaccctgagaacgccatcatggacgagctccgcaagcgcgccgacgccgacaagaacgacaagtcagtcaaggacctggtgatgctgctcttcgagacctccctgctcacctncggcttcagcctg

SEQ ID NO: 77490 - DNA, 909 bp, Triticum aestivum
  unsure (1)..(909): unsure at all n locations
  Clone ID: PAT_TA_77490
ggagaaatctcctccgatcgaagcgaagccaggctctctcgtccccctcctcaagatgcagatctttgtgaagaccctcaccggcaagaccatcacccttgaggtcgagtcctccgacaccatcgacaacgtcaaggctaagatccaggacaaggagggcatccctccggaccagcagcgcttgatcttcgctggcaagcagctcgaggatggccgcaccctggcagactacaacatccagaaggagtccacccttcacctggtgctcaggctccgtggtggcatgcagatatttgtgaagacactcaccggcaagaccatcaccctggaggttgagtcctcggacaccatcgacaacgtcaaggctaagatccaggacaaggagggcatccctccggaccagcagcgtctnatctttgctggcaagcagctcgaggatggccgcacccttgctgactacaacatccagaaggagtccaccctccacctggtgctcaggctccgtggtggcatgcagatatttgtgaagaccctcaccggcaagaccatcaccctggaggttgagtcctngggacaccatcgacaacgtcaaggctaagatccaggacaaggagggcattccttccggaccagcagcgcttgatctttgctggcaagcagcttgaggatggccggacccctggcagactacaacatncagaaggagtccacccttcacctnggngctcaggctncggggggggctgcaaatntttgggaagacccttaccggggaagaacattanccttgaggttgngtcntnggnaaccattgnaaatgggaaggccanaancnggcaagggggggnttcccccggaccaaanggntttatttttnttggaagnannttgnggaagggccnncccttg

SEQ ID NO: 77491 - DNA, 608 bp, Triticum aestivum
  Clone ID: PAT_TA_77491
ggttctaacctcccctccgtccgtcgcagctccgatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactgccttgctcctcttgctaaggttatcaatgacaggtttggcattgttgagggtttgatgaccacagttcatgccatgactgcaacccaga

SEQ ID NO: 77492 - DNA, 246 bp, Triticum aestivum
  Clone ID: PAT_TA_77492
ctcgcccagatcgccgccgattcgatccggttcctcgacgcgatggcgaccaagaggagcgtgggcaccctcggggaggcggatctcaaggggaagaaggtgttcgtgcgcgccgacctcaacgtgccgctcgacgacgcccagaagatcaccgacgacacccgcatccgcgcatccatccccaccatcaagtacctcctcgagaagggtgccaaggtcatcctggccagccatctgggccgccca

SEQ ID NO: 77493 - DNA, 914 bp, Triticum aestivum
  unsure (1)..(914): unsure at all n locations
  Clone ID: PAT_TA_77493
gcacgctcgaggtcgagtcttcagacaccattgacaacgtcaaggcgaagatccaggacaaggagggcatccctccggaccagcagcgcctcatctttgctggtaagcagcttgaggacggtcgcaccctcgctgactacaacatccagaaggagtccaccctccacctggtgctccgcctcaggggtggcatgcagatcttngtcaagaccctcaccggcaagaccatcaccttggaggtcgagtcttcagacaccatcgacaacgtcaaggcgaagatccaggacaaggagggcatccccccagaccagcagcgcctcatcttcgccggtaagcagcttgaggacggccgcacccttgctgactacaacatccagaaggagtccaccctccacctggtgctccgcctcaggggtggcatgcagatatttgttaagaccctcaccggcaagaccatcacgcttgaggtcgagtcatccgacaccattgacaacgtgaaggcgaagatccaggacaaggagggcatcccaccagaccagcagcgcctcatctttgctggtaagcagcttgaggacggtcgcaccctcgctgactacaacatccagaaggagtccacccttcacctggtgctccgcctcaggggtggtatgcagatctttgtcaagaccctcaccggcaagaccatcaccttggaggtcgagtcttcggacaccattgcaacggnnaaaggcgaagatncaggacaanggagggcattcccccnggaccagcagcgnctnatctttgncggcaagcagctttgaggacggncgnacccttgctgactacaacattcagaaggagtccacccttcanctggggctncgcctgcggggnggcatgcanattttngggaanacccttaccgnaagacc

SEQ ID NO: 77494 - DNA, 357 bp, Triticum aestivum
  unsure (1)..(357): unsure at all n locations
  Clone ID: PAT_TA_77494
aggaattcggcacgaggccgcaccgcgtcccctccctctcctgtcgcgtgcgctcggccagcaaaagcttncacataaaggccaacaagagaaaccttaatctgttgggtgccagtcaaacctcaacaacaaagtttcatgtctgatctcgacgttactctgccatctgccttcgatcctttngctgaggcaaatgctgaggatgctggtgcaggccccggcgcaaaagattatgtgcatgtgcgcatccagcagcgcaacggcaggaagagtctgaccactgtccagggcctgaagaaggagttcagntacaacaagatcctcaaggatctcaagaaggaattctgctgcaatggc

SEQ ID NO: 77495 - DNA, 644 bp, Triticum aestivum
  Clone ID: PAT_TA_77495
gccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgt

SEQ ID NO: 77496 - DNA, 577 bp, Triticum aestivum
  Clone ID: PAT_TA_77496
ggcccctcttctcttcctctgcccacaaaaccctagccgtcgcctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtacgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgaactttacgccgagaaggtcgtcaaccgtggcctctgcgccatcgcccaggccgagtcactccgctacaagctcctcggtggccttgccgtccgcagggcatgctatggtgttcttcgctttgttatggagagtggtgctaagggttgtgaggtcattgtgagcggcaagctcagggcccagagagccaagtcgatgaagttcaaggacgggtacatgatctcatctggtca

SEQ ID NO: 77497 - DNA, 595 bp, Triticum aestivum
  Clone ID: PAT_TA_77497
gcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtcc

SEQ ID NO: 77498 - DNA, 560 bp, Triticum aestivum
  unsure (1)..(560): unsure at all n locations
  Clone ID: PAT_TA_77498
gcatgtgcaagtatgaaccaatttgaactgtgaaactgcgaatggctcattaaatcngttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagt

SEQ ID NO: 77499 - DNA, 548 bp, Triticum aestivum
  unsure (1)..(548): unsure at all n locations
  Clone ID: PAT_TA_77499
ggccccgacgctcaagcccccagnacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagac

SEQ ID NO: 77500 - DNA, 349 bp, Triticum aestivum
  Clone ID: PAT_TA_77500
gcctttcggttcttcggcctcctgaagaatagcatcagcacaacatggtcatggtctttggcgagatcaccaccaaggccaccgtcgactacgagaagatcgtccgcgacacctgccgcaacatcggcttcatctctgacgacgtcggtctcgatgctgaccattgcaaggtgcttgtcaacatcgagcagcaatcccctgacattgcccagggtgttcacggacacttcaccaagcgccccgaagagatcggtgccggtgaccagggcatcatgttcggctacgccaccgatgagactcctgagctgatgcccctcacccacatgctcgccaccaagcttggagctcg

SEQ ID NO: 77501 - DNA, 559 bp, Triticum aestivum
  Clone ID: PAT_TA_77501
atgcttgtctaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattc

SEQ ID NO: 77502 - DNA, 239 bp, Triticum aestivum
  unsure (1)..(239): unsure at all n locations
  Clone ID: PAT_TA_77502
cacacccgccgccatggctcgccgcagcggaggaggaagatcttcccgccctgctccacgtgctgctccagtgagaaacccaccagcgccagcccgtcaagctcctccacctgctactacccagagcagcggtggtggnannatgagcggaattgggtccactattgctcagggcatggcttttggtactggcagtgctatggcgcacagggctgctgatgctgtgatgggtccccgta

SEQ ID NO: 77503 - DNA, 490 bp, Triticum aestivum
  Clone ID: PAT_TA_77503
gcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcagacgttaacattgtctcaaatgctagctgcaccact

SEQ ID NO: 77504 - DNA, 602 bp, Triticum aestivum
  Clone ID: PAT_TA_77504
gtccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagt

SEQ ID NO: 77505 - DNA, 560 bp, Triticum aestivum; identical to SEQ ID NO: 68798
  Clone ID: PAT_TA_77505

SEQ ID NO: 77506 - DNA, 427 bp, Triticum aestivum
  Clone ID: PAT_TA_77506
gaggaattcggcacgaggacagacccctcccctcccctcccctcccccaacccaccggcggcggcgcagcgcagcttgaggaaggaagcgaagatggtgaagttcctgaagcccggcaaggcggtgatcctgctgcagggcaggtacgcggggaagaaggcggtgatcgtgcgcgtgttcgaggagggcacccgcgaccgcccgtacgggcactgcctcgtcgccgggctggccaagtacccgaagaaggtgatccgcaaggactcggccaagaagacggccaagaagtcccgcgtcaaggtgttcctcaagctcgtcaacttcacccatctcatgcccacccgctataccctcgacgtcgacctcaaggaggtggcctccggcgcgcccgactccctcacctccaaggacaagaaggtgggcgccg

SEQ ID NO: 77507 - DNA, 551 bp, Triticum aestivum
  Clone ID: PAT_TA_77507
gaggaattcggcacgaggatcgaggacactccgtcgacatcgtcttctccactggctgctcatgtacctcaacgacgaggaggttgagaagctgattggcaggatagtgaagtggctgaagcccggtgggcatattttcatcagggaatcgtgcttccaccagtctggggattccaagaggaaagtgaacccgacgcactaccgggagccgaggttctacaccaaggtgtttaaggaatgccactcctatgaccaagaggggaattcctttgagctttctctggtaacttccaagtgcattggagcttatgtgaaaagcaagaagaaccagaaccagatatgttggctgtgggagaaggtcaagtgcacagaagacaaaggctttcagagattcctggacaatgtgcagtacaaatccactggaatcttgcgttatgagcgcgtgtttggggagggttatgttagcaccggtggattcgagaccacaaaggagtttgtggacaagctggacctgaaacctatgatgtccatgtcctcggcatcgatctttc

SEQ ID NO: 77508 - DNA, 665 bp, Triticum aestivum
  Clone ID: PAT_TA_77508
gaggaattcggcacgaggccgcccctcgctgccgctgcgtctcgtctccccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgtt

SEQ ID NO: 77509 - DNA, 510 bp, Triticum aestivum
  Clone ID: PAT_TA_77509
aggaattcggcacgaggttgcttgtctaaagataagcctgcatgtgcaagtatgaaccatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgctcagctccgacgaggtgctcttcaccggcagcccagccaccgcggaactcgtcaagctctacgcagcc

SEQ ID NO: 77510 - DNA, 647 bp, Triticum aestivum
  Clone ID: PAT_TA_77510
gcaggaacggaaccacaaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttcgctgggaagcagctggaggatggccgtaccctcgctgactacaacatccagaaggagtccaccctccaccttgtcctgcgtctgcgtggtggcatgcagatcttcgtgaagaccctcactggaaagactatcacccttgaggttgagagctctgacaccatcgacaatgtcaaggccaagatccaagacaaggagggcattcccccggaccagcagcgcctgatctttgctggcaagcagctggaggatggtcgcaccctcgccgactacaacatccagaaggagtccacccttcacctggtgctccgcctccgtggtggtcagtaattgccctctcactcgacctgctgctgctgctgtaccctgtgtcgtcctgtgggtgcgcctttgttcaagtgctgtctcgtttgtgtgaagtcgtactgtgt

SEQ ID NO: 77511 - DNA, 606 bp, Triticum aestivum
  Clone ID: PAT_TA_77511
aggaattcggcacgaggctgcggcggcgcgcgcataggaggcgaatagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggag

SEQ ID NO: 77512 - DNA, 280 bp, Triticum aestivum
  unsure (1)..(280): unsure at all n locations
  Clone ID: PAT_TA_77512
ggcacgagggcctcccttcccctgccaaccccaaattctcccctcgcccgtcgcagctctcgaatcccccccgagcatcgaccatgtcggcctactgcggaaagtacaaggatgagctcatcaagaacgctgcctacatcggcacccctggcaagggtatcctcgctgctgatgagtccaccggcaccatcggcaagcgctttgccagcatcaatgttgagaacgttgaggacaaccgtcgtgccctccgtgagctcctcttctgcacccctggngccct

SEQ ID NO: 77513 - DNA, 601 bp, Triticum aestivum
  Clone ID: PAT_TA_77513
attcggcacgagggccggcgcctccacttctctgctccctcgtctcctcgcgcgcagggcccggcgaaagggaagcaagatgtacaccgccaggaagaagatccagaaggacaagggcgtcgagccctccgagttcgaggacaccgttgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgttgtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaaggagcgcaacaacactgaatacaagctggagaccttctctgcagtctac

SEQ ID NO: 77514 - DNA, 186 bp, Triticum aestivum
  Clone ID: PAT_TA_77514
atgtaattgttgaacatgagttaattacccatggagaagtctttatcattctgttgactgtgtttgtcccctctcattgccattggtagttataagtaacttgtttttttattagaacgtattgggtcaatggctgtaacagaccagcaacccagcaaatatgcttatttcatttcaaaaaaaaaa

SEQ ID NO: 77515 - DNA, 337 bp, Triticum aestivum
  Clone ID: PAT_TA_77515
cgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtcttggtgccagcagccgcg

SEQ ID NO: 77516 - DNA, 251 bp, Triticum aestivum
  unsure (1)..(251): unsure at all n locations
  Clone ID: PAT_TA_77516
cggttcgatgactccttcagcttggcctctttcaaggcctacatgcgccgagttcatctccaccctcatcttcgtcttcgccggcgtcggctctgccatcgcctactccaaggtgagcggcggcgcgccgcttgacccatccgggctgatcgccgtggcgatctgccacgggttcgggctgttcgtcgcggtcgccgtcggcgccaacatctccggnggccatgtgaaccctgccgtcaccttcggcctng

SEQ ID NO: 77517 - DNA, 665 bp, Triticum aestivum
  unsure (1)..(665): unsure at all n locations
  Clone ID: PAT_TA_77517
ggcggcggcgaanatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctcaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagttcgaggccaagcgcgccaagagcaaggcaagcagggagaggaagattgccaggagggaggagagattggctcagggcccgagagatcatgcaccagcaccagcggctgcagctcccgctcaggcagcagcggcaccaaagaaggccaagaagtgaaggtctgacatgaagctttagc

SEQ ID NO: 77518 - DNA, 518 bp, Triticum aestivum
  Clone ID: PAT_TA_77518
agatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcggttaaaaaaaaaa

SEQ ID NO: 77519 - DNA, 577 bp, Triticum aestivum
  Clone ID: PAT_TA_77519
ggtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttg

SEQ ID NO: 77520 - DNA, 617 bp, Triticum aestivum
  unsure (1)..(617): unsure at all n locations
  Clone ID: PAT_TA_77520
gcgctcaagcccccagnacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagtt

SEQ ID NO: 77521 - DNA, 459 bp, Triticum aestivum
  Clone ID: PAT_TA_77521
gctttcctctcctctcactcactctccccctccgccgccggcgcagcgtcctccccgcgactccgatggccagcaagtgggtcaggcccgaggtgtacccgctgttcgcggcgacgggcgtggccatcggcatctgcgcctttagcctccttcgcaacatcaccggcaacccagaagtcagggtcaacaagatggggagggcagcgggagtgcttgagaaccatgaggagggcaggcgctacgccgagcacggcctcagagcttatgtgcaggacaagacccccgagatcatgccaggaatcaacaagttcttcaccagcccaaaatgaagcactttagtctgtctgtgactcgctattagtaactgttgtggtcaagtgcaaacctatttcaagcattcagtaatgttgttgcgtccataattcagaggacatcgtcaattacctcttaaaaaaaaaa

SEQ ID NO: 77522 - DNA, 874 bp, Triticum aestivum
  unsure (1)..(874): unsure at all n locations
  Clone ID: PAT_TA_77522
gctctctcctcctcctcctcaagatgcagatcttcgtgaagacccttaccggcaagaccatcacacttgaggtcgagtcctctgacaccatcgacaatgtcaaggcaaagatccaggacaaggagggcattcccccggaccagcagcgtctcatctttgctggcaagcagctcgaggatggccgcacccttgcagactacaacatccagaaggagtccaccctccacttggtgcttaggctccgtggtggtatgcagattttcgtcaagaccctgaccggcaagaccatcaccctggaggttgagtcctcggacaccatcgacaacgtcaaggccaagatccaggacaaggagggcattcccccggaccagcagcgtcttatcttcgccggcaagcagcttgaggatggccgcacccttgcggattacaacatccagaaggaatccaccctccacctggtactcaggcttcgtggtggcatgcaaatctttgtcaagaccctcactggcaagaccattaccctggaggttgagtcctcggacaccattgacaatgtgaaggccaagatccaggacaaggagggcatccccccggaccagcagcgcctgatctttgccggcaagcagctcgaggatggccgcacccttgcggattacaacatccagaaggagtccaccctncacttggtgctcaggctccgtggtggcatgcagatatttgtgaagaccctcacgggcaagancatcaccctgggaggnggagtcatctgacaccattgacacnnngaaggcnaagatccaggacaagggagggcattcccccggaccancagcgcctgattttgctggtaagcagctttgaggatggncgcncc

SEQ ID NO: 77523 - DNA, 570 bp, Triticum aestivum
  unsure (1)..(570): unsure at all n locations
  Clone ID: PAT_TA_77523
gagtagtntatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattc

SEQ ID NO: 77524 - DNA, 472 bp, Triticum aestivum
  Clone ID: PAT_TA_77524
ggtccaagcaaagcatccccagcccagccgagaccgcgtgcgctccacgcagcatccgccgcagcagccgcccagagaagtcgccgccggagaagggggaggatgtcgtggcagacgtacgtcgacgaccacctgtgctgcgagatcgacggccagcacctcacctccgccgccatcctcggccacgacggcagcgtctgggccgagtcccccaacttccccaagttcaagcctgaggagattgctggcatcgttaaagactttgaagaacctggacaccttgcaccaactggtcttttccttggaggcacaaagtacatggtcatccaaggtgaacctggggttgtcatccgaggaaagaagggcaccggtggcattactatcaagaagaccggcatggccctgattcttggtatctacgatgagcccatgactcctggccagtgcaatttggtcgtggagaggctcggcg

SEQ ID NO: 77525 - DNA, 141 bp, Triticum aestivum
  unsure (1)..(141): unsure at all n locations
  Clone ID: PAT_TA_77525
cagaacgctcagggtctggctcgctatgccatcatctgccaggagaatgggctggngcccattgntgagcctganatccttgntgatggacctcatgacattgaccgntgngcttacgngactganatcgnncttgctgnc

SEQ ID NO: 77526 - DNA, 536 bp, Triticum aestivum; identical to SEQ ID NO: 68577
  Clone ID: PAT_TA_77526

SEQ ID NO: 77527 - DNA, 565 bp, Triticum aestivum
  unsure (1)..(565): unsure at all n locations
  Clone ID: PAT_TA_77527
ggtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattc

SEQ ID NO: 77528 - DNA, 370 bp, Triticum aestivum
  unsure (1)..(370): unsure at all n locations
  Clone ID: PAT_TA_77528
gatgcagatcttcgtgaagaccctgacgggtaagaccagcagcgcctcatcttcgccggcaagcagctcgaggacggccgcaccctcgccgactacaacatccagaaggagtccaccctccacctggtgctccgcctccgcggtggcgccaagaagcgcaagaagaagacgtacaccaagcccaagaagcaaaagcacaagcacaagaaggtgaagctcgccgtcctccagttctacaaggtcgacgacgccactggtaaggtcaccaggctcaggaaggagtgccccaacgctgagtgcggcgccgggaccttcatggcaaaccacttcgaccgccactactgcggnaagtgcggnctcacctacgtct

SEQ ID NO: 77529 - DNA, 623 bp, Triticum aestivum
  Clone ID: PAT_TA_77529
ctccgtctcgcgtcgcggcggcagttccctccctcgccatgggcaagattaagatcggaataacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaacgaggacaagtacacctcagacgttaacattgtctcaaatgctagctgcaccactaactgccttgctcccctagctaagatcattaatgacaacttcggtattattgagggtttgatgaccactgttcatgccatcactgccacacagaagaccgttgatggtccctcgagca

SEQ ID NO: 77530 - DNA, 631 bp, Triticum aestivum
  unsure (1)..(631): unsure at all n locations
  Clone ID: PAT_TA_77530
aggaattcggncgaggtctcctcctcctcctgccccgatcccgaaccgggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgcta

SEQ ID NO: 77531 - DNA, 531 bp, Triticum aestivum
  unsure (1)..(531): unsure at all n locations
  Clone ID: PAT_TA_77531
tgtgcaagtatgaacnatttgaactgtgaaactgcgaatggctcattaaatngttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccngcggtaattc

SEQ ID NO: 77532 - DNA, 482 bp, Triticum aestivum
  unsure (1)..(482): unsure at all n locations
  Clone ID: PAT_TA_77532
gagggagcggcggcgaagatggtgtcgctgaagctgcagaagcgcctggcctcgagcgtcctcaaatgcggcaagggcaaggtctggctcgaccccaatgaggtcaacgagatctccatggccnactcccggcagaacatccggaagctggtaaaggatggtttcatcatcaggaagcctcagaagatccacttccaggtctcgtgcaaggagggcacatgaggccaagcagaagggccgtcacttctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtactntgaaggtcaaaggtaacatgttcanagancaagagggtcctcatggagaggtatccacaagtccaaggctgagaaggcaagagagaag

SEQ ID NO: 77533 - DNA, 131 bp, Triticum aestivum
  unsure (1)..(131): unsure at all n locations
  Clone ID: PAT_TA_77533
catgacgacgggcacgatggacttcatgacgagctccggccgcatgactcccatggacgccaccccgacgccgctcttggccgtcccgtaggccgcccccatgcatgagaagacnagggcggcggcggcgc

SEQ ID NO: 77534 - DNA, 605 bp, Triticum aestivum
  Clone ID: PAT_TA_77534
ctgacgttcttccttaaacatgcacataacaagatgaaacgacaccgctacaggaacacaaccggaccactatgaagaacactagtacagtctacgacatggaatggatcgatctaagccttggtggccttcttaggggacttggtcgtcttcgagcccccaactttcgttcttgattaatgaaaacatccttggcaaatgctttcgcagttgttcgtctttcataaatccaagaatttcacctctgactatgaaatacgaatgcccccgactgtccctattaatcattactccgatcccgaaggccaacacaataggaccggaatcctatgatgttatcccatgctaatgtatccagagcgatggcttgctttgagcactctaatttcttcaaagtaacgatgccggaaacacgacccggccaattaaggctaggagcgcgatgccggccgaagggtcgagtaggtcggtgctcgccgtgaggcggaccggccgacccggcccaaggtccaactacgagctttttaactgcaacaacttaaatatacgctattggagctggaattaccgcggctgctggcaccagacttgccctccaatggatc

SEQ ID NO: 77535 - DNA, 613 bp, Triticum aestivum
  unsure (1)..(613): unsure at all n locations
  Clone ID: PAT_TA_77535
gattgatagtaattctnccttgccttttgcatgagnaaattgaggattcaaccgtcgttacatacgttgatgcatgcatgatttgctgctgcacatgctttgaaaatacacgattcaagtgctggtatgataagtggtactggccactgttttgggggccttattcattcacgtgtcgtgctgccgacgcatacgtccatcacgagttcaccttggagcagctgagcctgatctggccctgcgtcccggtgagcggcgcgatgtttcccatcttgatcatggccgtcgtgaaggcgctgctgaaggccgccgcgttggacgcaaagttgcggacagtgttgtcggtggtgtcgttgttgaagagcacctggtccgagtgcaggagccctttctgtgacaggaggttggtgtagtaggcgttgtcgaacgcgttgggcgtcgtcgtgtccaggttcgccaggttggtgttgccgccggactgggggcagttggccttgagagacgtcgcgaaggcagtgttgatgttggtgtcaccgccgtagatccgagtccggaagttggagcactgggccttcccgatggtgtgcgcgcctgagagcgcgaccatgtcgac

SEQ ID NO: 77536 - DNA, 622 bp, Triticum aestivum
  unsure (1)..(622): unsure at all n locations
  Clone ID: PAT_TA_77536
tggcagatgttatnatnctcgcagcatgacatacaattagcatgttacacatgtggacgtagatgcacagctacagtttcgaaccaacacacatacgtaaccacacaccaccctactccgtagattctggtactggtacccgagaccttattcagttcattcatgcgcagcagcagagtgtcggcgcggagattacgagttgaccttggagcagacgagcctgatctgcccctgcgtccccgtctttggcgcgatgttccccatgtttaccatggccgttgtgaaggcgctgttgaacgtcgccgcgctggacgagaagctcctgaccgtgttgtcggcgccgccgccgttgaacagcacctggtccgagtgcaggagccccttctgggacatgaggttggtgtagtaggcgttgtcgaagccgttgggcgtctgcgtgtccagcggcgccaggctgctgtcaccgccggactgggggcagttggccctgagagatgtcgcgaaggtggtgttgatgttggtctcgttgtagatcctgtccctgaaaaaccggcactgcgattgcccgatcgtgtgggcacctgagagcgcaaccatgtctgtcatgctgagctgcttgttg

SEQ ID NO: 77537 - DNA, 672 bp, Triticum aestivum
  Clone ID: PAT_TA_77537
agtttacatcttattctgtgtacgagtgtaataaggtaggattgatagtaattctccttgccttttgcatgagaaattgaggattcaaccgtcgttacatacgttgatgcatgcatgatttgctgctgcacatgctttgaaaatacacgattcaagtgctggtatgataagtggtactggccactgttttgggggccttattcattcacgtgtcgtgctgccgacgcatacgtccatcacgagttcaccttggagcagctgagcctgatctggccctgcgtcccggtgagcggcgcgatgtttcccatcttgatcatggccgtcgtgaaggcgctgctgaaggccgccgcgttggacgcaaagttgcggacagtgttgtcggtggtgtcgttgttgaagagcacctggtccgagtgcaggagccctttctgtgacaggaggttggtgtagtaggcgttgtcgaacgcgttgggcgtcgtcgtgtccaggttcgccaggttggtgttgccgccggactgggggcagttggccttgagagacgtcgcgaaggcagtgttgatgttggtgtcaccgccgtagatccgagtccggaagttggagcactgggccttcccgatggtgtgcgcgcctgagagcgcgaccatgtcgaccgtgttaaggttcttcttgagg

SEQ ID NO: 77538 - DNA, 307 bp, Triticum aestivum
  unsure (1)..(307): unsure at all n locations
  Clone ID: PAT_TA_77538
aaaacaggtcaaaacattctgcagttgcaacctaggactgcgaacagtttacagcaaaatggtgttcagtatgtctgcaaacatgacatggaacgcaacatctaagaaaatccaacgagtaacatgcagcagctcttcggcctaagctgtggcacccttgcccttcttcttctggagcttcctcatgtcnaactccagctccttgccctccaggatgtacccatcagctctgccacactgtccagggcgagacgacatgcangccaacagccttncaccactgaactgctcctcaatgngcgagtcc

SEQ ID NO: 77539 - DNA, 635 bp, Triticum aestivum
  unsure (1)..(635): unsure at all n locations
  Clone ID: PAT_TA_77539
ggattgatngtattctccttgccttttgcatgagaaattgaggattcaaccgtcgttacatacgttgatgcatgcatgatttgctgctgcacatgctttgaaaatacacgattcaagtgctggtatgataagtggtactggccactgttttgggggccttattcattcacgtgtcgtgctgccgacgcatacgtccatcacgagttcaccttggagcagctgagcctgatctggccctgcgtcccggtgagcggcgcgatgtttcccatcttgatcatggccgtcgtgaaggcgctgctgaaggccgccgcgttggacgcaaagttgcggacagtgttgtcggtggtgtcgttgttgaagagcacctggtccgagtgcaggagccctttctgtgacaggaggttggtgtagtaggcgttgtcgaacgcgttgggcgtcgtcgtgtccaggttcgccaggttggtgttgccgccggactgggggcagttggccttgagagacgtcgcgaaggcagtgttgatgttggtgtcaccgccgtagatccgagtccggaagttggagcactgggccttcccgatggtgtgcgcgcctgagagcgcgaccatgtcgaccgtgttaaggttcttcttgaggaa

SEQ ID NO: 77540 - DNA, 734 bp, Triticum aestivum
  Clone ID: PAT_TA_77540
agtacataataccaccaaaatgtgagccgctaagcccaaccaaccatcaggatacatccaataaaaggtttttagctgacataattccatacaaaaatttattctcagaagaagaggctttgaacactcctctggggcaaaccactctcccctgtatgcctctcatttacttggtgctgtgcatgtgacggatgaggtcgaccacgcgggtgctgtatccccactcgttgtcgtaccaggagacaagcttgacaaagttgtcgttcagagcaatcccggccttggcatcgaagatgctggacctgttgtcaccctggaagtcagtggaaacaaggtcctcatcaacgtaacccaaaatgcccttgaggtttccctcagactcctccttgatagcagccttaatctgatcataggttgctggcttcgcaagtctaacagtcagatcaacaacagaaacatcaacagtgggaacacggaaggccattccagtcaactttccgttaagctctgggagcaccttgccaacagcctttgcggcaccagtgctgcttggaatgatgttgaagctggcagcccttccacctctccagtccttgctggaaggaccatcaacagtcttctgggttgcagtcatggcatgaactgtggtcatcaaaccctcaacaatgccaaacctgtcattgataaccttagcaagaggagcaaggcagttagtggtgcagctagcgttggag

SEQ ID NO: 77541 - DNA, 677 bp, Triticum aestivum
  unsure (1)..(677): unsure at all n locations
  Clone ID: PAT_TA_77541
ggtgcataacaggttgnaagatacangggtcttacaacacancaggttgtaaaacaaacaccacaangcaaagattcaaacagacagataacagataaagccactcgggcagatcatgggatacgcagcagcacgccttgcgaaagcaccaggaggcaggctctagtactcgtcgccctcgtcaccgtcctcaccctcgtcgaactcagcaccaacttcttcatagtccttctncagggcagcaagatnctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctntggaccttggcaaggtcaccacctgggacaacacctggtggctggtagttgataccacacttgaagccagtggggcaccagtcaacaaactggatagtgcgcttggtcttgatggtggccacagcagcgntgacatncttgggaacaacatcaccacggtacatgagacagcangccatgtacttgccgtggctggnggtcacacttggccatcatagatgaaggctcaaaggcgctggttggtgatctcagcaacagacagctgctcatggta

SEQ ID NO: 77542 - DNA, 432 bp, Triticum aestivum
  unsure (1)..(432): unsure at all n locations
  Clone ID: PAT_TA_77542
catgcatattaacnaggtgcaaagcaggttnaagatacaaggttcttacaacacaacaggttgtaaaacaaacaccacaaagcaaacgttcaaacagacagataacagataaagccactcgggcagatcataggatagcagtagcaagccttgggaaagcaccaggaggcaggcttaatactcatcgccctcatcaccgtcctcaccctcgtcgaactcagcaccaacttcttcatagtccttctccagggcagcgagatcctcacgggcctcagagaactctccctcctccatgccctcaccgacgtaccagtggacgaaggcacgcttggcgtacatcaggtcaaacttgtggtcgatgcgggagaagacctcgacgacactggtggagttggagatcatgcacacagccctctggaccttggcaaggtc

SEQ ID NO: 77543 - DNA, 234 bp, Triticum aestivum
  unsure (1)..(234): unsure at all n locations
  Clone ID: PAT_TA_77543
caacaaaacttccagcccaggtgatatgattggcacccaggactgaatcaaatggcgtatatgaaagcgactaacttagtcgacctcctcgatcttggggccagcaccgccgctggcagccggcgcgtcctcgtccatgcctcccggcatgtcagcaccagcgccctggtacatcttggcgatgatggggntgcagaggccctncagctccttcatcttgncctcgaactcgat

SEQ ID NO: 77544 - DNA, 665 bp, Triticum aestivum
  unsure (1)..(665): unsure at all n locations
  Clone ID: PAT_TA_77544
gtaaacctacataccgtctgtaattgttcgactgttaaactactgatgactagtaactgattgcaaagtcaaagttcatacaacaatttttttaccaagnaacatatgcttccacatgtggatgccagcgtatcattggcaattggcacatatagggattaaagaaacaaaacggtttccgcaaactaacatttgtgttcccaatgtttcatatgatcaaactccatgtgagtgagagggactatccaactaccttttgttcttggacataggatcacaaacacatagtccccatttgtactttctccgaagcttcaccaaatctcagaccatgggagagctgcctaggatctggttgttgacaccaaaccaccaaacagaactccaaaattctagtagtacagtactactacagttatgaaacaactcatgtgcattgccccatgattatcaatggcaagtaaatggtaaaccatgcacccctgctttacacttataaccccacatataatagtgtaataattattgccaccgatctgtgcctctgcggtcactatggtatacaagccaagaagaaacctacctctcgccggcgactggaccgccggagctagctgtgataaaactagacctctacgtggcagtaagtggtcgnctggaacttg

SEQ ID NO: 77545 - DNA, 696 bp, Triticum aestivum
  Clone ID: PAT_TA_77545
aggttcttacacacaacaggttgtaaaacaaacaccacaaagcaaatgttaaacagacagataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgcctgggacaacaccaggtggctggtagttgataccacacttgaagccagtggggcaccagtcaacaaactggatagtgcgcttggtcttgatggtggccacagcagcgttgacatccttgggcacaacatcaccacggtacatgaggcagcaggccatgtacttgccgtggcgggggtcacacttggccatcatggaggaaggctcaaaggcgctgttggtgatctcagcaacagacagctgctcatggtaggccttctcggctgagatcactggggcataggaggaaagcatgaagtgg

SEQ ID NO: 77546 - DNA, 611 bp, Triticum aestivum
  Clone ID: PAT_TA_77546
cagcggttttcattacaggttatatccatcaacaccaacactaacggtaactaatataattcgacaacattaacggtgacagggagtaataattgaagggtgaaaacgcgccacgaatcacgcatgctggccttcctctcactcacatgcatgcacagacactgaacgacgaggccggatggacacgctagcttgtgtggctggctagcgcggtgggtgaccgttgcattaaattattggccggccggctcagttgctccggctgctccggaaggagccgagcgccttgatggccgccgcccggaggatgtactggtggtacgccgccgccgccagcgctcccacgaacgggccgacccagaagatccagtggttgtcccatgcggccttcttgttgtagatgacggcggcgccgaggctcctggcggggttgatgccggtgccggtgatggggatggtggcgaggtgcaccatgaagaccgcgaacccgatggggagcggagaagacggtgtagacgagcacgaaggtgccgacgatctccgcccccagcgcggtgccgcgggagaagccggaggccaccatgttggcgccgccgccgttggcctggtac

SEQ ID NO: 77547 - DNA, 702 bp, Triticum aestivum
  unsure (1)..(702): unsure at all n locations
  Clone ID: PAT_TA_77547
catgcatattaacncaggtgcataacaggttnaacatacaaggttcttacaacacaacaggttgtaaaacaaacaccacaaagcaaatgttcaaacagacagataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgcctgggacaacaccaggtggctggtagttgataccacacttgaagccagtggggcaccagtcaacaaactggatagtgcgcttggtcttgatggtggccacagcagcgttgacatccttgggcacaacatcaccacggtacatgaggcagcaggccatgtacttgccgtggcgggggtcacacttggccatcatggaggaaggctcaaaggcgctgttggtgatctcagcaacagacagctgctcatggtaggccttctcggct

SEQ ID NO: 77548 - DNA, 484 bp, Triticum aestivum
  unsure (1)..(484): unsure at all n locations
  Clone ID: PAT_TA_77548
gaatctggatagctttagatncaaccaaacaggaaaaacattctcagttcaacctaggactcgaacagtttacagaaaatggtgttcagtatgtctgcaaacatgacatggacgcaacatctaagaaaatccaacaagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccgctgaactgctcctcaatgtgagagtccagtgtacgtccctgctggcgcttctcaagcttcctctggacattgttgctcttctttgcttcctctgtggcagcagcagcaacctcagactcttgtccctcagcagcatccttcttggcagctgcagcagctttcttcttcctaccgatttccactcc

SEQ ID NO: 77549 - DNA, 668 bp, Triticum aestivum
  unsure (1)..(668): unsure at all n locations
  Clone ID: PAT_TA_77549
atgactatgatttagttnagcagtacataataccaccaaaatgtgagccgctaagcccaaccaaccatcaggatacatccaataaaaggtttttagctgacataattccatacaaaaatttattctcagaagaagaggctttgaacactcctctggggcaaaccactctcccctgtatgcctctcatttacttggtgctgtgcatgtgacggatgaggtcgaccacgcgggtgctgtatccccactcgttgtcgtaccaggagacaagcttgacaaagttgtcgttcagagcaatcccggccttggcatcgaagatgctggacctgttgtcaccctggaagtcagtggaaacaaggtcctcatcaacgtaacccaaaatgcccttgaggtttccctcagactcctccttgatagcagccttaatctgatcataggttgctggcttcgcaagtctaacagtcagatcaacaacagaaacatcaacagtgggaacacggaaggccattccagtcaactttccgttaagctctgggagcaccttgccaacagcctttgcggcaccagtgctgcttggaatgatgttgaagctggcagcccttccacctctccagtccttgctggaaggaccatcaacagtcttctgggttgcagtcatggcatgaactgtg

SEQ ID NO: 77550 - DNA, 101 bp, Triticum aestivum
  unsure (1)..(101): unsure at all n locations
  Clone ID: PAT_TA_77550
tcttctggccagtggtcttgtcctcagcagagacattcaggataccgttggcatcaatgtcgaagcagacagtgatctggggaacacccctgggtgcangc

SEQ ID NO: 77551 - DNA, 700 bp, Triticum aestivum
  unsure (1)..(700): unsure at all n locations
  Clone ID: PAT_TA_77551
tccttgccttttgctgagaaattgaggattnaccgtcgttcntacgttgatgcntgcatgatttgctgctgacatgctttgaaaatacacgattcaagtgctggtatgataagtggtactggccactgttttgggggccttattcattcacgtgtcgtgctgccgacgcatacgtccatcacgagttcaccttggagcagctgagcctgatctggccctgcgtcccggtgagcggcgcgatgtttcccatcttgatcatggccgtcgtgaaggcgctgctgaaggccgccgcgttggacgcaaagttgcggacagtgttgtcggtggtgtcgttgttgaagagcacctggtccgagtgcaggagccctttctgtgacaggaggttggtgtagtaggcgttgtcgaacgcgttgggcgtcgtcgtgtccaggttcgccaggttggtgttgccgccggactgggggcagttggccttgagagacgtcgcgaaggcagtgttgatgttggtgtcacccgccgtagatccgagtccggaagttggagcactgggccttcccgatggtgtgcgcgcctgagagcgcgaccatgtcgaccgtgttaaggttcttcttgaggaacgcggcctcgagctgtgaccggctagagctcgggccagggaggtcactgttcgccagcgaggcacttgcggtggtggagtncc

SEQ ID NO: 77552 - DNA, 554 bp, Triticum aestivum
  unsure (1)..(554): unsure at all n locations
  Clone ID: PAT_TA_77552
tctgtgtcgagtgtanaggtaggattgatngtattctccttgccttttgcatgagaaattgaggattaaccgtcgttacatacgttgatgcatgcatgatttgctgctgcacatgctttgaaaatacacgattcaagtgctggtatgataagtggtactggccactgttttgggggccttattcattcacgtgtcgtgctgccgacgcatacgtccatcacgagttcaccttggagcagctgagcctgatctggccctgcgtcccggtgagcggcgcgatgtttcccatcttgatcatggccgtcgtgaaggcgctgctgaaggccgccgcgttggacgcaaagttgcggacagtgttgtcggtggtgtcgttgttgaagagcacctggtccgagtgcaggagccctttctgtgacaggaggttggtgtagtaggcgttgtcgaacgcgttgggcgtcgtcgtgtccaggttcgccaggttggtgttgccgccggactgggggcagttggccttgagagacgtcgcgaaggcagtgttgatgttggtgtcaccg

SEQ ID NO: 77553 - DNA, 696 bp, Triticum aestivum
  Clone ID: PAT_TA_77553
gtggaaaaaaagtgttctcgtacaataatcgagcacggccacttcacgcccaatttcacaagaggagtttacatcttcattctgtgtacgagtgtaataaggtaggattgatagtaattctccttgccttttgcatgagaaattgaggattcaaccgtcgttacatacgttgatgcatgcatgatttgctgctgcacatgctttgaaaatacacgattcaagtgctggtatgataagtggtactggccactgttttgggggccttattcattcacgtgtcgtgctgccgacgcatacgtccatcacgagttcaccttggagcagctgagcctgatctggccctgcgtcccggtgagcggcgcgatgtttcccatcttgatcatggccgtcgtgaaggcgctgctgaaggccgccgcgttggacgcaaagttgcggacagtgttgtcggtggtgtcgttgttgaagagcacctggtccgagtgcaggagccctttctgtgacaggaggttggtgtagtaggcgttgtcgaacgcgttgggcgtcgtcgtgtccaggttcgccaggttggtgttgccgccggactgggggcagttggccttgagagacgtcgcgaaggcagtgttgatgttggtgtcaccgccgtagatccgagtccggaagttggagcactgggccttcccgatggtgtgcgcgcct

SEQ ID NO: 77554 - DNA, 558 bp, Triticum aestivum
  unsure (1)..(558): unsure at all n locations
  Clone ID: PAT_TA_77554
ggcgacattactatttcttnagaccacaagcagcacaattcctacagagattgtaccatcgcactgctaactacacacaaaacgctgccatcggaagaggcctaggaggaggtgaacttggtgacggccttggtgccctcagagacggcgtgcttggcaagctcgccggggaggacgaggcgaacggaggtctggatctccctcgacgtgatggtgggcttcttgttgtaccgcgcgagcttggcggactcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttggccttcttcttccccttcttctcgcctccgccctccttggacgccggcaccttcttctccgccttgggcttcttgcccgccggggtcttctccaccggcttcttctctgcggccttgggcgccatgggtgcttcgacggcggtggagcttggttggaaggtgtgggctgac

SEQ ID NO: 77555 - DNA, 608 bp, Triticum aestivum
  unsure (1)..(608): unsure at all n locations
  Clone ID: PAT_TA_77555
tgtgcggattnaatttgaataacataactgaaatatcaacaaactggagaagtaacagatcgcaggaaacccaattctataacttaaaattccaggccgaaatgggggatctctctgtcaaccgaaccgaaccgtcaccatcgtcctacgcaacaacagcagggggcaaaaaattctccgacttagctctaatggggggcgcgccgctgaccgatcagaggctaaagccatccgccgaggaggaactcgtcgaggtcctggaagaaggcgtcgttcttgattaatgaaaacatccttggcaaatgctttcgcagttgttcgtctttcataaatccaagaatttcacctctgactatgaaatacgaatgcccccgactgtccctattaatcattactccgatcccgaaggccaacacaataggaccggaatcctatgatgttatcccatgctaatgtatccagagcgatggcttgctttgagcactctaatttcttcaaagtaacgatgccggaaacacgacccggccaattaaggctagggagcgcgatgccggccgaagggtcgagtaggtcggtgctcgccgtgaggcggaccggccgacccggcc

SEQ ID NO: 77556 - DNA, 534 bp, Triticum aestivum
  Clone ID: PAT_TA_77556
acatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagagcacgccgtt

SEQ ID NO: 77557 - DNA, 568 bp, Triticum aestivum
  unsure (1)..(568): unsure at all n locations
  Clone ID: PAT_TA_77557
caattatagaaagttttcgagacacttaacatctgatagttactgacaccaacattggagagtcgactgacaaccatacatagagcagagcaaaaatactgacgaccccaaagattttagcatactgngccattagcacttgacctctttcagcccatgtgcaaagtacaggaaagttggatcagcagctccctccttgtagtacgcgaacaccacgccgccatcatcatgcatgctctcgccaacaaagaactgaaggtccttgagcttgctaagaagatacttcgtggcagactcaacattcttcttgaaaacatctaggtcatccccttcaagcttggcagtgaggttcttgatgtagcgcttcatgtgagagataaactgcttcttgtcaaaagcaggttgctcctgaagacggaaggtgtcaacaatgtcaaccaccttcacggnctggtcatcgacaccctcatcgtcaccaccaccctcagcagagggattggctccaatgtccacatcaactgctccttgaacgacccaatggccatcgacttcccagagcacgccgttc

SEQ ID NO: 77558 - DNA, 576 bp, Triticum aestivum
  unsure (1)..(576): unsure at all n locations
  Clone ID: PAT_TA_77558
acggtgcactgttagctacagactnagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgaga

SEQ ID NO: 77559 - DNA, 639 bp, Triticum aestivum
  unsure (1)..(639): unsure at all n locations
  Clone ID: PAT_TA_77559
cattcccccagnactcaacaaccacaacaaccatttccccagcaaccacaacaaccatttccccagactcaacaaccccaacaaccatttccccaacaaccacaacaaccattcccccagactcaacaaccccaacaaccatttccccagctccagcaaccacaacaaccttttccccagccccaacaacaattaccgcagccccaacaaccgcaacaatcattcccccaacaacaacggtcattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcagcagcaacaacaacaacaacaacaaggcatgcatatctttctgccactatctcagcagcaacaggtgggtcaaggttctctagtccaaggccagggcatcatccaaccacaacaaccagctcaattggaggcgatcagatcattggtattgcaaactcttccatncatgtgcaac

SEQ ID NO: 77560 - DNA, 280 bp, Triticum aestivum
  unsure (1)..(280): unsure at all n locations
  Clone ID: PAT_TA_77560
accaatatggcctncaaccaggaaccaggtccagctaccacgccggcgagtaccaaggcccgcaccgtaggagaagaccgggcaggtgatgggcgcgaccaaggacaaggcggtgcagaccacggaggccaccaagcagaaggccggacagaccaccgaggccaccaagcagaaggncggcgagacngncgacgcaactaagcattaaggccgttcaggccacggaggccaccaannnganngncgtcnagacggtncgnggccaccnagcagaaggccg

SEQ ID NO: 77561 - DNA, 589 bp, Triticum aestivum
  Clone ID: PAT_TA_77561
catgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgtgagaacggacctgagctgtgtgcggtggtgtcataaggagcctatcca

SEQ ID NO: 77562 - DNA, 516 bp, Triticum aestivum
  Clone ID: PAT_TA_77562
cggcggcgcgcgcataggaggcgaatcagcagcggaaccgagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaaga

SEQ ID NO: 77563 - DNA, 621 bp, Triticum aestivum
  Clone ID: PAT_TA_77563
cggcgcgcgcataggtaggcgaatcagcagcggtaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttc

SEQ ID NO: 77564 - DNA, 610 bp, Triticum aestivum
  unsure (1)..(610): unsure at all n locations
  Clone ID: PAT_TA_77564
tggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgnaccatgggcactcccagtgtttatggactttaatacatacaactcgttctgttcaaaaaaaaaa

SEQ ID NO: 77565 - DNA, 596 bp, Triticum aestivum
  Clone ID: PAT_TA_77565
acggtgcactgttagctacagaccagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactccc

SEQ ID NO: 77566 - DNA, 385 bp, Triticum aestivum
  Clone ID: PAT_TA_77566
ggttgacattgttgacaccttccgtcttcaggagcaacctgcttttgacaagaagcagtttatctctcacatgaagcgctacatcaagaacctcactgccaagcttgaaggggatgacctagatgttttcaagaagaatgttgagtctgccacgaagtatcttcttagcaagctcaaggaccttcagttctttgttggcgagagcatgcatgatgatggcggcgtggtgttcgcgtactacaaggagggagctgctgatccaactttcctgtactttgcacatgggctgaaagaggtcaagtgctaatggcacagtatgctaaaatctttggggtcgtcagtatttttgctctgctctatgtatggttgtcagtcgactctccaa

SEQ ID NO: 77567 - DNA, 871 bp, Triticum aestivum
  unsure (1)..(871): unsure at all n locations
  Clone ID: PAT_TA_77567
ggcaagggcaacaaggtngcagccaggacaagggcaacaaggtcagcaaccggggcaagggcagccagggtactacccaacttctccgcagcaatcaggacaagggcaacagccaggacaatggcaacaaccaggacaagggcaaccaggatactacccaacttctccgttgcagccaggacaagggcaaccagggtacgacccaacttctccgcaacagccaggacaagggcagcaaccaggacaattgcaacaaccagcacaagggcaacaagggcagcaactagcacaagggcaacaagggcagcaaccagcacaagtgcaacaagggcagcagccagcacaagggcaacaaggtcagcagctaggacaagggcaacaaggtcagcagccaggacaagggcagcaaccagcacaagggcaacaaggtcagcagccaggacaagggcaacaaggtcagcagccaggacaagggcagcaacccgggacaagggcagccatggtactacccaacttctccgcaggagtcaggacaagggcancagccangacaatggcaacaacccagggacaatggcaacaaccaggacaagggcaaccagggtactacctaacttcttcgtttgcagctaggacaagggcaacaagggtactacccaactttntntgcaacaaccagggacaagggcagcaaccaggacaatggcnacaattngggacaagggcaacattgggtactaccccacttttccgnacttgtcaggaaagggcaacggccgggacaatgggcttgaaccaggacaaggggcaacaagggtactacccaactttttcggaanaggtaggacaagggcaacaactaggaaaatgg

SEQ ID NO: 77568 - DNA, 638 bp, Triticum aestivum
  unsure (1)..(638): unsure at all n locations
  Clone ID: PAT_TA_77568
cgggctgaggaattcggacgaggnaagctgcggcggcgcgcgcataggaggcgaatagcagcggaaccagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgct

SEQ ID NO: 77569 - DNA, 479 bp, Triticum aestivum
  unsure (1)..(479): unsure at all n locations
  Clone ID: PAT_TA_77569
ttcggcacgaggcatctctccgcctacgctgcagcagccgcctcctgctacccgccgccgagnatgacaaagcgcaccaagaaggccggaatcgtcgggaagtatggtaccaggtacggtgccagtttgcgtaagcagatcaagaagatggaggtgtctcagcactccaagtacttctgtgaattctgtgggaagtttgctgtgaagaggaaagctgttggaatttggggatgcaaggactgtggcaaggtcaaggcaggcggcgcctataccatgaacactgctagtgcagtcaccgtcaggagcacgatccgtcgcttgagggagcagaccgaagcatgattgcactactgttatcttgagtaatccaggggttctgtagtggagtgaagacttaacaatctctgtattttggctatcgagcgatggatatctgttagtnaaaaaaaaaaaaaaaaaaaaaaattttaaaaaaaaaa

SEQ ID NO: 77570 - DNA, 656 bp, Triticum aestivum
  unsure (1)..(656): unsure at all n locations
  Clone ID: PAT_TA_77570
aggaattcggcacgagggggacaagggcagccgggtactacccaacttctccgctgcagtcaggacaagggcaaccagggtactacctaacttctccgcagcagtcaggacaagggcagcagccaggacaattgcaacaatcagcacaagggcaaaaaggacagcaaccaggacaaggtcaacagccagggcaagggcaacaaggtcagcagccaggacaagggcaacaaggtcagcaaccggggcaagggcagccagggtactacccaacttctccgcagcaatcaggacaagggcaacagccaggacaatggcaacaaccaggacaagggcaaccaggatactacccaacttctccgttgcagccaggacaagggcaaccagggtacgacccaacttctccgcaacagccaggacaagggcagcaaccaggacaattgcaacaaccagcacaagggcaacaagggcagcaactagcacaagggcaacaagggcagcaaccancacaagtgcaacaagggcagcagccagcacaagggcaacaaggtcagnagctaggaccaagggcannnanggtcagcagccaggacnagggcngcaanccttnncaagggnaatanggtcngcanccantgacaagggcaactnngtcagca

SEQ ID NO: 77571 - DNA, 553 bp, Triticum aestivum
  Clone ID: PAT_TA_77571
tggcggtcggcaagaacagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtg

SEQ ID NO: 77572 - DNA, 897 bp, Triticum aestivum
  unsure (1)..(897): unsure at all n locations
  Clone ID: PAT_TA_77572
aggaattcggcacgaggagaaagtttccgatcgaatcgaagcaaaggctttctcgtccgcctccaagatgcagatctttgtgaagaccctcaccggcaagaccatcacccttgaggtcgagtcctctgacacgattgacaatgtcaaggcgaagatccaggacaaggagggcatccctccggaccagcagcgcctcatcttcgctggcaagcagcttgaggacggtcgcaccctcgctgactacaacatccagaaggagtccaccctccacctggtgctccgcctcaggggtggtatgcagatctttgtcaagaccctcaccggcaagaccatcaccttggaggttgagtcatccgacaccattgacaacgtgaaggcaaagatccaggacaaggagggcatccctccggaccagcagcgcctcatcttcgctggcaagcagcttgaggatggccgcacccttgctgactacaacatccagaaggagtccaccctccacctggtgctccgcctgcgtggtgggatgcagatcttcgtcaagaccctcactggcaagaccatcacccttgaggtcgagtnctctgacacaatcgacaacggtcaaggcgaagatccaggacaaggagggcatccccccgggaccagcagcgcctnatctttngttcggcaagcagcttgaggacggtcgcacccttgctgactacaacattnaagaagggagtncacccctccaccctgggtgctcccncctcaggggtgggnatgcnanaatactccgttcaagncnccttncccggcaagaacatnnttttncntgtaagcantttgnnggacggccngcacccttngnttgcctacaacantccagaaggagntcaccccttcncccggggctcc

SEQ ID NO: 77573 - DNA, 578 bp, Triticum aestivum
  Clone ID: PAT_TA_77573
tacggtgcactgttagctcagaccagaagtgatatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagttt

SEQ ID NO: 77574 - DNA, 479 bp, Triticum aestivum
  Clone ID: PAT_TA_77574
ggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagctt

SEQ ID NO: 77575 - DNA, 649 bp, Triticum aestivum
  Clone ID: PAT_TA_77575
gccgcccctcgctgccgctgcatctcgtctccccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgttg

SEQ ID NO: 77576 - DNA, 592 bp, Triticum aestivum
  Clone ID: PAT_TA_77576
acggtgcactgttagctacagaccagaagtgatatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcgcccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcact

SEQ ID NO: 77577 - DNA, 381 bp, Triticum aestivum
  Clone ID: PAT_TA_77577
acctgagcagcccatggtcaccctggagatgtgcatgactgggctggacaagaagaaggcctctgtcttcttcaagactcaagctgatagccacgtttcctgcgccaaggagatgaccaagctctctggtatctccgacatcattcccgagatggaggtctgtgacttcgacttcgagccctgcggctactccatgaacgccatcaacggatctgccgtctccaccatccatgtgacccccgaggacggcttcagctatgcgagctacgaggtcatgggcatggacgcctccgccctggcctacggcgacatcgtcaagagggtcctccggtgctttggcccttcagagttctctgcggcggtcaccatctttggtggccg

SEQ ID NO: 77578 - DNA, 430 bp, Triticum aestivum
  Clone ID: PAT_TA_77578
gggctgaggaattcggcacgcgggacccctcccctcccctcccctcccccaacccaccggcggcggcgcagcgcagcttgaggaaggaagcgaagatggtgaagttcctgaagcccggcaaggcggtgatcctgctgcagggcaggtacgcggggaagaaggcggtgatcgtgcgcgtgttcgaggagggcacccgcgaccgcccgtacgggcactgcctcgtcgccgggctggccaagtacccgaagaaggtgatccgcaaggactcggccaagaagacggccaagaagtcccgcgtcaaggtgttcctcaagctcgtcaacttcacccatctcatgcccacccgctataccctcgacgtcgacctcaaggaggtggcctccggcgcgcccgactccctcacctccaaggacaagaaggtgggcgccgc

SEQ ID NO: 77579 - DNA, 309 bp, Triticum aestivum
  unsure (1)..(309): unsure at all n locations
  Clone ID: PAT_TA_77579
gggctctgtcngcctcaacaactgccccagttcgaggaaataaggaacctagcgctacagacgctacctgcaatgtgcaatgtctacatccctccatattgcaccatcgtgccatttggcatcttcggtactaactgagaagaaaataactctagtactagatatatgaaacaccgttttctcagtccatggtttggtcattgtagcggtgaaaaaataatgtgacatgcactatcatgtaagaacccgaactatactagttcaaacttgggaataaaagacaaacacaggtcttgtctaaaaaaaaaa

SEQ ID NO: 77580 - DNA, 675 bp, Triticum aestivum
  Clone ID: PAT_TA_77580
aattcggacgaggaccgacggaggtagggaggaggaggaggagagcggcggcgaagatggtgtcgctgaagctgcagaagcgcctggcctcgagcgtcctcaagtgtggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcagggccccagagatcatgcaccagcaccagcggctgcagctccagctccagctccggcagcagcggcaccaa

SEQ ID NO: 77581 - DNA, 536 bp, Triticum aestivum
  Clone ID: PAT_TA_77581
gaggaattcggacgagggttgacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgc

SEQ ID NO: 77582 - DNA, 596 bp, Triticum aestivum
  Clone ID: PAT_TA_77582
aagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacataca

SEQ ID NO: 77583 - DNA, 735 bp, Triticum aestivum
  unsure (1)..(735): unsure at all n locations
  Clone ID: PAT_TA_77583
aggccagnagccaggtacaaggtagggtatcccacncggnatcagcagcgtctcatctttgccggcaagcagcttgaggatggccgcacccttgcagtactacaacatccagtaaggagtccactctccacttggtgctcaggctccgtggtggtatgcagatcttcgtcaagnaccctcacaggcaagaccatcaccctggaggttgagtcctcggacaccatcgacaacgtcaaggccaagatccaggacaaggagggcattcccccggaccagcagcgtcttatcttcgccggcaagcagcttgaggatggccgnacccttgcggattacaacatccagaaggaatccaccctccaccttgtcctncgacttcgnggaggcatgcaaatctttgtcaagaccctcaccggcaaaaccatcaccctggaggttgagtcctcagacaccattgacaatgtgaaggccaagatccaggacaaggagggcatgcccccggaccagcaancgcctgatctttgccggaaagcagctcgaggatgnccgnacccttgcggattacaacattcagaaggagntcaccctccacttgatgctnaagctncnagnnnggcatgcaaattttttngaagacccttactgncaagaccatanccccttgaagnnggngtcttntctgacanccttngacnaccntnaagncnaanatccnggncnnaggaagggcatgccncc

SEQ ID NO: 77584 - DNA, 609 bp, Triticum aestivum
  unsure (1)..(609): unsure at all n locations
  Clone ID: PAT_TA_77584
gggttttctcttttttcgggggnagnaaatctcaagnaggcggcaccatgctcgtgtaccaggnacaagctttccggcgacgagcttctgtcggattcgttcccttacagggnagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctat

SEQ ID NO: 77585 - DNA, 470 bp, Triticum aestivum
  Clone ID: PAT_TA_77585
gtcgccttggtgctgatgctcgcggcggtcccgcgcgctgccgtggccatcgactgcggccacgttgacagcttggtgagaccctgcctgagctacgttcagggcggccccagcccgtctgggcagtgctgcggcggcgtccagagcctccataaccaggcgcaatccaagagcgatcgccaagccgcttgcaactgcctcaaggggatcgctcgtggcatccacaatctcaacgaggacaacgcccgcagcctcgcccccaagtgcggtgtcaacctcccataccacatcagtctcgacatcgactgcaacagtgtgtaatgagcgacgatccgtcaagctggtgctcagctcatccatccacgtggagttgaagcgcgcagcctctatccctatgtagtatgggcactagttatgcgagtttatactgaatatgaataagaactctctcctgctggcttgctggtact

SEQ ID NO: 77586 - DNA, 518 bp, Triticum aestivum
  unsure (1)..(518): unsure at all n locations
  Clone ID: PAT_TA_77586
cttgctccgttccagctcaggcgancagcgaccaccttccggcgagggcagtgggcagcagcgatggnagggcaaggnaggaggacgtgcggctcggggcgaacaagtactcggagcgtcagcccatcggcacggcggcgcaggggtccgaggacaaggactacaaggnagcccccgccggcgccgcttttcgagcccggcgagctcaagtcctggtccttctaccgcgccggcatcgccgagttcatggccaccttcctcttcctctacgtcaccatcctcaccgtgatggggtacagcggcgccgcctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagctgtcgctgacccgggcggtgttctacatcatcatgcagtgcctgggcgccatctgcggcgccggcgt

SEQ ID NO: 77587 - DNA, 579 bp, Triticum aestivum
  Clone ID: PAT_TA_77587
atcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaaga

SEQ ID NO: 77588 - DNA, 598 bp, Triticum aestivum
  Clone ID: PAT_TA_77588
aatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactc

SEQ ID NO: 77589 - DNA, 236 bp, Triticum aestivum
  unsure (1)..(236): unsure at all n locations
  Clone ID: PAT_TA_77589
ttccgcaccgtacgccctgcgccctcaccctgccccaaagccctaaccgctcgcccgctccgccgccatgaggtccaaggccaacggtagacaccgcgttcaaggcnctccggcaagnaacaagacggnncaccggcggcgtcgncaagccgaagcgcgcccccacccccttcttcgccttcctggctgagttcaggccacagtacatggagaagcaccccgaggcaaagggcgtt

SEQ ID NO: 77590 - DNA, 624 bp, Triticum aestivum
  Clone ID: PAT_TA_77590
cgccgcagcgccgccactccacccgcagcggcaaccatggcggtcggcaagaacaagcgcatctccaaggggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgattggaaaggag

SEQ ID NO: 77591 - DNA, 619 bp, Triticum aestivum
  Clone ID: PAT_TA_77591
ccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgatcggaaag

SEQ ID NO: 77592 - DNA, 547 bp, Triticum aestivum
  unsure (1)..(547): unsure at all n locations
  Clone ID: PAT_TA_77592
atctttgctggcaagcatttnggggacggncgcacccttgctgactacaacatccagaaggagtccaccctccacctggtgnttcgcctgcgggggggcatgcanatctttgtgaagaccctcaccganaagaccatcacgctcgaggtcgagtcttcanacaccattgacaacgtcaaggcgaagatccaggacaaggagggcatccctccggaccancagcgcctcatctttgctggtaagcagcttgaggacggtcgcaccctcgctgactacaacatccagaaggagtccaccctccacctggtgctccgcctcaggggtggcatgcanatcttngncaagaccctcaccggcaagaccatcaccntgnaggtcnagtcttcanacaccatnnnacaacgncaaggcnaanatccangacaaggangncatncccccnnaccancancncctcatnttnnncgnaancanntnnangacnnncnnnccctnnctgactacaacanncannangannncaccctncacnnnnngntccnncnna

SEQ ID NO: 77593 - DNA, 133 bp, Triticum aestivum
  unsure (1)..(133): unsure at all n locations
  Clone ID: PAT_TA_77593
ggatgcccgcaagttgctcggtgccaagggcaagaggttcgccaagaagcggtatgccgagaaggcgcagatgaagaagaccctgaaaatgcatgantngtcttcttcccggcagaaggttgatgatgatgtt

SEQ ID NO: 77594 - DNA, 535 bp, Triticum aestivum
  Clone ID: PAT_TA_77594
gcatgtgcaagtatgaaccatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattc

SEQ ID NO: 77595 - DNA, 261 bp, Triticum aestivum
  unsure (1)..(261): unsure at all n locations
  Clone ID: PAT_TA_77595
ctcagggtacgcgcgcagccatgggcgacggagnaccgagtaccttcgccttccaggcccgaggatcaaccagctcctctcgctcatcatcaacaccttctactccaacaaggagatcttcctncgcgagctcatctccaactcctccgatgccttggacaagatcaggtncnagagcctcacggacaagagcaagctcgatgcgcagcccgagctcttcatccacatcatccccgacaaggcgaccagcacgctcacgat

SEQ ID NO: 77596 - DNA, 536 bp, Triticum aestivum
  unsure (1)..(536): unsure at all n locations
  Clone ID: PAT_TA_77596
agagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaggagcaacctgcttttgacaagaagcagtttatctntcacatgaagcgctacatcaagaacctcactgccaagcttgaaggggatgacctanatgttttcaagaagaatgttgagtctgccacgaagtatcttcttagcaagctcaaggaccttcagttctttgttggcgagagcatgcatgatgatggcggcgtggtgttcgcgtactacaaggagggagctgctgatccaactttcctgtactttgcacatgggctgaaagaggtcaagtgctaatggcacagtatgctaaaatctttggggtcgtcagtatttttgctctgctctatgtatggtt

SEQ ID NO: 77597 - DNA, 640 bp, Triticum aestivum
  unsure (1)..(640): unsure at all n locations
  Clone ID: PAT_TA_77597
aggaattcggcacgagggtnaggaagtctatcgtacctgaagaaggttggctacaaccctgagaaggttccctttgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtctgttgagatgcaccacgagtccctcctggaggcgcttcctggtgacaatgtcggcttcaacgtgaagaacgttgctgtcaaggatctgaagcgtgggtttgttgcatccaactccaaggatgaccctgccaaggaggcagccaacttcacctctcaggtcatcatcatgaaccaccctggtcagatcggcaacggctacgccccagtgctggactgccacacctcccacattgctgtcaagtttgctgagctggtgaccaagattgacaggcgatctggtaaggagattgaggctgcgc

SEQ ID NO: 77598 - DNA, 608 bp, Triticum aestivum
  Clone ID: PAT_TA_77598
acttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgt

SEQ ID NO: 77599 - DNA, 496 bp, Triticum aestivum
  unsure (1)..(496): unsure at all n locations
  Clone ID: PAT_TA_77599
agcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagttngtaccatgggcacttccagtggtttatggactttaatacatacaactcgt

SEQ ID NO: 77600 - DNA, 365 bp, Triticum aestivum
  Clone ID: PAT_TA_77600
gaagtgatcatggcccgcgctcaggtaatgctcatggccgtcgccttggtgctgatgctcgcggcggtcccgcgcgctgccgtggccatcgactgcggccacgttgacagcttggtgagaccctgcctgagctacgttcagggcggccccagcccgtctgggcagtgctgcggcggcgtccagagcctccataaccaggcgcaatccaagagcgatcgccaagccgcttgcaactgcctcaaggggatcgctcgtggcatctacaatctcaacgaggacaacgcccgcagcctcgcccccaagtgcggtgtcaacctcccataccacatcagtctcgacatcgactgcaacagtgtgtaatgagc

SEQ ID NO: 77601 - DNA, 516 bp, Triticum aestivum
  Clone ID: PAT_TA_77601
gcgcgattcctctcccctcgcctcctcgtcctccccctcctagggttagtacccctgcccccgccctcccccccggattccgccacggggatcgccggagaggaatcgcgacgagggcttcctcctatcagttaaatcaaagtcatggagcacaaggagaccggctgccagtctcgtgagggccccatcctttgcgtcaataactgcggcttcttcggcagtgcggcgaccatgaacatgtgctccaagtgccacaaggagatggcgatgaagcaggagcaggccaagctggccgcctcctcttttgacagcatcgtcaacggtggtgatgccgcgaaagaacatcttgctgctggcaacacggcggtggcagttgctcacgtagaggcgaagacgcttattaccgcacagcctgctgatatcgccggtcccagcgaggcggcgatggagaaccccaaaggcccaagccggtgcagcacctgcagaaagagggtcgggctgaccggattcaactgc

SEQ ID NO: 77602 - DNA, 384 bp, Triticum aestivum
  unsure (1)..(384): unsure at all n locations
  Clone ID: PAT_TA_77602
tacggtgcactgttagctacagacnagaagtgatcatggcccgcgctcaggtaatgctcatggccgtcgccttggtgctgatgctcgcggcggtcccgcgcgctgccgtggccatcgactgcggccacgttgacagcttggtgagaccctgcctgagctacgttcagggcggccccagcccgtctgggcagtgctgcggcggcgtccagagcctccataaccaggcgcaatccaagagcgatcgccaagccgcttgcaactgcctcaaggggatcgctcgtggcatccacaatctcaacgaggacaacgcccgcagcctcgcccccaagtgcggtgtcaacctcccataccacatcagtctcgacatcgactgcaacagtgtgt

SEQ ID NO: 77603 - DNA, 619 bp, Triticum aestivum
  Clone ID: PAT_TA_77603
ggcggagccgccgagccgggaagagccccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgagccatacaagggtattggtgactgctttggccgcaccatcaaggatgaaggctttggctcattgtggagaggaaacactgctaacgtcatccgttacttcccaactcaggctttgaactttgcattcaaggattacttcaagagggatgttcaacttcaagaaggacaaggatggttactggaagtg

SEQ ID NO: 77604 - DNA, 541 bp, Triticum aestivum
  Clone ID: PAT_TA_77604
gcaagcccccagacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatc

SEQ ID NO: 77605 - DNA, 643 bp, Triticum aestivum
  unsure (1)..(643): unsure at all n locations
  Clone ID: PAT_TA_77605
actagctaatacggtgcactgttagctacagaccaagaagtgatcntggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacatacaactcgttctg

SEQ ID NO: 77606 - DNA, 656 bp, Triticum aestivum
  Clone ID: PAT_TA_77606
gcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaaggagagcaacaatgtccagaggaagcttgagaagcgccagcagggacgtacactggactcgcacattgaggagcagttcagtggtggaaggctgctggcctgcatttcgtctcgccctggacagtgtggcagagctgatgg

SEQ ID NO: 77607 - DNA, 630 bp, Triticum aestivum
  unsure (1)..(630): unsure at all n locations
  Clone ID: PAT_TA_77607
ggnctgcaggnaattcggcacgaggccccaacccaaaccctaccccgccgccgccgtcgccgacgcagcgcgcggaggcgacctcccaccgccgccaagatgcagatcttcgtgaagaccctgacgggcaagaccatcacgctggaggtggagtcctctgacaccatcgacaacgtcaaggccaagatccaggacaaggagggcatcccgccggaccagcagcgcctcatcttcgccggtaagcagctcgaggacggccgcacccttgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgcccgaacgccgactgcggcgccggcaccttcatggccaaccacttcgaccgccactactgcggcaagtgcggnctcacctacgtctacaaccagaaggcttanaggtggcttgcgtttgctctgctcttttacctacctacctatcgagagncgaactcatttaga

SEQ ID NO: 77608 - DNA, 326 bp, Triticum aestivum
  unsure (1)..(326): unsure at all n locations
  Clone ID: PAT_TA_77608
atggcccgcgctcaggtaatgctcatggccgtcgccttggtgctgatgctcgcggcggtcccgcgcgctgccgtggccatngactgcggccacgttgacagcttggtgagaccctgcctgagctacgttcagggcggccccagcccgtctgggcagngctgcgncggcgtccagagccttcataaccaggcgcaatccaagagcgatcgccaagccgcttgcaactgcctcaaggggatcgctcgtggcatncacaatctcaacgaggacaactgcccgcagcctcgcccccaagtgcggtgtcaacctcccataccacatcaggc

SEQ ID NO: 77609 - DNA, 328 bp, Triticum aestivum
  unsure (1)..(328): unsure at all n locations
  Clone ID: PAT_TA_77609
acacaatggtgaaggctgtggctgngcttaccggnagtgagggtgttaagggcaccatcttcttcacccaggagggagatggnccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagttggagcggatggtgttgctaacatnaatgttactgactgccatatcccccttactggacc

SEQ ID NO: 77610 - DNA, 659 bp, Triticum aestivum
  unsure (1)..(659): unsure at all n locations
  Clone ID: PAT_TA_77610
gccgctactcccctgcctcccccagnnnctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactctcca

SEQ ID NO: 77611 - DNA, 565 bp, Triticum aestivum
  unsure (1)..(565): unsure at all n locations
  Clone ID: PAT_TA_77611
gctaatacggtgcactgttagctacagacnagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcaaaaaaaaaa

SEQ ID NO: 77612 - DNA, 564 bp, Triticum aestivum
  Clone ID: PAT_TA_77612
cgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgct

SEQ ID NO: 77613 - DNA, 357 bp, Triticum aestivum
  Clone ID: PAT_TA_77613
cacagagcagagcggataaactcagagggagatcatcaccaaccgaccatgtcgtgctgcggaggcaactgcggatgcggatccggctgcaagtgcggcaacggctgcggagggtgcaagatgtaccctgagatggacgagggggtgaacaccacctcccagaccctcatcatgggcgtggcgccctccaagggcaccccgtcgttcgaggccgccgccgagaacggaggatgcaagtgcggccccaactgctcctgcaacccgtgcacctgcaagtgatccatcaaatcaagacaaggagacgccatggacggacctgatgaaggagcactagtggttatgcatggtgtgtgtttc

SEQ ID NO: 77614 - DNA, 569 bp, Triticum aestivum
  Clone ID: PAT_TA_77614
ttcggcacgaggagaaggagcaggcggcggcggtgcccgagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctg

SEQ ID NO: 77615 - DNA, 581 bp, Triticum aestivum
  Clone ID: PAT_TA_77615
atacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtt

SEQ ID NO: 77616 - DNA, 425 bp, Triticum aestivum
  unsure (1)..(425): unsure at all n locations
  Clone ID: PAT_TA_77616
ccacaacagacatttccccaacctgcaacaaacattnccccatgaaccacaacaacaagttccccaggnctcgagcaaccacaacaaccatttctccagccccaacaaccattcccccaacaaccacaacaaccattccnccagactcnaacaaccacatcaacnatttccccagcanccacaacaaccatttcccgcagaactgaacaaccncaacaaccatttncccaacaaccacaacaaccattcccccagactcaacaactcncaacaagccatttnnccagctccagcaaccacaacaaccttttccccagccccaacaacaattaccgcagccccaacanccgcaacaatcattcccccaacaacaacggtcattcattcaaccatctgtacancaacagttgaacccatgcaagaat

SEQ ID NO: 77617 - DNA, 511 bp, Triticum aestivum
  unsure (1)..(511): unsure at all n locations
  Clone ID: PAT_TA_77617
ggcaaggnaggnaaggnaaggggnaagatgccggcggggcacgggctgcggtcgcggacgcgcgacctgttcgcgcggccgttccgcaagaaggggtacatcccgctcaccacctacctgcgcacctacaaggtcggcgagcacgtcgacgtcaaggtgaacggcgccgtccacaagggcatgccgcacaagttctaccacggccgcaccggccgcgtctgcaacgtcaccaagcgcgccatcggcgtcgagatcaacaagcaggtcggcaacaggatcatcaagaagaggatccatgtccgtgtggagcacgtgcagccatccaggtgcaacgaggagttcctccagaggaaactcaacaacgacaagctgaaggcngaggccaaggcgcgcggcgaggtcatcagcaccaagaggcagccagcagggcccaagccggggttcatggttgagggcaccaccatcgagacggtcacccccatcccgtatgacgtcgtcaacgattctcaag

SEQ ID NO: 77618 - DNA, 567 bp, Triticum aestivum
  unsure (1)..(567): unsure at all n locations
  Clone ID: PAT_TA_77618
ctccacccaatcatcactagctaatacggtgcactgttagctacagnaccaagnaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctct

SEQ ID NO: 77619 - DNA, 419 bp, Triticum aestivum
  unsure (1)..(419): unsure at all n locations
  Clone ID: PAT_TA_77619
agcgcctggcctcgagcgtcctcaagtgcggcaagggcaaggtctggctcgaccccaatgaggtcaacgagnatctccatggccaactcccngcagaatatccggtaagctggtgaaggatggtttcatcatcaggaagcctcagaagatccactccaggtntcgtgcaaggagggcacatgaggccaagcagaagggccgtcactctggatatggtaagcgtaggggtaccagggaggctaggctccccaccaagatcctgtggatgcggaggatgcgtgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaagg

SEQ ID NO: 77620 - DNA, 595 bp, Triticum aestivum
  unsure (1)..(595): unsure at all n locations
  Clone ID: PAT_TA_77620
catggcnccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtacctgagagttgagagtttgtaccatgggcactcccagtgtttatggactttaatacatacaactcg

SEQ ID NO: 77621 - DNA, 297 bp, Triticum aestivum
  Clone ID: PAT_TA_77621
gcagcagcgccgcgtcgccgacatgtgagcgacgatctcgagcgtgccgtgtgcagttcgtggagctgcatgcatgagtgtacatgtgacgggaataaatagctagcacgtacggcactgcctactacagtactacgtgcgtgtagcagaggagaggagagacgatgctctgtgtacgggatgtgcatgcttgtgttcgtgtgcgtttatgcatgcatgcacgtgagttttctatgtatgtatagtacgtgagttttccggtaataaaagacgtgaccttgcccgtcaaaaaaaaaa

SEQ ID NO: 77622 - DNA, 926 bp, Triticum aestivum
  unsure (1)..(926): unsure at all n locations
  Clone ID: PAT_TA_77622
gccgatccccaccgaanaatctccgacagnatcgaagccaaggctttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctcgaggatggtcgtacccttgctgactacaacatccagaaggagtccaccctccacctggtgctccgccttcgcggtggtatgcagatcttcgtgaagaccctgacgggcaagaccatcacgcttgaggtggagtcctcggacaccatcgacaacgtcaaggccaagatccaggacaaggagggcatccccccggaccagcagcgcctcatcttngccggcaagcagcttgaggatggccgcactctggcagactacaacatccagaaggagtccaccctccacctggtgctccgccttcgcggtggtatgcagatcttngtgaagaccctgacgggcaagaccatcacgntggaggtggagtcctcggacaccatcgacaacgtnaaggccaagatccaggacaaggagggcatcccnccggaccagcagcgcctcatctttgccggcaagcagctcgaggatggccgtacccttgctgactacaacatncagaangagtccaccctncacctggtgctccgncttcgcggtggtatgcagatcttngtgaagaccctgacnggcagacatnnannccctggaggggggagtncttgggacaccattnnacaacgtnaagggcaaanatccaggacaagggagggcattcccccgggaccagcaggggccttattttttgccggcaagcannttgaggatgggccgnaccct

SEQ ID NO: 77623 - DNA, 224 bp, Triticum aestivum
  unsure (1)..(224): unsure at all n locations
  Clone ID: PAT_TA_77623
aggtgttgtggttgctggggaaatggttgttgtggttgttgagtctgagggaatggttgttgtggttgttgggggaatgcttgttggggctggagaaatggttgttgtggttgctgaggctgnggaactngctgttgtgattgctggggnaatggttgtngtggntgctngcgaaatggttnttgtgnctgttnnctctgccggaatggctgntgnggttgctg

SEQ ID NO: 77624 - DNA, 302 bp, Triticum aestivum
  unsure (1)..(302): unsure at all n locations
  Clone ID: PAT_TA_77624
gagtgagatttcccccttnccattgattccagttagtgttccaagaaaccaaaatggcctccaactcagaaccaggccagctaccacgccggngagaccaaggcccgnaccgaggagaagaccgggcaggtgatgggcgcgaccaaggacaaggcggggcagaccacggaggccacgaagcagaaggccggcgagaccacggaggccacgaagcagaaggccgccgagaccacggaggcggccaagcagaaggccngngagacggccgaggccaccaagcagaaggccgtcgaggccaagga

SEQ ID NO: 77625 - DNA, 860 bp, Triticum aestivum
  unsure (1)..(860): unsure at all n locations
  Clone ID: PAT_TA_77625
gctcatctttgctggcaagcagcttgaggacggtcgcaccctcgctgactacaacatccagaaggagtccaccctccacctggtgctccgcctgcgtggtggaatgcagatcttcgtcaagaccctcaccggcaagaccatcacgctcgaggttgagtcttcggacaccatagacaacgtcaaggcgaagatccaggacaaggagggcatccccccggaccagcagcgcctcatctttgctgggaagcagcttgaggacggccgcacccttgctgactacaacatccagaaggagtccaccctccacttggtgctccgcctgcgtggtgggatgcagatcttcgtcaagaccctcaccggcaagaccatcacgctcgaggtcgagtcttcggacaccatcgacaacgtgaaggcgaagatccaggacaaggagggcatccccccggaccagcagcgcctcatctttgccggcaagcagcttgaggacggccgcaccctcgctgactacaacatccagaaggagtccaccctccacctggtgctccgcctgcgtggtgggatgcagatcttngtcaagaccctcaccggcaagaccatcacncttgaggttgagtcttcggacaccatngacaacgtgaaaaggcgaagatncaggacaaggagggcattcncccggaccagcagcgcctnatctttgccggcaagcagcttgaggacggccgcacncttgctgactacaacatncagaaggagtccacccttcacctggtgctncgcctgcgtggngggangcaaatctttggcagaccctcancggcnagancatcacgctcgnggtcgagtcttcngcnccatcgaca

SEQ ID NO: 77626 - DNA, 459 bp, Triticum aestivum
  Clone ID: PAT_TA_77626
cgccttggtgctgatgctcgcggcggtcccgcgcgctgccgtggccatcgactgcggccacgttgacagcttggtgagaccctgcctgagctacgttcagggcggccccagcccgtctgggcagtgctgcggcggcgtccagagcctccataaccaggcgcaatccaagagcgatcgccaagccgcttgcaactgcctcaaggggatcgctcgtggcatccacaatctcaacgaggacaacgcccgcagcctcgcccccaagtgcggtgtcaacctcccataccacatcagtctcgacatcgactgcaacagtgtgtaatgagcgacgatccgtcaagctggtgctcagctcatccatccacgtggagttgaagcgcgcagcctctatccctatgtagtatgggcactagttatgcgagtttatactgaatatgaataagaactctctcctgctggctt

SEQ ID NO: 77627 - DNA, 497 bp, Triticum aestivum
  Clone ID: PAT_TA_77627
gcctctgcccacaaaaccctagccgtcgcctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtacgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgaactttacgccgagaaggtcgtcaaccgtggcctctgcgccatcgcccaggccgagtcactccgctacaagctcctcggtggccttgccgtccgcagggcatgctatggtgttcttcgctttgttatggagagtggtgctaagggttgtgaggtcattgtgagcgg

SEQ ID NO: 77628 - DNA, 879 bp, Triticum aestivum
  unsure (1)..(879): unsure at all n locations
  Clone ID: PAT_TA_77628
gcaagggcaacaagnctcagcagccaggnacaagggcagcaaccgggacaagggcagccagggtactacccaacttctccgctgcagtcaggacaagggcaaccagggtactacctaacttctccgcancagtcaggacaagggcagcagccaggacaattgcaacaatcagcacaagggcaaaaaggacagcaaccaggacaaggtcaacagccagggcaagggcaacaaggtcagcagccaggacaagggcaaacaaggtcancaaccggggcaagggcagccagggtactacccaacttctccgcancaatnaggacaagggcaacagccaggacaatggcaacaaccaggacaagggcaaccaggatactacccaacttctccgttgcanncaggacaagggcaaccagggtacnanccaacttntccgcancanccaggacaagggcatcaaccaggacaattgcancaaccagcncaagggcaacaagggcagcaactagcacaagggcntcaagggcancaaccagcacaagtgcaacaagggcatcagccagcanaagggcaacaaggtcancagctangacaagggcancaaggtcagnagccaggacaagggcagcaaccagcacaagggcaacaaggtcancagccnggacaagggcaacaaggtcagcagncaggacaagggcatcaaccgggacaagggcagncatgggactacccaacttctncgnaggagtcaggacaagggcaacagccaggacaatggcnacaaccaggacaatggnaacaaccaggacaagggcaaccagggtactanctaactttttccgttgcagctnggacaagggcaacaagggtnctacccaactt

SEQ ID NO: 77629 - DNA, 655 bp, Triticum aestivum
  Clone ID: PAT_TA_77629
gcatcctccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgtt

SEQ ID NO: 77630 - DNA, 483 bp, Triticum aestivum
  Clone ID: PAT_TA_77630
actagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtca

SEQ ID NO: 77631 - DNA, 332 bp, Triticum aestivum
  unsure (1)..(332): unsure at all n locations
  Clone ID: PAT_TA_77631
tggcccgcgctaggtaatgctatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgntacggcgtcaagaacctccataaccaggcgcgatcccagagcgatcgccaaagcgcttgcaactgcctcaaggggatcgctcgtggcatccacaatctnaacgaggacaacgcccgcagnatcccccccaagtgcggtgtcatacctcccatacaccatcagtctcaacatcg

SEQ ID NO: 77632 - DNA, 491 bp, Triticum aestivum
  Clone ID: PAT_TA_77632
ggcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgct

SEQ ID NO: 77633 - DNA, 555 bp, Triticum aestivum
  unsure (1)..(555): unsure at all n locations
  Clone ID: PAT_TA_77633
gctcaccgcaagnaccggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgagccatacaagggtattggtgactgctttggccgcaccatcaaggatgaaggctttggctcattgtggagaggaaacactgctaacgtcatccgttacttc

SEQ ID NO: 77634 - DNA, 925 bp, Triticum aestivum
  unsure (1)..(925): unsure at all n locations
  Clone ID: PAT_TA_77634
ttcggcacgaggctcgtccgcctccaanatgcagatctttgtgaagaccctcaccggcaagaccatcacccttgaggtcgagtcctctgacacgattgacaatgtcaaggcgaagatccaggacaaggagggcatccctccggaccagcagcgcctcatcttcgctggcaagcagcttgaggacggtcgcaccctcgctgactacaacatccagaaggagtccaccctccacctggtgctccgcctcaggggtggtatgcagatctttgtcaagaccctcaccggcaagaccatcaccttggaggttgagtcatccgacaccattgacaacgtgaaggcaaagatccangacaaggagggcatccctccggaccagcagcgcctcatcttngctggcaagcagcttgagganggtcgcaccctcgctgactacaacatccanaaggagtccaccctccacctggtgctccgnctgcgtggtggcatgcagatcttcgtcaagaccctcactggcaagaccatcacccttgaggtcgagtcctctgacacgatcgacaacgtcaaggcgaagattccangacaaggagggcatccccccggaccagcagcgcctcatctttgccggcaagcagcttgaggacgggcgcaccctngctgactacaacatccanaaggagtccacccttcacctggtgctncgtctgcgnggtgggatgcanatcttcgtcnagacccttactggcgagaccatcacccttgaggtcgagtcctttgacacaatcgacaacgtcangcagattcccggncaaggngggattcccccggacaacagcgnctnatntttgccggaagcaacttgaggcggncgcacccttgntgctacaaattcaaaaggatncnccttcactggngctccnctnanggg

SEQ ID NO: 77635 - DNA, 658 bp, Triticum aestivum
  unsure (1)..(658): unsure at all n locations
  Clone ID: PAT_TA_77635
gagttgtatgtattaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagc

SEQ ID NO: 77636 - DNA, 633 bp, Triticum aestivum
  unsure (1)..(633): unsure at all n locations
  Clone ID: PAT_TA_77636
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagc

SEQ ID NO: 77637 - DNA, 635 bp, Triticum aestivum
  Clone ID: PAT_TA_77637
actgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagcac

SEQ ID NO: 77638 - DNA, 637 bp, Triticum aestivum
  unsure (1)..(637): unsure at all n locations
  Clone ID: PAT_TA_77638
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagc

SEQ ID NO: 77639 - DNA, 642 bp, Triticum aestivum
  Clone ID: PAT_TA_77639
gctgtatgtataaaagtccataaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgatc

SEQ ID NO: 77640 - DNA, 630 bp, Triticum aestivum
  unsure (1)..(630): unsure at all n locations
  Clone ID: PAT_TA_77640
actgggcagngcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagat

SEQ ID NO: 77641 - DNA, 540 bp, Triticum aestivum
  Clone ID: PAT_TA_77641
cgagctgtatgtataaaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccc

SEQ ID NO: 77642 - DNA, 205 bp, Triticum aestivum
  unsure (1)..(205): unsure at all n locations
  Clone ID: PAT_TA_77642
ttagtttaactataacctcntcngaaaagtaacacgaacaaaataagatagctgaacgctggctaggaatgtcgacacaagtactcaagaaatcagccatcaaaactgactacaaagttcacgacaccaagtggcacatatatcatcttctagatatgaagcagcaaaatagcgacttctattctctactcagcagcagcaaccc

SEQ ID NO: 77643 - DNA, 613 bp, Triticum aestivum
  unsure (1)..(613): unsure at all n locations
  Clone ID: PAT_TA_77643
aaagtcntaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactnnacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacntagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtc

SEQ ID NO: 77644 - DNA, 550 bp, Triticum aestivum
  unsure (1)..(550): unsure at all n locations
  Clone ID: PAT_TA_77644
ctgatctcctccgaggagaccngcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccct

SEQ ID NO: 77645 - DNA, 496 bp, Triticum aestivum
  unsure (1)..(496): unsure at all n locations
  Clone ID: PAT_TA_77645
ggtacacagatactgatctcctncagaggagtaccagcaagccagctggagagagtncttattcatattcagtataaactcgcataactagtgaccgtactacatagggatagaggctgngcgcttcaactncacgtggatggatgagctgagcaccagcttgacggatcgtcgcccattacaccctgctgcagtcgatgttgagactgatggtgtatgggaggttgacaccgnacttggnggggatgctgcgggcgttgtcctcgttgagattgnggatgccacgagcgatccccttgaggcagntgcaagcgctttgncgatcgntctgngatcgngcctggttatggaggttcttgacgccgtcgcagcactgcccagacggnccggggccgccctgaacgtagctcaggcagggtctcaccaagctgtcaacgtggccgcagtcgatggncacggcagcgcgcgggaccgacgcgagcatgagcaccaangc

SEQ ID NO: 77646 - DNA, 636 bp, Triticum aestivum
  Clone ID: PAT_TA_77646
aaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgatttgggtggagagatgc

SEQ ID NO: 77647 - DNA, 588 bp, Triticum aestivum
  unsure (1)..(588): unsure at all n locations
  Clone ID: PAT_TA_77647
actgggagtgccntggtacaactctaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacc

SEQ ID NO: 77648 - DNA, 564 bp, Triticum aestivum
  unsure (1)..(564): unsure at all n locations
  Clone ID: PAT_TA_77648
cattacaaagncaaancccacaattatcagnaangttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggnaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccat

SEQ ID NO: 77649 - DNA, 557 bp, Triticum aestivum
  unsure (1)..(557): unsure at all n locations
  Clone ID: PAT_TA_77649
gagctgtatgtataaaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctngttgagattgtggatgccacgagcgatccccttgaggcagttgcaagcggcttggcgatcgctcttggattgcgcctggttatggaggctctggacgccgccgnagcactgcccanacgggctggggccgccctgaacgtagctcangcagggtctcaccaagctgtcaacgtggccgcagtcgatggccacggcagcgcgcgggaccgccgcgagcatcagcaccaagg

SEQ ID NO: 77650 - DNA, 640 bp, Triticum aestivum
  Clone ID: PAT_TA_77650
ctgtatgtataaaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactaatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgatc

SEQ ID NO: 77651 - DNA, 587 bp, Triticum aestivum
  Clone ID: PAT_TA_77651
gagctgtatgtataaaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcggc

SEQ ID NO: 77652 - DNA, 486 bp, Triticum aestivum
  unsure (1)..(486): unsure at all n locations
  Clone ID: PAT_TA_77652
cnggaaaaacnttctcngttcaacctaggactcgaacagtttacagaaaatggtgttcagtatgtctgcaaacatgacatggacgcaacatctaagaaaatccaacaagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccgctgaactgctcctcaatgtgagagtccagtgtacgtccctgctggcgcttctcaagcttnctctggacattgttgctcttctttgcttcctctgtggcagcagcagcaacctcagactcttgtccctcagcagcatccttcttggcagctgcagcagctttcttcttcctaccgatttccactccataatgagtcaggtaccactgcttgaaaggg

SEQ ID NO: 77653 - DNA, 410 bp, Triticum aestivum
  Clone ID: PAT_TA_77653
agatgaaaatactgcaaggtagaacacataatagaatctggatagctttagatcacaaccaaaacaggcaaaacattctcagttcaacctaggactcgaaccgtttacagaaaatggtgttcagtatgtctgcaaacatgacatggacgcaacatctaagaaaatccaacgagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccactgaactgctcctcaatgtgcgagtccagtgtacgtccctgctggcgcttctcaagcttcctctggacattgttgc

SEQ ID NO: 77654 - DNA, 660 bp, Triticum aestivum
  unsure (1)..(660): unsure at all n locations
  Clone ID: PAT_TA_77654
gagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagcc

SEQ ID NO: 77655 - DNA, 635 bp, Triticum aestivum; identical to SEQ ID NO: 69791
  Clone ID: PAT_TA_77655

SEQ ID NO: 77656 - DNA, 540 bp, Triticum aestivum
  unsure (1)..(540): unsure at all n locations
  Clone ID: PAT_TA_77656
ggaaaaanttctagttaacctaggactcgaacagtttacagaaaatggtgttcagtatgtctgcaaacatgacatggacgcaacatctaagaaaatccaacaagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccgctgaactgctcctcaatgtgagagtccagtgtacgtccctgctggcgcttctcaagcttcctctggacattgttgctcttctttgcttcctctgtggcagcagcagcaacctcagactcttgtccctcagcagcatccttcttggcagctgcagcagctttcttcttcctaccgatttccactccataatgagtcaggtaccactgcttgaaaggggcagcatcaacttgcacaatggcattcttgacaagggtctgagtcctcacaagctcatt

SEQ ID NO: 77657 - DNA, 653 bp, Triticum aestivum
  unsure (1)..(653): unsure at all n locations
  Clone ID: PAT_TA_77657
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggaga

SEQ ID NO: 77658 - DNA, 652 bp, Triticum aestivum
  unsure (1)..(652): unsure at all n locations
  Clone ID: PAT_TA_77658
cgagttgtatgtattaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagc

SEQ ID NO: 77659 - DNA, 613 bp, Triticum aestivum
  unsure (1)..(613): unsure at all n locations
  Clone ID: PAT_TA_77659
gagctgtatatataaaagtcntaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagct

SEQ ID NO: 77660 - DNA, 521 bp, Triticum aestivum
  unsure (1)..(521): unsure at all n locations
  Clone ID: PAT_TA_77660
cgcataactagtgaccatactacatagggatagaggctgcgcgcttcaactccacgtggatggntgagctgagcaccagcttgacggatcgtcgcccattacaccctgctgnagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcncagcactgcccagacgggccggggccgccctgaacgtagctcaggcagggtctcaccaagctgtcaacgtggccgcagtcgatggccacggcagcgcgcgggaccgccgcgagcatgagcaccaangcgacggccatgagcattacctgagcgcggnccatgatcacttcttggtctgtanctaacagtgcaccgtattanctagtgatgattgngtggacctcgtgccgaat

SEQ ID NO: 77661 - DNA, 650 bp, Triticum aestivum
  unsure (1)..(650): unsure at all n locations
  Clone ID: PAT_TA_77661
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggcgagcattacctgagcgcgggccatgatcacttcttggtctgtagctaacagtgcaccgtattagctagtgatgattgggtggagc

SEQ ID NO: 77662 - DNA, 740 bp, Triticum aestivum
  Clone ID: PAT_TA_77662
gagctgtatgtataaaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagcgagagagagagagagagagagagagagagagagagagagagagagagagagagagagagagagagagagagagagagagag

SEQ ID NO: 77663 - DNA, 658 bp, Triticum aestivum; identical to SEQ ID NO: 69809
  unsure (1)..(658): unsure at all n locations
  Clone ID: PAT_TA_77663

SEQ ID NO: 77664 - DNA, 663 bp, Triticum aestivum
  unsure (1)..(663): unsure at all n locations
  Clone ID: PAT_TA_77664
gagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagcaacc

SEQ ID NO: 77665 - DNA, 653 bp, Triticum aestivum; identical to SEQ ID NO: 69808
  unsure (1)..(653): unsure at all n locations
  Clone ID: PAT_TA_77665

SEQ ID NO: 77666 - DNA, 660 bp, Triticum aestivum
  unsure (1)..(660): unsure at all n locations
  Clone ID: PAT_TA_77666
cgagttgtatgtattaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagc

SEQ ID NO: 77667 - DNA, 656 bp, Triticum aestivum
  Clone ID: PAT_TA_77667
gaacgagttgtatgtattaaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggaga

SEQ ID NO: 77668 - DNA, 658 bp, Triticum aestivum
  Clone ID: PAT_TA_77668
ttacaaagcaaatcccacaattatagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagagcacgccgttctccagctccctgtacgggaacgaatccgacagaagctcgtcgccggaaagcttgtcctggtacacgagcatggtgccg

SEQ ID NO: 77669 - DNA, 657 bp, Triticum aestivum
  unsure (1)..(657): unsure at all n locations
  Clone ID: PAT_TA_77669
gagttgtatgtattnaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgc

SEQ ID NO: 77670 - DNA, 550 bp, Triticum aestivum
  unsure (1)..(550): unsure at all n locations
  Clone ID: PAT_TA_77670
cgagctgtatgtataaaagtcntaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcag

SEQ ID NO: 77671 - DNA, 654 bp, Triticum aestivum
  unsure (1)..(654): unsure at all n locations
  Clone ID: PAT_TA_77671
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatcctcgtgccgaatt

SEQ ID NO: 77672 - DNA, 657 bp, Triticum aestivum
  unsure (1)..(657): unsure at all n locations
  Clone ID: PAT_TA_77672
cgagttgtatgtattaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgc

SEQ ID NO: 77673 - DNA, 645 bp, Triticum aestivum
  unsure (1)..(645): unsure at all n locations
  Clone ID: PAT_TA_77673
cgagctgtatgtataaaagtcntaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattc

SEQ ID NO: 77674 - DNA, 608 bp, Triticum aestivum
  Clone ID: PAT_TA_77674
gagctgtatgtataaaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctc

SEQ ID NO: 77675 - DNA, 641 bp, Triticum aestivum
  Clone ID: PAT_TA_77675
aaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagcaacc

SEQ ID NO: 77676 - DNA, 635 bp, Triticum aestivum
  unsure (1)..(635): unsure at all n locations
  Clone ID: PAT_TA_77676
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagct

SEQ ID NO: 77677 - DNA, 662 bp, Triticum aestivum
  unsure (1)..(662): unsure at all n locations
  Clone ID: PAT_TA_77677
cgctgaacagaacgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattggggc

SEQ ID NO: 77678 - DNA, 658 bp, Triticum aestivum
  unsure (1)..(658): unsure at all n locations
  Clone ID: PAT_TA_77678
gtatgtattaaagtccataaacactgggngtgcccatggtacaaactctcaactctcaggtacacagatactgatctcctccagnaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagcc

SEQ ID NO: 77679 - DNA, 659 bp, Triticum aestivum
  unsure (1)..(659): unsure at all n locations
  Clone ID: PAT_TA_77679
cgagttgtatgtattaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgcc

SEQ ID NO: 77680 - DNA, 643 bp, Triticum aestivum
  unsure (1)..(643): unsure at all n locations
  Clone ID: PAT_TA_77680
gagctgtatgtataaaagtcntaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgat

SEQ ID NO: 77681 - DNA, 592 bp, Triticum aestivum
  unsure (1)..(592): unsure at all n locations
  Clone ID: PAT_TA_77681
catggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgncgcgagcatcagcaccaaggcgacggccatgagcattacctgagcgcgggccatgatcacttcttggtctgtagctaacagtgcaccgtatta

SEQ ID NO: 77682 - DNA, 657 bp, Triticum aestivum; identical to SEQ ID NO: 69835
  unsure (1)..(657): unsure at all n locations
  Clone ID: PAT_TA_77682

SEQ ID NO: 77683 - DNA, 635 bp, Triticum aestivum
  Clone ID: PAT_TA_77683
cactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagc

SEQ ID NO: 77684 - DNA, 632 bp, Triticum aestivum
  Clone ID: PAT_TA_77684
agaaagttttaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcctggtacacgagcatggtgc

SEQ ID NO: 77685 - DNA, 661 bp, Triticum aestivum
  Clone ID: PAT_TA_77685
aacgagttgtatgtattaaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgc

SEQ ID NO: 77686 - DNA, 658 bp, Triticum aestivum
  Clone ID: PAT_TA_77686
cgagttgtatgtattaaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgc

SEQ ID NO: 77687 - DNA, 620 bp, Triticum aestivum
  Clone ID: PAT_TA_77687
ctgtatgtataaaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcc

SEQ ID NO: 77688 - DNA, 637 bp, Triticum aestivum
  Clone ID: PAT_TA_77688
cactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagcctg

SEQ ID NO: 77689 - DNA, 339 bp, Triticum aestivum
  unsure (1)..(339): unsure at all n locations
  Clone ID: PAT_TA_77689
tacaaactctcaactnttaggatacacagatactgatactcctncagaggagtaccagcaagccagcaggagagagttcttattcatattcagtataaactcgcataactagtgcccatactacatagggatagaggctgcgcgcttaaactccacgtggatggatgagctnnttttnagcttgacggatcgttggtcattacacactgttgcagtcgatgtcgagactgatgtggtatgggaggttgacaccgaacttgggggcgaggctgcgggcgnngncctcgttgagattggggatgccacgagcgatccccttgaggcagntgcaagcggntt

SEQ ID NO: 77690 - DNA, 635 bp, Triticum aestivum
  Clone ID: PAT_TA_77690
actgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagcc

SEQ ID NO: 77691 - DNA, 408 bp, Triticum aestivum
  unsure (1)..(408): unsure at all n locations
  Clone ID: PAT_TA_77691
cccatggntacaagactctcaacttttnngtacacagatactgatactantccagtaggagtaccagcaagccagctggagagagttcttattcatattcagtataaactcgcataactagtgaccatactacatagggatagaggctgcgcgcttcaactccacgtggatggatgagctnttttttnnnttgacggatcgtngcccattacaccctgctgcagtcgatgttgagactgatggtgtatgggaggttgacaccgtacttgggggggatgctgcgggcgttgtcctngttgagattgtggatgccacgagcgatccccttgaggcagttgcaagcgctttggcgatcgctctgggatcgcgcctggttatggaggttcttgacgccgtcgcagcactgcc

SEQ ID NO: 77692 - DNA, 507 bp, Triticum aestivum
  unsure (1)..(507): unsure at all n locations
  Clone ID: PAT_TA_77692
gtgcccatggtacaaactctcaactctcagnatacacagatactgatctcctccagaggagtaccagcaagccagcaggagagagttcttattcatattcagtataaactcgcataactagtgcccatactacatagggatagaggctgcgcgcttcaactccacgtggatggnttanctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggatatgcgcctggttatggaggctctggacgccgncgcagcactgcccagacgggctggggccgccctgaacgtagctnangcagggtctnaccaagctgncaacgtggncgnagncgatggncacngnagnncgcggnaccgnc

SEQ ID NO: 77693 - DNA, 641 bp, Triticum aestivum
  unsure (1)..(641): unsure at all n locations
  Clone ID: PAT_TA_77693
ccataaacactgggngtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagc

SEQ ID NO: 77694 - DNA, 633 bp, Triticum aestivum
  unsure (1)..(633): unsure at all n locations
  Clone ID: PAT_TA_77694
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattac

SEQ ID NO: 77695 - DNA, 660 bp, Triticum aestivum
  Clone ID: PAT_TA_77695
cgagttgtatgtattaaagtcctaaaactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagcc

SEQ ID NO: 77696 - DNA, 600 bp, Triticum aestivum
  Clone ID: PAT_TA_77696
cgagctgtatgtataaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcactc

SEQ ID NO: 77697 - DNA, 647 bp, Triticum aestivum
  unsure (1)..(647): unsure at all n locations
  Clone ID: PAT_TA_77697
gagctgtatgtntaaagtcntaaaactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtc

SEQ ID NO: 77698 - DNA, 547 bp, Triticum aestivum
  unsure (1)..(547): unsure at all n locations
  Clone ID: PAT_TA_77698
caggagagagttcttattntattagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatc

SEQ ID NO: 77699 - DNA, 534 bp, Triticum aestivum
  Clone ID: PAT_TA_77699
caattatagaaagttttcgagacacttaacatctgatagttactgacaccaacattggagagtcgactgacaaccatacatagagcagagcaaaaatactgacgaccccaaagattttagcatactgtgccattagcacttgacctctttcagcccatgtgcaaagtacaggaaagttggatcagcagctccctccttgtagtacgcgaacaccacgccgccatcatcatgcatgctctcgccaacaaagaactgaaggtccttgagcttgctaagaagatacttcgtggcagactcaacattcttcttgaaaacatctaggtcatccccttcaagcttggcagtgaggttcttgatgtagcgcttcatgtgagagataaactgcttcttgtcaaaagcaggttgctcctgaagacggaaggtgtcaacaatgtcaaccaccttcacggcctggtcatcgacaccctcatcgtcaccaccaccctcagcagagggattggctccaatgtccacatcaactgctccttgaacgac

SEQ ID NO: 77700 - DNA, 636 bp, Triticum aestivum
  unsure (1)..(636): unsure at all n locations
  Clone ID: PAT_TA_77700
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagccc

SEQ ID NO: 77701 - DNA, 634 bp, Triticum aestivum
  Clone ID: PAT_TA_77701
acactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgc

SEQ ID NO: 77702 - DNA, 639 bp, Triticum aestivum
  Clone ID: PAT_TA_77702
aaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcacccgtattagctagtgatgattgggtggagagatgagcc

SEQ ID NO: 77703 - DNA, 690 bp, Triticum aestivum
  unsure (1)..(690): unsure at all n locations
  Clone ID: PAT_TA_77703
actgttctttcnagatgtctcagacaaacaaaaataacttccaaactggagccaaacagccacagtatgcttgaacactactcaaggatgaggaatagatatggttcaacaatgctaaacttagttcatccgctgcgcagcctcctttgcgataagcctttccctggccttggtcttcgcttgcgacttggagcccatgacaccaccaccccacttcttcctaacctcgtcgaatttgtcgttgaagttcgccttaatagcctcaaggatcttgctgaactcaagcttatcctcattcttcactgtggtcaggcacagaacagaagcagtcttcttgtgaacaatcgatccaaggcgagattttcccttgacaatgcagtaagggacctccattttcctgcaaagagcagggagccacacaaccagctcaatcggatcaacatcatgagctatgacaaccagctgggctttactctgctcgattaggtaggtaacatggttaaggccatacttcacaactattggctttttggcctcaacagttttcccttcagcttcagcctgggccctctttagaagcctctccttcttggcaactttgtcttcaggccggtacttaagaagcatcttgaacaagtttgttgcaaggttcttgtcgagggtgcgggtgaactggtgggagtgccgggg

SEQ ID NO: 77704 - DNA, 653 bp, Triticum aestivum
  Clone ID: PAT_TA_77704
tgtattaaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagcc

SEQ ID NO: 77705 - DNA, 608 bp, Triticum aestivum
  unsure (1)..(608): unsure at all n locations
  Clone ID: PAT_TA_77705
agctgtatgttaaagtcntaaanctgggagtgccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcancaccaaggcgacngccatgagcattacctgagcgcgggccatgatcacttcttggtctgtagc

SEQ ID NO: 77706 - DNA, 617 bp, Triticum aestivum
  unsure (1)..(617): unsure at all n locations
  Clone ID: PAT_TA_77706
aaagtcctaaanctgggagtgcccatggtacaaactctcaactctcagatacacagatactgatctcctccagaggagtaccagcaagccagcaggagagagttcttattcattttcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagc

SEQ ID NO: 77707 - DNA, 608 bp, Triticum aestivum
  Clone ID: PAT_TA_77707
cactgggagtgcccatggtacaaactctcaactctcagatacacagatactgatctcctccagaggagtaccagcaagccagcaggagagagttcttattcattttcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagc

SEQ ID NO: 77708 - DNA, 660 bp, Triticum aestivum; identical to SEQ ID NO: 69788
  unsure (1)..(660): unsure at all n locations
  Clone ID: PAT_TA_77708

SEQ ID NO: 77709 - DNA, 637 bp, Triticum aestivum; identical to SEQ ID NO: 69787
  Clone ID: PAT_TA_77709

SEQ ID NO: 77710 - DNA, 541 bp, Triticum aestivum
  Clone ID: PAT_TA_77710
agaaagttttaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttccc

SEQ ID NO: 77711 - DNA, 634 bp, Triticum aestivum
  Clone ID: PAT_TA_77711
cgagttgtatgtattaaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagc

SEQ ID NO: 77712 - DNA, 660 bp, Triticum aestivum
  Clone ID: PAT_TA_77712
cgagttgtatgtattaaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagc

SEQ ID NO: 77713 - DNA, 659 bp, Triticum aestivum
  Clone ID: PAT_TA_77713
cgagttgtatgtattaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagc

SEQ ID NO: 77714 - DNA, 634 bp, Triticum aestivum
  Clone ID: PAT_TA_77714
actgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagc

SEQ ID NO: 77715 - DNA, 660 bp, Triticum aestivum; identical to SEQ ID NO: 69844
  unsure (1)..(660): unsure at all n locations
  Clone ID: PAT_TA_77715

SEQ ID NO: 77716 - DNA, 286 bp, Triticum aestivum
  unsure (1)..(286): unsure at all n locations
  Clone ID: PAT_TA_77716
cccgcccatgcatgcatcgatcgagtatgcagcagctggctggctagtgatgacacggacatacatacgacatacgtacgtagaaaggggcacacacattcaagtaggtacacagacgtatggttccatgggctagctagctgacgtacggcgaaggccagctagccgtagcacatatgatcagcactgcctgatgcacttgcaccggcggaagggcccgtcgnagttgtcgccgccccagccttcttgctggcagacttgngcgcagtncttattggacatgcac

SEQ ID NO: 77717 - DNA, 626 bp, Triticum aestivum
  unsure (1)..(626): unsure at all n locations
  Clone ID: PAT_TA_77717
tccataaacactgggnagtgcccatggtacaaactctcaactctcaggtacacagnatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagngcacccgtattcctcgtgccga

SEQ ID NO: 77718 - DNA, 586 bp, Triticum aestivum
  unsure (1)..(586): unsure at all n locations
  Clone ID: PAT_TA_77718
agttaccggacacaacattggggnagtcgactgacaaccataggagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagagcacgccgttctccagctccctgtacgggaacgaatccgacagaagctcgtcgccggaaagcttgtcc

SEQ ID NO: 77719 - DNA, 188 bp, Triticum aestivum
  unsure (1)..(188): unsure at all n locations
  Clone ID: PAT_TA_77719
agatctgaccgacggccgctccgcccgggctcgcgccccgggttttgcagcggccgccgcgccctcctactaatnggggcatggcgctcgcccagatggccgggtgtgggtcgcgcgcttcagcgccatccattttcggggctagttgattcggcaggngagttgttacacactccttagcggatttc

SEQ ID NO: 77720 - DNA, 126 bp, Triticum aestivum
  unsure (1)..(126): unsure at all n locations
  Clone ID: PAT_TA_77720
gacgacgcttactcgatacnttaccggttgcgactgtaagacagacagacagacaccgggaggaaacagcagtacattacagagtgctagccaaaatgcgaaagccacaataccgttcccgttccc

SEQ ID NO: 77721 - DNA, 654 bp, Triticum aestivum
  Clone ID: PAT_TA_77721
acgagttgtatgtattaaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcactccttggtctgtagctaacagtgcaccgtattagctagtgatgattgggtggaga

SEQ ID NO: 77722 - DNA, 636 bp, Triticum aestivum
  Clone ID: PAT_TA_77722
aaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgc

SEQ ID NO: 77723 - DNA, 659 bp, Triticum aestivum
  unsure (1)..(659): unsure at all n locations
  Clone ID: PAT_TA_77723
cgagttgtatgtattaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagc

SEQ ID NO: 77724 - DNA, 616 bp, Triticum aestivum
  Clone ID: PAT_TA_77724
cactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatc

SEQ ID NO: 77725 - DNA, 637 bp, Triticum aestivum
  unsure (1)..(637): unsure at all n locations
  Clone ID: PAT_TA_77725
acactgggngtgcccatggtacaaactctcaactctcagnatacacagnatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagc

SEQ ID NO: 77726 - DNA, 657 bp, Triticum aestivum; identical to SEQ ID NO: 69827
  unsure (1)..(657): unsure at all n locations
  Clone ID: PAT_TA_77726

SEQ ID NO: 77727 - DNA, 600 bp, Triticum aestivum
  unsure (1)..(600): unsure at all n locations
  Clone ID: PAT_TA_77727
ctgggagtgccntggtnaaactctaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccgtattc

SEQ ID NO: 77728 - DNA, 634 bp, Triticum aestivum; identical to SEQ ID NO: 69798
  Clone ID: PAT_TA_77728

SEQ ID NO: 77729 - DNA, 113 bp, Triticum aestivum
  unsure (1)..(113): unsure at all n locations
  Clone ID: PAT_TA_77729
gcagctatgcaggcaaaaagtngncnaccttgatgtcctgagataacatcctatcacaccggtctgaaatacaactttcacaaaattttccttcagtagaaaaagcctagcac

SEQ ID NO: 77730 - DNA, 551 bp, Triticum aestivum
  unsure (1)..(551): unsure at all n locations
  Clone ID: PAT_TA_77730
gttgtatgtattaagtccataaacactgggnagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtancagcactgcccagacgggccggggccgncctgaacgtanctcangcagggtctcaccaagctgtcaacgtggcccgcagtcgatggccacggcagngcgcgggaccgncgngagcatganca

SEQ ID NO: 77731 - DNA, 638 bp, Triticum aestivum
  unsure (1)..(638): unsure at all n locations
  Clone ID: PAT_TA_77731
cgagttgtatgtattnaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagc

SEQ ID NO: 77732 - DNA, 635 bp, Triticum aestivum
  unsure (1)..(635): unsure at all n locations
  Clone ID: PAT_TA_77732
gagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcaccctcgtgccgaa

SEQ ID NO: 77733 - DNA, 640 bp, Triticum aestivum
  unsure (1)..(640): unsure at all n locations
  Clone ID: PAT_TA_77733
taaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagnc

SEQ ID NO: 77734 - DNA, 661 bp, Triticum aestivum
  unsure (1)..(661): unsure at all n locations
  Clone ID: PAT_TA_77734
cgagttgtatgtattaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagcc

SEQ ID NO: 77735 - DNA, 636 bp, Triticum aestivum; identical to SEQ ID NO: 69880
  Clone ID: PAT_TA_77735

SEQ ID NO: 77736 - DNA, 644 bp, Triticum aestivum
  Clone ID: PAT_TA_77736
gagctgtatgtataaaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgatt

SEQ ID NO: 77737 - DNA, 659 bp, Triticum aestivum
  unsure (1)..(659): unsure at all n locations
  Clone ID: PAT_TA_77737
cgagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgc

SEQ ID NO: 77738 - DNA, 628 bp, Triticum aestivum
  unsure (1)..(628): unsure at all n locations
  Clone ID: PAT_TA_77738
gagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtc

SEQ ID NO: 77739 - DNA, 658 bp, Triticum aestivum
  Clone ID: PAT_TA_77739
cgagttgtatgtattaaagtcctaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatc

SEQ ID NO: 77740 - DNA, 492 bp, Triticum aestivum
  unsure (1)..(492): unsure at all n locations
  Clone ID: PAT_TA_77740
cacaattatcaggaaagttttgcaagacactcagacatctgatagttaccgacacaacattggagagtcgactgacaaccatagagcnnagcaaaaatactgacgaccgcatagattctagcatacagtgcgattagcacttgacctctttcagcccatgtgcaaagtacaggaaagttggatcagcagctccctccttgtagtaggcgaacaccacgccgncatcatcatgcatgctctcgccaacaaagaactgaaggtccttgagcttgctaagaagatactttgtggcagactcaacattcttcttgaaaacatctangtcatccccttcaagcttggcagagaggttcttgatgtatcgcttcatgtgagagataaactgcttcttgncaaaagcaggttgctcctgaagacggaaggtgtcaacaatgtcaaccaccttcacggcctggtcatcgacaccctcatcatcaccaccaccctcagcag

SEQ ID NO: 77741 - DNA, 556 bp, Triticum aestivum
  unsure (1)..(556): unsure at all n locations
  Clone ID: PAT_TA_77741
gagctgtatgtataaaagtcctaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcangcagggtctcaccaagctgtcaacgtggccgcagtcgatggccacggcagcgcgcgggaccgccgcgagcatcagcaccaag

SEQ ID NO: 77742 - DNA, 658 bp, Triticum aestivum
  unsure (1)..(658): unsure at all n locations
  Clone ID: PAT_TA_77742
gagttgtatgtattaaagtcntaaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgc

SEQ ID NO: 77743 - DNA, 612 bp, Triticum aestivum
  Clone ID: PAT_TA_77743
aactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagc

SEQ ID NO: 77744 - DNA, 608 bp, Triticum aestivum
  unsure (1)..(608): unsure at all n locations
  Clone ID: PAT_TA_77744
cactgggagtgcccatggtacaaactctcaactctcagntacacagatactgatctcctccagaggagtaccagcaagccagctggagagagttcttattcatattcagtataaactcgcataactagtgcccatactacatagggatagaggctgcgcgcttcaactccacgtggatggatgagctgagcaccagcttgacggatcgtcgctcattacacactgntgcagtcgatgtngagactgatgnggtatgggaggttgacaccgcacttgggggcgangctgcgggcgttgtcctcgttgagattgtggatgccacgagcgatccccttgaggcagttgcaagcgntttggcgatcgctcttggattgcgcctggttatggaggctctngacgccgtcgcagcactgcccagacgggctggggccgccctgaacgtagctcaggcagggtctcaccaagctgtcaacgtggcccgcagtcgatggccacggcagcgcgcgggaccgccgcgagcatnagcaccaaggcgacggccatgagcattacctgagcgcgggccatgatcacttcttggtctgtagctaacagtgcaccgtattagc

SEQ ID NO: 77745 - DNA, 661 bp, Triticum aestivum
  unsure (1)..(661): unsure at all n locations
  Clone ID: PAT_TA_77745
cgagttgtatgtattaaagtcntaaacnctgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggcccgcagtcgatggccacggcagcgcgcgggaccgccgcgagcatgagcaccaaggcgacggccatgagcattacctgagcgcgggccatgatcacttcttggtctgtagctaacagtgcaccgtattagctagtgatgattgggtggagagatgagc

SEQ ID NO: 77746 - DNA, 594 bp, Triticum aestivum
  unsure (1)..(594): unsure at all n locations
  Clone ID: PAT_TA_77746
cacagnatactgatctcctccagnngnagtaccagcaagccagcaggnagnagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatg

SEQ ID NO: 77747 - DNA, 608 bp, Triticum aestivum
  unsure (1)..(608): unsure at all n locations
  Clone ID: PAT_TA_77747
aaacactgggngtgcccatggtacaaactctcaactctcagnatacacagnatactgatctcctccagnggnagtaccagcaagccagcaggnagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgc

SEQ ID NO: 77748 - DNA, 594 bp, Triticum aestivum
  unsure (1)..(594): unsure at all n locations
  Clone ID: PAT_TA_77748
tgcccaggtacaaactctncaactctcaggtacacagnatactgatctcctccagnggnagtaccagcaagccagctggnagnagagttcttattcatattcagtataaactcgcataactagtgaccatactacatagggatagaggctgcgcgcttcaactccacgtggatggatgagctgagcaccagcttgacggatcgtcgcccattacaccctgctgcagtcgatgttgagactgatggtgtatgggaggttgacaccgcacttgggggggatgctgcgggcgttgtcctcgttgagattgtggatgccacgagcgatccccttgaggcagttgcaagcgctttggcgatcgctctgggatcgcgcctggttatggaggttcttgacgccgtcgcagcactgcccagacgggccggggccgccctgaacgtagctcaggcagggtctcaccaagctgtcaacgtggccgcagtcgatggccacggcagcgcgcgggaccgccgcgagcatgagcaccaaggcgacggccatgagcattacctgagcgcgggccatgatcacttcttggtctgtagctaacagtgcacc

SEQ ID NO: 77749 - DNA, 608 bp, Triticum aestivum
  Clone ID: PAT_TA_77749
aactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggcccgcagtcgatggccacggcagcgcgcgggaccgccgcgagcatcagcaccaaggcgacggccatgagcattacctgagcgcgggccatgatcacttcttggtctgtagctaacagtgcaccgtattagctagtgatgattgggtggagagatgagcac

SEQ ID NO: 77750 - DNA, 637 bp, Triticum aestivum
  unsure (1)..(637): unsure at all n locations
  Clone ID: PAT_TA_77750
cactgggnagtgcccatggtacaaactctcaactctcagatacacagnatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgatcacttcttggtctgtagctaacagtgcaccgtattagctagtaatgattgggtggagagatgagcc

SEQ ID NO: 77751 - DNA, 659 bp, Triticum aestivum; identical to SEQ ID NO: 69823
  unsure (1)..(659): unsure at all n locations
  Clone ID: PAT_TA_77751

SEQ ID NO: 77752 - DNA, 590 bp, Triticum aestivum
  unsure (1)..(590): unsure at all n locations
  Clone ID: PAT_TA_77752
ctgtatgtataaaagtcntaaacactgggagtgcccatggtacaaactctcaactctcagatacacagatactgatctcctccagaggagtaccagcaagccagcaggagagagttcttattcatattcagtataaactcgcataactagtgcccatactacatagggatagaggctgcgcgcttcaactccacgtggatggatgagctgagcaccagcttgacggatcgtcgctcattacacactgttgcagtcgatgtcgagactgatgtggtatgggaggttgacaccgcacttgggggcgaggctgcgggcgttgtcctcgttgagattgtggatgccacgagcgatccccttgaggcagttgcaagcggcttggcgatcgctcttggattgcgcctggttatggaggctctggacgccgccgcagcactgcccagacgggctggggccgccctgaacgtagctcaggcagggtctcaccaagctgtcaacgtggccgcagtcgatggccacggcagcgcgcgggaccgccgcgagcatcagcaccaaggcgacggccatgagcattacctgagcgcgggccatgc

SEQ ID NO: 77753 - DNA, 642 bp, Triticum aestivum
  unsure (1)..(642): unsure at all n locations
  Clone ID: PAT_TA_77753
cnttacaagcaatcccacaattatagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagagcacgccgttctccagctccctgtacgggaacgaatccgacagaagctcgtcgccggaaagcttgtcctggtc

SEQ ID NO: 77754 - DNA, 690 bp, Triticum aestivum
  Clone ID: PAT_TA_77754
ccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaagtcgtcatcgccgactgcggccagctctagatccgtccgcccgccggtcgcctgtcgtcgtcgccccgtgtcccgtgtcgtcgatctaaataagagagtcgtgtgtcgtgtcgtgtcttccccttgtccgtccgatgagatctccgtggttggt

SEQ ID NO: 77755 - DNA, 662 bp, Triticum aestivum
  Clone ID: PAT_TA_77755
tgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaattaatggcaaaaagtgtgatactggctggcgacgtaagttgttctaaatataatgaagatcctgtgttgtctgtggaaaaaataacgaaggattgggaaggtgggccacttttttctttggatgggaactttatcggcatgaacctttttctggttatggaaagagctttttttctaccatggggtgtaatggtcta

SEQ ID NO: 77756 - DNA, 588 bp, Triticum aestivum
  unsure (1)..(588): unsure at all n locations
  Clone ID: PAT_TA_77756
gcttcacccactctcaaaccctctcgccggnancccccagcaaggnagcaagcaagcaagatggacggcagcaaggcgaagaaggtggcggcgaagaagttcggcgggccgaggaagaagtcggtgaccaagtccatcaaggctgggctccagttccccgtcggccgcatcgggcgctacctcaagaagggccgctacgcccagcgcgtcggctccggcgcccccgtctacctcgccgccgtcctcgagtacctcgcagccgaggtgctggagctggccgggaacgccgccaaggacaacaagaagacccggatcgtgcccaggcacctgctgctggccatccgcaacgaccaggagcctcgggaggctgctgagcggcgtcaccatcgcccacggcggcgtcatccccaacatcaacccggtgctgctccccaagaaggccgctgagaaggctgagaaggccggcgccgcccccaagtcgcccaagaagaccaccaagtcccccaagaaggccaccaaggcctagatccggccgtgccggtgaactgatggtgctccggcagccctcgtgtgcctagtgtctctgtg

SEQ ID NO: 77757 - DNA, 622 bp, Triticum aestivum
  Clone ID: PAT_TA_77757
gaagaagccggcggcgaagaagcccgcggaggaggagccggtgacggagaaggccgccgagaaggccccggcggcgaagaagcccaaggccgagaagcggctgccggcgggcaagacggcgtccaaggaggccggcggcgaggcgaagacgaggggccggaagaagggcagcaaggcgaagaagggcgtggagacgtacaagatctacatcttcaaggtgctgaagcaggtgcaccccgacatcggcatctcttccaaggccatgtccatcatgaactccttcatcaacgacatcttcgagaagctcgccgccgaggccgccaagctcgcccgctacaacaagaagcccaccatcacctcccgggagatccagacctccgtccgcctcgtcctccccggggagctcgccaagcacgccgtctccgagggcaccaaggccgtcaccaagttcacctcctcctagattgcatctgcattgcttgtatctatctatctatctagtagcgactgtagctggttctgttgctttagttggtgcttgccgactctggttatctggaactctcaagtgctcttattgctggatggggaattgattgatggatgactgccaaaaaaaaaa

SEQ ID NO: 77758 - DNA, 700 bp, Triticum aestivum
  unsure (1)..(700): unsure at all n locations
  Clone ID: PAT_TA_77758
gggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatgaggaagctnca

SEQ ID NO: 77759 - DNA, 586 bp, Triticum aestivum
  unsure (1)..(586): unsure at all n locations
  Clone ID: PAT_TA_77759
tatgcttgtctcaaagnattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatttaagt

SEQ ID NO: 77760 - DNA, 545 bp, Triticum aestivum
  Clone ID: PAT_TA_77760
attaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattc

SEQ ID NO: 77761 - DNA, 578 bp, Triticum aestivum
  Clone ID: PAT_TA_77761
gcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatattt

SEQ ID NO: 77762 - DNA, 597 bp, Triticum aestivum
  Clone ID: PAT_TA_77762
gctccagcccccctcagcccacaccttccaaccaagctccaccgccgtcgaagcacccatggcgcccaaggccgcagagaagaagccggtggagaagaccccggcgggcaagaagcccaaggcggagaagaaggtgccggcgtccaaggagggcggaggcgagaagaaggggaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgcgcggtacaacaagaagcccaccatcacgtcgagggagatccagacctccgttcgcctcgtcctccccggcgagcttgccaagcacgccgtctctgagggcaccaaggccgtcaccaagttcacctcctcctaggcctcttccgatggcagcgttttgtgtgtagttagcagtgcgatggtacaatctctgtaggaattgtgctgcttgttggtctgaagaaatagtaatgtcgccgtctgaattattgctcaaaaaaaaaa

SEQ ID NO: 77763 - DNA, 644 bp, Triticum aestivum
  unsure (1)..(644): unsure at all n locations
  Clone ID: PAT_TA_77763
gctcgctgccgctgcgtctcgtctccaccaccccacttgcccccggnactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgtt

SEQ ID NO: 77764 - DNA, 631 bp, Triticum aestivum
  Clone ID: PAT_TA_77764
agcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcataaggagcctatccat

SEQ ID NO: 77765 - DNA, 642 bp, Triticum aestivum
  unsure (1)..(642): unsure at all n locations
  Clone ID: PAT_TA_77765
gcctcccccanactcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactctcc

SEQ ID NO: 77766 - DNA, 421 bp, Triticum aestivum
  Clone ID: PAT_TA_77766
tcggcacgaggctcctctgcccacaaaaccctagccgtcgtctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtggcctctgcgccatcgcccaggctgagtcactccgctacaagctcctcg

SEQ ID NO: 77767 - DNA, 551 bp, Triticum aestivum
  Clone ID: PAT_TA_77767
tcggcacgaggggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacact

SEQ ID NO: 77768 - DNA, 455 bp, Triticum aestivum
  unsure (1)..(455): unsure at all n locations
  Clone ID: PAT_TA_77768
cgaggnccgtccgtccccacacacacacgcacgcgtttgacattttccgcccaccaccgccggagggagctccagccatggccgccaagtgctacccgacggtcagcgacgagtacctggccgccgtcgccaaggccaagcgcaagctccgcggcttcatcgccgagaagaactgcgcgccccttatgctccgcctcgcgtggcactcggccgggaccttcgacgtggccaccaagaccggngggcccttcggcaccatgaagtgccccgcggagctcgcgcacggcgccaacgccggcctcgacatcgccgtcaggctgctcgagcccatcaaggagcagttccccatcctctcctacgccgacttctaccagctcgctggagtcgtcgccgtcgaggtcaccggcgggcccgaggttcccttccacccggggagacaggacaagcccgagcct

SEQ ID NO: 77769 - DNA, 438 bp, Triticum aestivum
  unsure (1)..(438): unsure at all n locations
  Clone ID: PAT_TA_77769
ggcaatgattcccagnaggcaggcaaccaaggnatgctggtgttattgctggtcttaatgtgatgcgtatcatcaacgagccaacagcagctgcaattgcctatggtcttgacaagaaggctaccagtgtcggtgagaagaacgtgcttatctttgacctcggtggtggcacttttgatgtctctctccttaccattgaggagggtatttttgaggtcaaggccacagctggtgacactcaccttggtggggaggactttgacaaccgtatggtgaaccactttgtccaagagttcaagaggaagcacaagaaggatatcagtggaaaccccaggtctttgaggaggctcaggacttcatgtgagagggcgaagaggaccctttcttncactgcccaaaccaccatcgagattgattcactcttcgagggagttgatt

SEQ ID NO: 77770 - DNA, 356 bp, Triticum aestivum
  Clone ID: PAT_TA_77770
tcggcacgagggcgtcccctccctctcctgtcgcgtgcgctcggccagcaaaaagcttccacataaaggccaacaagagaaaccataatctgttgggtgccagtcaaacctcaacaacaaagtttcatgtctgatctcgacgttactctgccatctgccttcgatccttttgctgaggcaaatgctgaggatgctggtgcaggcccgggcgcaaaagattatgtgcatgtgcgcatccagcagcgcaacggcaggaagagtctgaccactgtccagggcctgaagaaggagttcagctacaacaagatcctcaaggatctcaagaaggaattctgctgcaatggcacagtagtcca

SEQ ID NO: 77771 - DNA, 323 bp, Triticum aestivum
  Clone ID: PAT_TA_77771
tcggcacgaggatccgttggcttctgttcatccattccccctcccggcgccgcctccagcctagggtttcctcccgccgcccgtccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcagggcatggctttcggtactggaagtgccatggcgcacagggctgttgatgctgtgatgggtccc

SEQ ID NO: 77772 - DNA, 589 bp, Triticum aestivum
  Clone ID: PAT_TA_77772
tgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcataaggagcctatccatc

SEQ ID NO: 77773 - DNA, 642 bp, Triticum aestivum
  unsure (1)..(642): unsure at all n locations
  Clone ID: PAT_TA_77773
tcggcacgaggctctcctttccccaacccaaaccggnagcgccctccctccctccccacccagggaaacccaccagccatgaagggggccaaatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcggacaaaggcgggagcggctgctgcgcgagaaccgacgtgagc

SEQ ID NO: 77774 - DNA, 564 bp, Triticum aestivum
  Clone ID: PAT_TA_77774
gccggcgtcttcgtactcgcctctctctcgcgcttccgagctttggcctccgtcctcccctcctcccccgatctctccaccagcgcagcgtagcgccggcttccgccgctccgacccgccgccatgagggagtgcatctcgatccacatcggccaggccggtatccaggtcgggaacgcgtgctgggagctctactgcctcgagcatggcattcagcctgatggacagatgcccggtgacaagaccgttgggggaggtgatgatgctttcaacaccttcttcagtgagactggtgctgggaagcatgtcccccgcgcggtctttgttgatcttgagcccactgtgattgatgaggtgaggactggcacttaccgccagctcttccaccctgagcagcttatcagtggcaaggaggatgcagccaacaactttgcccgtggtcactacaccattggcaaggagattgttgacctatgccttgaccgtatcaggaagcttgcagacaactgcactggtctccaggggttccttgtcttcaacgctgttggaggtggaactggctct

SEQ ID NO: 77775 - DNA, 567 bp, Triticum aestivum
  Clone ID: PAT_TA_77775
gcgacattgagaagatggtccaggacgcagagaagtacaagtctgaggacgaggagcacaagaagaaggttgacgccaagaactccctggagaactacgcctacaacatgaggaacaccatccaggacgagaagatcgcctccaagctgcccgctgacgacaagaagaagatcgaggacgctgtcgacgctgcgatccagtggcttgacgccaaccagcttggtgaggttgacgagttcgaggacaagatgaaggagctggagggcctctgcaaccccatcatcgccaagatgtaccagggcgctggtgctgacatgccgggaggcatggacgaggacgcgccggctgccagcggcggtgctggccccaagatcgaggaggtcgactaagttagtcgctttcatatacgccatttgattcagtcctgggtgccaatcatatcacctgggctggaagttttgttgtacttttggtctgtagcatcagtgtcgtaaacaatgcaatgatgcatgttttggctcattgttgatttcagcttaatgcttattgtttgtactaaaaaaaaaa

SEQ ID NO: 77776 - DNA, 535 bp, Triticum aestivum; identical to SEQ ID NO: 67692
  Clone ID: PAT_TA_77776

SEQ ID NO: 77777 - DNA, 564 bp, Triticum aestivum
  unsure (1)..(564): unsure at all n locations
  Clone ID: PAT_TA_77777
ggtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaatt

SEQ ID NO: 77778 - DNA, 325 bp, Triticum aestivum
  unsure (1)..(325): unsure at all n locations
  Clone ID: PAT_TA_77778
ttcggcacgaggcacgcacgaancccctccgccgccgtcctcgcgtcttctcctgcgcatctcggaggtgcttcctagtttccacgatgaagctgatcgcagcctaccttctcgcctatctgggcgggaactcttccccaagtgccgctgacgtcaagaacatccttgactcagttggtgctgaggctgatgaagaaaagcttgagttccttcttgctgaactcaaaggcaaggacatcacagaagtgattgcatctggaagggnagaagtttgccgctgtgccttcaggtgggggtgccattgctgtgggagctccagctgctg

SEQ ID NO: 77779 - DNA, 562 bp, Triticum aestivum
  Clone ID: PAT_TA_77779
tatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattcc

SEQ ID NO: 77780 - DNA, 622 bp, Triticum aestivum
  unsure (1)..(622): unsure at all n locations
  Clone ID: PAT_TA_77780
gcgacgctcaagncccccagnacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagttc

SEQ ID NO: 77781 - DNA, 588 bp, Triticum aestivum
  unsure (1)..(588): unsure at all n locations
  Clone ID: PAT_TA_77781
gccgganccccagcaacccgccagcaagcaagnatggacggcagcaaggcgaagaaggtggcggcgaagaagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgccgtcctcgagtacctcgcagcagaggtgctggagctggccgggaacgccgccaaggacaacaagaagagccgcatcgtgcccaggcacctgctgctggccatccgcaacgaccaggagctcgggaggctgctgtccggcgtcaccatcgcccacggcggcgtcatccccaacatcaacccggtgctgctccccaagaaggccgccgagaaggctgagaaggccgagaagaccgccaccaagtcgcccaagaaggccaccaagtcccccaagaaggccaccaaggcgtagatctggctccgagcgcccgtgccggtgaactggactgatggtgctccgtcagccctcgtgtgcctagtgtctctgtgttaagttagc

SEQ ID NO: 77782 - DNA, 537 bp, Triticum aestivum; identical to SEQ ID NO: 68288
  Clone ID: PAT_TA_77782

SEQ ID NO: 77783 - DNA, 548 bp, Triticum aestivum
  Clone ID: PAT_TA_77783
gcctcccccctccacctcctccccagcgtcgcctcccgttcggaaccccaagctcccccgccgccggcgaaatggccccgaagcgaggcggcaaggccccggtgccggcgaagaagaaggcggcggacaaggtggtgaacccgctgttcgagaagaggccgaagcagttcggcatcggcggggcgctgccgcccaagaaggacctccaccggttcgtcaagtggcccaaggtcgtccgcattcagcgccagcgccgcatcctcaagcagcgcctcaaggtgcccccggcgctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcatcgagcagagcaaggctcagctggtcgtcatcgctcatgatgttgacccaattgagctg

SEQ ID NO: 77784 - DNA, 669 bp, Triticum aestivum
  Clone ID: PAT_TA_77784
ggtcgtgcgtgtgaggcagccccgctaaacctcgcaacagcccccgtgggcgaccaacccagcccagccgcccccctcaccaaccccggagtcggaagcagagccgcgatggccggcaccgtgcccaagctcgccgccaggagccccttcattgcgatggcttccgccaaggaagggaacggcgccgtgacgaagaggaccacgctccatgacctctacgagcaacagggtcagtccccgtggtacgacaacctctgccggcctgtcaccgatttgctgccctacatcgccaacggtgtccgtggagtcaccagcaacccaacgattttccagaaagccatctcttcatcaaacgcgtatgacggtcagttcaaggagcttatatcagctgggaaggatgcggagagcgcttactgggaactcgtcataaaggatatccaagacgcgtgcaaactgtttgagcccatctatgacgagaccgatggagctgatggttacgtttcagtggaggtgtctcctaggttggcaaatgacacccaaggaaccgttgaagctgcgaagtggttacacaaagtggtcaaccgccccaatgtgtatatcaagatcccagctactgcagaatgcgttccttctatcaaggaagtcattgctaatggcatcagcgtcaat

SEQ ID NO: 77785 - DNA, 667 bp, Triticum aestivum
  unsure (1)..(667): unsure at all n locations
  Clone ID: PAT_TA_77785
ttcggcacgaggcgctactcccctgcctcccccagnnnctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactctc

SEQ ID NO: 77786 - DNA, 622 bp, Triticum aestivum
  Clone ID: PAT_TA_77786
tgaggaattcggcacgaggcgctcctcctccccgtccgtccccacacacacacgcacgcgtttgacattttccgcccaccaccgccggagggagctccagccatggccgccaagtgctacccgacggtcagcgacgagtacctggccgccgtcgccaaggccaagcgcaagctccgcggcttcatcgccgagaagaactgcgcgccccttatgctccgcctcgcgtggcactcggccgggaccttcgacgtggccaccaagaccggcgggcccttcggcaccatgaagtgccccgcggagctcgcgcacggcgccaacgccggcctcgacatcgccgtcaggctgctcgagcccatcaaggagcagttccccatcctctcctacgccgacttctaccagctcgctggagtcgtcgccgtcgaggtcaccggcgggcccgaggttcccttccacccggggagacaggacaagcccgagcctcctccagaaggccgtcttcctgatgctacccaaggctctgaccacctcaggcaggtgttttccactcagatgggtttgagtgaccaggacattgttgctctttctggtggtcacaccctgggaagatgccacaaggagagat

SEQ ID NO: 77787 - DNA, 619 bp, Triticum aestivum
  Clone ID: PAT_TA_77787
gccaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgct

SEQ ID NO: 77788 - DNA, 666 bp, Triticum aestivum
  unsure (1)..(666): unsure at all n locations
  Clone ID: PAT_TA_77788
ctgcggcggcgcgcgcataggnaggcgaagcagcagcggnagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcatttcgtctcgccctggacagtgtggcagagctgatgggtacat

SEQ ID NO: 77789 - DNA, 334 bp, Triticum aestivum
  unsure (1)..(334): unsure at all n locations
  Clone ID: PAT_TA_77789
aatgtgtacatggccaagcttgccgagcaggctgagcgttacgaagcaaatggntgagttcatggcagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacnaggcctatgntgcttcaatcaaggngtaccgtaccaggattgaaactgagctcagcangatctgtgatggcatcctcaagcttctggactcccaccttgtcccctctgccactgcanc

SEQ ID NO: 77790 - DNA, 561 bp, Triticum aestivum; identical to SEQ ID NO: 68565
  Clone ID: PAT_TA_77790

SEQ ID NO: 77791 - DNA, 844 bp, Triticum aestivum
  unsure (1)..(844): unsure at all n locations
  Clone ID: PAT_TA_77791
caggcaattcggcacgagggtccccctccgatctcaccgagaaatcgacgcgaaggctctctgcccgtcctcaagatgcagatctttgtgaagaccctcaccggcaagaccatcaccctcgaggtcgagtcgtcggacaccatcgacaatgtcaaggccaaaatccaggacaaggagggcatccctccggaccagcagcgtctcatcttcgctggcaagcagcttgaggatggccgcacccttgctgactacaacatccagaaggagtccaccctccacctggtgctcaggctccgtggtggcatgcagatttttgtgaagaccctcaccggcaagaccatcacccttgaggtcgagtcctcggacactatcgacaacgtcaaggctaagatccaggacaaggagggcatccctccggaccagcagcgtctcatcttcgctggcaagcagctcgaggatggccgcacccttgctgactacaacatccagaaggagtccaccctccacctggtgctcaggctccgtggtggcatgcanatttttgtgaagaccctcaccggcaagaccatcaccctggangttgagtcctcggacaccatcgacaacgtcaaggcgaanatccaggacaaggagggcatncccccggaccancagcgnntnatnttngctggnnannagnttgnggatggccngacccctggcggactatnacatccanaangagtncaccccttnaccnnggngctnangcttnaggggngggnangcanattnttggnnannancctnaccngcnanacnatnnnccttnangnnnannncctnngncacnatnnnnnnnnnn

SEQ ID NO: 77792 - DNA, 230 bp, Triticum aestivum
  Clone ID: PAT_TA_77792
tcccccgggctgaggaattcggacgagggggacctgaacgtgatcgggttcgggctgatcgggtggctggcgccgtcgagcatcccgctgatcaacggcaacagcttgacggggctcttcttctccagcatcggcgaggagctcgcccacttcccctcacccccggctctccagtcgcagttctggctgtggttggtgacgtggcacctgggtctgttcattcgcgctca

SEQ ID NO: 77793 - DNA, 509 bp, Triticum aestivum
  unsure (1)..(509): unsure at all n locations
  Clone ID: PAT_TA_77793
ttctcctccgctccccgccccgcctcgagcagctcaggaacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcanggttcgagagcctcacggacaagagcaagctcgatgcgcagcccgagctcttcatccacatcatccccgacaaggcgaccaacacgctcacgatcgtcgacagcggcattggcatgaccaagtcggacctcgtcaacaacctcgggaccatcgccaggtcggggaccaaggagttcatggaggccctcgccgccggcgccgacgtgtccatgattgggcagtttggtgtcggtttctactccgcctacctcgtcgccgagagggttgtcgtcaccaccaagcacaacgacgacgagcagtacgtgtgggagtccc

SEQ ID NO: 77794 - DNA, 654 bp, Triticum aestivum
  Clone ID: PAT_TA_77794
attcggcacgaggaagaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccctc

SEQ ID NO: 77795 - DNA, 633 bp, Triticum aestivum
  Clone ID: PAT_TA_77795
gccgagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactc

SEQ ID NO: 77796 - DNA, 485 bp, Triticum aestivum
  unsure (1)..(485): unsure at all n locations
  Clone ID: PAT_TA_77796
ccacctcctcccccagcgtcgcctcccgttcggaaccccaagctcccccgccgccggcgaaatggccccgaagcgaggcggcaaggccccggtgccggcgaagaagaaggcggcggacaaggtggtgaacccgctgttcgagaagaggccgaagcagttcggcatcggcggggcgctgccgcccaagaaggacctccaccggttcgtcaagtggnccaaggtcgtccgcattcagcgccagcgccgcatcctcaagcagcgcctcaaggtgcccccggcgctccaccagttcacccgcaccctcgacaagaacctcgccaccaacctgtttaagatgcttctcaagtaccgccctgaggacaaggtggctaanaaggagaggcttctgaagagggcccangctgaggctgaggggaaaaccgttgangccaanaagccaattgttgtgaagtatggtcttaaccatgtcacttacctcatngagc

SEQ ID NO: 77797 - DNA, 693 bp, Triticum aestivum
  Clone ID: PAT_TA_77797
tcccccgggctgaggaattcggacgaggccgccgcagctgaggaacaggaggcagtccgggatgcggcgatagcttggcgctccgctccacggcggaccggtgcttcggccaccactcaccgttgacgaacgttattcaatcaacatacagtgcaaacattggttcaagattgggaagtcttgcaagagctttcagtgcaaaaccacttggaaatgaggttattgggattgatttgggaacaacaaattcatgtgtttctgttatggagggaaagaatgcaaaagtgatagagaattcagaaggcactaggacgacaccatcagttgttgcctttagtcagaagggcgagcggcttgttggaactccagccaaacgtcaagcaattaccaatccacagaacaccttctttggtacaaagcgtatgatagggcgtcgctttgatgacccacagacgcagaaagagatgaaaatggttccatacaaaattgtgaaggctccaaatggtgacgcttgggttgaaacaacagacggcaagcagtactcaccgagccagattggtgcatttgtgttgaccaagatgaaggagaccgctgaatcttaccttggcaagtctatttcgaaggctgtgatcacagttccagcttacttcaacgatgcccagcggcaggcaaccaaggatgctggtcgaattg

SEQ ID NO: 77798 - DNA, 507 bp, Triticum aestivum
  Clone ID: PAT_TA_77798
ttggcaaggagattgttgatctctgccttgatcgtatcaggaagctttcagacaactgcactggtctgcagggattccttgtcttcaacgctgttggaggtggaactggctctggccttggttcgcttctcctggagcgtctctctgttgactatggaaagaagtccaagcttgggttcacagtttacccatctccccaggtctccacttctgttgttgagccatacaacagtgtcctgtccacccactcactccttgagcacaccgatgtctctatccttcttgacaatgaggccatctatgacatctgccgccgctcccttgacattgagcgcccaacatacaccaacctcaacaggcttgtttctcaggtcatttcatcattgactgcttccctgaggtttgatggtgctctgaatgttgatgtcaacgagttccagaccaacctggtgccctacccgaggatccacttcatgctttcctcctatgccccagtgatctcagccg

SEQ ID NO: 77799 - DNA, 530 bp, Triticum aestivum
  unsure (1)..(530): unsure at all n locations
  Clone ID: PAT_TA_77799
gcgacaaggagaaggagagattgatggcgcgtacgaagcagaccgcccggaagtccaccggcggcaaggcgccccgcaagcagctggccaccaaggcggcgaggaagtcggcgccgaccacgggcggcgtgaagaagccccaccgctacaggcccggcaccgtggcgctgcgcgagatccgcaagtaccagaagagcacggagctgctcatccgcaagctgccgttccagcgcctggtgcgggagatcgcgcaggacttcaagacggacctcaggttccagagccacgccgtgctggccctccaggaggccgccgaggcgtacctcgtcgggctctttgaggacaccaacctctgcgccatccacgccaagcgcgtcaccatcatgcccaaggacatccagctcgcccgccgcattcgcggggagcgcgcatagatcaagcgtctgcctactcgacttaggccttgtacaatgggaggtgtttagagagatgcttagaaaaataaatcgggtttttctggnnnaaaaaaa

SEQ ID NO: 77800 - DNA, 578 bp, Triticum aestivum
  unsure (1)..(578): unsure at all n locations
  Clone ID: PAT_TA_77800
ccgggctgaggaattcggacgaggcgaagagcagcgtccgatggcccccaaggcggagaagaagccggctgccgcggagaagactccggcggccgagaagacnaccgcgggcaagaagcccaaggccgagaagcggccgcccaagtccaaggagggcggcgccgacaagaagaagaagaaggccaagaagagcgtggagacgtacaagatctacatcttcaaggtgctgaagcaggtgcacccggacatcggtatctcctccaaggccatgtccatcatgaactccttcatcaacgacatcttcgagaagctcgccggcgagtccgccaagctcgcccgctacaacaagaagcccaccatcacctccagggagatccagacctccgtccgcctcgtcctcccgggcgagctcgccaagcacgccgtctctgagggcaccaaggccgtcaccaagttcacatcctcttagataggctgttctctgtcttcgtggttgatcgatggttctctgtaatgctcgttagctgttcggaccatgtcgctgtgtaacttgtgctggtgttgtggcaaaaaaaaaa

SEQ ID NO: 77801 - DNA, 574 bp, Triticum aestivum
  Clone ID: PAT_TA_77801
tcccccgggctgaggtcgtactcgcctctctccgcgcatcctagccttcgccctcctccttcccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagc

SEQ ID NO: 77802 - DNA, 206 bp, Triticum aestivum
  Clone ID: PAT_TA_77802
caaagctggagccagcatcaagaagattccgctgtaccagcacattgccaaccttgctggcaacaagcaattggttttgcctgttcctgcattcaatgtcatcaatggtggatcccatgctggaaacaagcttgctatgcaggagttcatgatccttcctactggagctgcctcattcaaggaggcaatgaagatgggcgttgaag

SEQ ID NO: 77803 - DNA, 654 bp, Triticum aestivum
  Clone ID: PAT_TA_77803
tcccccgggctgaggaattcggacgaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctcccca

SEQ ID NO: 77804 - DNA, 582 bp, Triticum aestivum
  Clone ID: PAT_TA_77804
cggtacctccaggctgactgtgctgttctatattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtgggcttcaa

SEQ ID NO: 77805 - DNA, 637 bp, Triticum aestivum
  Clone ID: PAT_TA_77805
gccgagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactctcca

SEQ ID NO: 77806 - DNA, 511 bp, Triticum aestivum
  Clone ID: PAT_TA_77806
gagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggcgagcacgtcgacgtcaaggtgaacggcgccgtccacaagggcatgccgcacaagttctaccacggccgcaccggccgcgtctgcaacgtcaccaagcgcgccatcggcgtcgagatcaacaagcaggtcggcaacaggatcatcaagaagaggatccatgtccgtgtggagcacgtgcagccatccaggtgcaacgaggagttcctccagaggaaactcaacaacgacaagctgaaggcggaggccaaggcgcgcggcgaggtcatcagcaccaagaggcagccagcagggcccaagccggggttcatggttgagggcaccaccatcgagacggtcacccccatcccgtatgacgtcgtcaacgatctcaag

SEQ ID NO: 77807 - DNA, 369 bp, Triticum aestivum
  Clone ID: PAT_TA_77807
cagcacaattcttacagagattgtaacatcgcactgctaactacacacaggaacaccgccatcaactcatgatacaagggatgaagcctaagaagaggtgaacttggtgacggccttggtgccctcggagacggcgtgcttggcgagctcgccggggaggacgaggcggacggaggtctggatctccctcgacgtgatggtgggcttcttgttgtagcgggccagcttggcggactcgccggcgagcttctcgaagatgtcgttgatgaaggagttcatgatggacatggccttggaggagatgccgatgtcggggtgcacctgcttgagcaccttgaagatgtagatcttgtacgtctccacgctctt

SEQ ID NO: 77808 - DNA, 518 bp, Triticum aestivum
  unsure (1)..(518): unsure at all n locations
  Clone ID: PAT_TA_77808
ctaggactcgaacagtttacagaaaatggtgttcagtatgtctgcaaacatgacatggacgcaacatctaagaaaatccaacgagtaacatgcagcagctcttcggcctaagctgtggcacccttgcccttcttcttctggagcttcctcatgtagaactccagctccttgccctccaggatgtacccatcagctctgccacactgtccagggcgagacgaaatgcaggccagcagccttccaccactgaactgctcctcaatgtgcgagtccagtgtacgtccctgctggcgcttctcaagcttcctctggacattgntgctcttctttgcttcctctgtggcagcagcagcaacctcagcctcttgtccctcagcagcttccttcttggcagctgcagcagctttcttcttcctaccgatttcaactccataatgagtcaggtaccacctgtttgaaaggggctgcatcaacttgcacaatggcattcttgacaagggtctgagtcctcacaagct

SEQ ID NO: 77809 - DNA, 574 bp, Triticum aestivum
  Clone ID: PAT_TA_77809
cccatccgcaataagagccttgagagttcagataaccgagtcggcaagcaccaactaaagcaacagaaccagctacagtcgctactagatagatagatagatacaagcaatgcagatgcaatctaggaggaggtgaacttggtgacggccttggtgccctcggagacggcgtgcttggcgagctccccggggaggacgaggcggacggaggtctggatctcccgggaggtgatggtgggcttcttgttgtagcgggcgagcttggcggcctcggcggcgagcttctcgaagatgtcgttgatgaaggagttcatgatggacatggccttggaagagatgccgatgtcggggtgcacctgcttcagcaccttgaagatgtagatcttgtacgtctccacgcccttcttcgccttgctgcccttcttccggcccctcgtcttcgcctcgccgccggcctccttggacgccgtcttgcccgccggcagccgcttctcggccttgggcttcttcgccgccggggccttctcggcggccttctccgtcaccggctcctcctccgcgggcttcttcgccg

SEQ ID NO: 77810 - DNA, 400 bp, Triticum aestivum
  unsure (1)..(400): unsure at all n locations
  Clone ID: PAT_TA_77810
gttggcgaacaaacaagngtctgcagcatcatcatttgatgttcattgtttcaacataaatccctgaacaagttctttgctgccagagtcgcccttccttaaccatagttcaggcggaacatgtcgttctgcacgtagaagctccctccagctggcagcaaatggaacatctgtgagaacttgagggggtgctcgccggggccggtggtgatggtgccggagacgaagacgaggacgccgccctggggccccgagggctggcagtcgacggtgtcgatcttgtgctggcactgctggaaggggagagatccatggcctctccctcgccgcgccgcctcctcgcctcgcctcgcctcgcctcgcctagggtttggagctctggatgcggaggctttgggcc

SEQ ID NO: 77811 - DNA, 728 bp, Triticum aestivum
  Clone ID: PAT_TA_77811
aggtgcataacaggttaaacatacaaggttcttacaacacaacaggttgtaaaacaaacaccacaaagcaaatgttcaaacagacagataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgcctgggacaacaccaggtggctggtagttgataccacacttgaagccagtggggcaccagtcaacaaactggatagtgcgcttggtcttgatggtggccacagcagcgttgacatccttgggcacaacatcaccacggtacatgaggcagcaggccatgtacttgccgtggcgggggtcacacttggccatcatggaggaaggctcaaaggcgctgttggtgatctcagcaacagacagctgctcatggtaggccttctcggctgagatcactggggcataggaggaaagcatgaagtggatcct

SEQ ID NO: 77812 - DNA, 647 bp, Triticum aestivum
  Clone ID: PAT_TA_77812
atagggtacacaatctatgtttaacatctgttacattacgatacagatcaaaatgtagccgtctcagcatcacgacagataagacgattcatagacagaattaatgcagctcccttaacaaacaagagaaagtagcaaaacatgaccaaaaatttagagcttgtcctcaaaatcggataggggagtcatctgttccttgagacccttcctcttgcggatctcggtgacaagcgtcgccgactgggtcccagggtccaaaggatcggaagccatgatgtcccagtggtcaaacacacactgggggaaagcctgaccggacgtcgcagccctgagggtgctcgagaacccgaaggactcaatgacaggcaggtaggccttgatgttgtagagcggggtaccttgcctctgcatctcctcgaacacgtgacctctcttctgattcagaacaccatagataccaccaagcgcattctccggggcctggatctcaaccaggtagacgggctccagcagccttggcttagcagtgagctgagaagcgtaaatgaccctcctagccgttgggatgacctgaccaccacccctgtgaatagcatcagtgtgcagaacaacatcacagacctcaaagcaaatgccacgcatgttct

SEQ ID NO: 77813 - DNA, 270 bp, Triticum aestivum
  Clone ID: PAT_TA_77813
tgaggtctcgaaatagcgcttaataaggtaaacatcccattacatctagcagcaaccacgagttcgcaaatcaacaaacatcaggcaaaacttaaaaacgatggttccaggaacataggtctatatccttgcagataactggctatagcaaaacgactcaacacctcagaatcaggccttggcagcagcctgggcagcggcatcccgcttcctctgctcctcaatgatggtgagcttgatacccttgcccttggggaggctcacccacgc

SEQ ID NO: 77814 - DNA, 719 bp, Triticum aestivum
  unsure (1)..(719): unsure at all n locations
  Clone ID: PAT_TA_77814
tgcttatttatnngtttgagacaacttctccccagaagtacgctcattgtggcagacgcagcaaaccacctagagctaatagtttattcggagtagcaatagcctggccagctgcttcacagtaaccaaacgacaaacttagtcagaacaaagtccacagacggaacagcgacagccaatcactcgcacagcaccgcgccctcctccagggaatcctcctccgcccgccatgcgaggaggttggcgagcttgccttccttgaccagagggtggctctgcacactctcggcctcgaagcagtggaagacggacctgggcgacccggcagagacagcaacctcttcgttcgcggcaaagctctggtagatgaggacgcccccgcaggggagctcctgctccacaacgttgttgcagtcgtatgcctcagagaagctcctgtggggagcaggctgtgcgccggggaagatgaacatcccacgagagtacttgacggcagcaagcggcatgcacagctcttcagcaagctcaagaatcctaggaatggtgagcaggagcatggtagtcccacaggtcttgatcacaatcttctgagaatagatgaacaggctggactcagatagcacatacgagtcgaagtccttgttggagagctcggacacaatggtgcaccgtgcaagatcaagaacagagtcaatctgggccctagagagggcgcgcag

SEQ ID NO: 77815 - DNA, 641 bp, Triticum aestivum
  unsure (1)..(641): unsure at all n locations
  Clone ID: PAT_TA_77815
atgcatattaacnaggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtactttgccgtggcgggggtcacacttggccatcatagatgaagg

SEQ ID NO: 77816 - DNA, 704 bp, Triticum aestivum
  Clone ID: PAT_TA_77816
atgcatattaaccaggtgcataacaggttcaaacatacaaggttcttacaacacaacaggttgtaaaacaaacaccacaaagcaaatgttcaaacagacagataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgcctgggacaacaccaggtggctggtagttgataccacacttgaagccagtggggcaccagtcaacaaactggatagtgcgcttggtcttgatggtggccacagcagcgttgacatccttgggcacaacatcaccacggtacatgaggcagcaggccatgtacttgccgtggcgggggtcacacttggccatcatggaggaaggctcaaaggcgcttgttggtgatctcagcaacagacagctgctcatggtaggccttctcggctga

SEQ ID NO: 77817 - DNA, 607 bp, Triticum aestivum
  Clone ID: PAT_TA_77817
caattatagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcgacaccctcatcatcaccaccaccctcagcagagggattggctccaatgtccacatcaactgctccttgaacgacccaatggccgtcgacttcccagagcacgccgttctccagctccctgtacgggaacgaatccgacagaagctcgtcgcc

SEQ ID NO: 77818 - DNA, 725 bp, Triticum aestivum
  Clone ID: PAT_TA_77818
ttaaccaggtgcataacaggttcaaacatacaaggttcttacaacacaacaggttgtaaaacaaacaccacaaagcaaatgttcaaacagacagataacagataaagccactcgggcagatcataggattgcagcagcatgccttgggaaagcaccaggaggcaggctctagtactcgtcgccctcgtcaccgtcctcaccctcgtcaaactcagcaccaacttcttcatagtccttctccagggcagcaagatcctcacgggcctcagagaactctccctcctccatgccctcacccacgtaccagtggacgaaggcgcgcttggcgtacatcaggtcaaacttgtggtcgatgcgggagaagacctcgacgacactggtggagttggagatcatgcacacagccctctggaccttggcaaggtcaccgcctgggacaacaccaggtggctggtagttgataccacacttgaagccagtggggcaccagtcaacaaactggatagtgcgcttggtcttgatggtggccacagcagcgttgacatccttgggcacaacatcaccacggtacatgaggcagcaggccatgtacttgccgtggcgggggtcacacttggccatcatggaggaaggctcaaaggcgctgttggtgatctcagcaacagacagctgctcatggtaggccttctcggctgagatcactggggcataggaggaaagcatga

SEQ ID NO: 77819 - DNA, 684 bp, Triticum aestivum
  Clone ID: PAT_TA_77819
aggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtactttgccgtggcgggggtcacacttggccatcatagatgaaggctcaaaggcgctgttggtgatctcagcaacagacagctgctcatggtaggccttct

SEQ ID NO: 77820 - DNA, 522 bp, Triticum aestivum
  Clone ID: PAT_TA_77820
gcttggtgtagataaccgtatagcatgcatattaaccaggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagt

SEQ ID NO: 77821 - DNA, 453 bp, Triticum aestivum
  Clone ID: PAT_TA_77821
acagatgcaacccaacgcacgcactagaatttagaaacccacaggaagacaggaacagcgggagcagagcagcggcagcggcaggtcaatcagccgccgaatccgtagagggtgcggccctgtcgcttgagcgcgtagacgacgtccatggcggtgacggtcttgcggcgggcgtgctcagtgtaggtgacggcgtcgcggatgacgttctcgaggaagatcttgagcacgccgcgggtctcctcgtagatgagccccgagatgcgcttcacgccgccacggcgagccagccgccggatggccggcttggtgatgccctggatgttgtcccgcagcaccttccggtggcgcttggcgccgcccttgcccagccccttcccgcccttgccgcggccggacatggtcaacggcttccttccttcctttgagctgcgagcgggcggattggctcgc

SEQ ID NO: 77822 - DNA, 487 bp, Triticum aestivum
  Clone ID: PAT_TA_77822
aaactggcagctagctcatacagaatgcgaccatccattcgtccgatgaagcctaggctgaggtgaacttggtgacggccttggtgccctcggagacggcgtgcttggcgagctcgccggggaggacgaggcggacggaggtctggatctcccgggaggtgatggtgggcttcttgttgtagcgggcgagcttggcggactcgccggcgagcttctcgaagatgtcgttgatgaaggagttcatgatggacatggccttggaggagatgccgatgtccgggtgcacctgcttgagcaccttgaagatgtagatcttgtacgtctccacgctcttcttggacttcttcttgcccttcttctcgccgccctccttggacgccggcggccgcttctctgccttgggcttcttccccgctggagccttctccgtggccaccggcttcttctccgccttgggtgccatggacgctgattcgagggtgtcgag

SEQ ID NO: 77823 - DNA, 256 bp, Triticum aestivum
  unsure (1)..(256): unsure at all n locations
  Clone ID: PAT_TA_77823
ccactagacggtatctagcctccgaagccgtagagggtgcggncctggcgcttgagcgcgtagacgacgtccatggcggtgacggtcttgcggcgggcgtgctcggtgtangtgacggcgttgnggatgacgttctcgaggaagatcttgaggacgccacgggtctcctcgtanatgaggccggagatgcgcttnacgccgcccctcctggccagcctncggatcgncggcttggtgataccctggatgttgtcgc

SEQ ID NO: 77824 - DNA, 575 bp, Triticum aestivum
  unsure (1)..(575): unsure at all n locations
  Clone ID: PAT_TA_77824
cgagggccgtagtntatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagcccgcggtaattc

SEQ ID NO: 77825 - DNA, 583 bp, Triticum aestivum
  Clone ID: PAT_TA_77825
gcatatgcttgtctcaaagattaagcctgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcggtaattccagctccaatagcgtatatt

SEQ ID NO: 77826 - DNA, 921 bp, Triticum aestivum
  unsure (1)..(921): unsure at all n locations
  Clone ID: PAT_TA_77826
gccgatccccaccgaanaatctccgacagnatcgaagccaaggctttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctcgaggatggtcgtacccttgctgactacaacatccagaaggagtccaccctccacctggtgctccgccttcgcggtggtatgcagatcttcgtgaagaccctgacgggcaagaccatcacgcttgaggtggagtcctcggacaccatcgacaacgtcaaggccaagatccaggacaaggagggcatccccccggaccagcagcgcctcatcttcgccggcaagcagcttgaggatggccgcactctggcagactacaacatccagaaggagtccaccctccacctggtgctccgccttcgcggtggtatgcagatcttcgtgaagaccctgacgggcaagaccatcacgntggaggtggagtcctcggacaccatcgacaacgtcaaggccaagatccaggacaaggagggcatccccccggaccagcagcgcctcatnttcgccggcaagcagctcgaggatggccgtacccttgctgactacaacatncagnaggagtccaccctccacctggtgctccgccttcgcggnggtatgcagatcttngtgaagaccctgacnggcaagaccatcacgcttgaagggggagtcctcgggacaccatcgacaacgtcaaggncaagattcaggacaagggngggcattccncccggaccagnagcggccttattntttgccggcaagcaactntgaggatgggccgnac

SEQ ID NO: 77827 - DNA, 656 bp, Triticum aestivum
  Clone ID: PAT_TA_77827
ggccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcagacactcattgaggctcatgtggatgtgaagacaactgacaactacatgcttcgcatgttcgccattggcttcaccaagagacgcccgaaccaggtgaagcgcacttgctatgcccaagcaagtcagatcagacagatccgccgcaagatggttgagatcatggtcaaccaagctgcaagctgtgacttgaaggagcttgtgaacaagttcatccctgaggtgatcggaaaggagattgagaaggctacctcaagcatcttccccct

SEQ ID NO: 77828 - DNA, 638 bp, Triticum aestivum
  Clone ID: PAT_TA_77828
gagcaaactcacacaacccaccaccgaagctcccaaccccacccgaagcggcagccatggcccccaaggcagacaagaagccggcggccgagaacaaggtggagaaggcggcggagaagacccccgcggggaagaagcccaaggccgagaagcggctgccggcgggcaagacggcgtccaaggaggccggcggcgaggggaagacccggggccggaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcccgctacaacaagaagcccaccatcacctccagggagatccagacctccgtccgcctcgtcctccccggggagctcgccaagcacgccgtctccgagggcaccaaggccgtcaccaagttcacatcctcctagactgacggcgtgcagttggtttctgcatctgcatctgtactcttgactctgcttatctatctatctgcaagtagtggtggtggtagtagtacctgtgctgggtgattgccaacgctttgt

SEQ ID NO: 77829 - DNA, 661 bp, Triticum aestivum
  unsure (1)..(661): unsure at all n locations
  Clone ID: PAT_TA_77829
ttcggcacgaggccgcccctcgctgccgctgcatctcgtctccaccaccccacttgcccccggnacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaagatatctgtt

SEQ ID NO: 77830 - DNA, 619 bp, Triticum aestivum
  unsure (1)..(619): unsure at all n locations
  Clone ID: PAT_TA_77830
aggaattcggacgaggctaacttcncccactctnaaaccctctcgccggagcccccagcaaggagcaagcaagcaagatggacggcagcaaggcgaagaaggtggcggcgaagaagttcggcgggccgaggaagaagtcggtgaccaagtccatcaaggctgggctccagttccccgtcggccgcatcgggcgctacctcaagaagggccgctacgcccagcgcgtcggctccggcgcccccgtctacctcgccgccgtcctcgagtacctcgcagccgaggtgctggagctggccgggaacgccgccaaggacaacaagaagacccggatcgtgcccaggcacctgctgctggccatccgcaacgaccaggagctcgggaggctgctgagcggcgtcaccatcgcccacggcggcgtcatccccaacatcaacccggtgctgctccccaagaaggccgctgagaaggctgagaaggccggcgccgcccccaagtcgcccaagaagaccaccaagtcccccaagaaggccaccaaggcctagatccggccgtgccggtgaactgatggtgctccggcagccctcgtgtgcctagtgtctctgtgttaagttagctatgg

SEQ ID NO: 77831 - DNA, 642 bp, Triticum aestivum
  unsure (1)..(642): unsure at all n locations
  Clone ID: PAT_TA_77831
gcaggagcgccctccctccctccccacccagggnaaacccaccagccatgaagggggccaaatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccgccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcggacaaaggcgggagcggctgctgcgcgagaaccgacgtgagctgtgtgcggtggtgtcataaggagcctgtcc

SEQ ID NO: 77832 - DNA, 178 bp, Triticum aestivum
  Clone ID: PAT_TA_77832
atgaagaaagggagaggcttttgaaggaacaggagacttagggagcagcagaggatccgtaaagaaatagaggaaaaagaggcgagggaagcagcaaaaatgatagaagatttaacaggaagggggaagaataagaaaaaaattcacattgagggggatatgacaaaacaacacgcca

SEQ ID NO: 77833 - DNA, 540 bp, Triticum aestivum
  Clone ID: PAT_TA_77833
tcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgc

SEQ ID NO: 77834 - DNA, 537 bp, Triticum aestivum
  Clone ID: PAT_TA_77834
gcagacaagaagccggccgcggagagcaaggtggagaaggcggcggagaaggcccccgcgggcaagaagcccaaggccgagaagcggcttccggcgtccaaggaggccgccggcggcgagggcaagacgaggggccggaagaagggcagcaaggcgaagaagggcgtggagacgtacaagatctacatcttcaaggtgctgaagcaggtgcacccggacatcggcatctcctccaaggccatgtccatcatgaactccttcatcaacgacatcttcgagaagctcgccggggagtcggccaagctcgcccgctacaacaagaagcccaccatcacgtccagggagatccagacctccgtccgcctcgtcctccccggcgagctcgccaagcacgccgtctccgagggcaccaaggccgtcaccaagttcacctcctcatagactgaagatgcgtccgtcgcctgtagttggtctctgtatctgcacctgtactgtcgactctgcttgtctctctgcaagtagtgctggtagtctgct

SEQ ID NO: 77835 - DNA, 555 bp, Triticum aestivum
  Clone ID: PAT_TA_77835
gcccccctcccctcctccccagcgtcgcctcccgttcggaaccccaagctcccccgccgccggcgaaatggccccgaagcgaggcggcaaggccccggtgccggcgaagaagaaggcggcggacaaggtggtgaacccgctgttcgagaagaggccgaagcagttcggcatcggcggggcgctgccgcccaagaaggacctccaccggttcgtcaagtggcccaaggtcgtccgcattcagcgccagcgccgcatcctcaagcagcgcctcaaggtgcccccggcgctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcatcgagcagagcaaggctcagctggtcgtcatcgctcatgatgttgacccaattgagctggttgtgtggct

SEQ ID NO: 77836 - DNA, 528 bp, Triticum aestivum
  Clone ID: PAT_TA_77836
cccatcgcctccgtttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcagaaccttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcgcaccatcaaggatgaaggctttggctcactgtggagaggaaacactgctaacgtcatccgttacttcccaactcaggctttgaactttgcattcaaggat

SEQ ID NO: 77837 - DNA, 622 bp, Triticum aestivum
  unsure (1)..(622): unsure at all n locations
  Clone ID: PAT_TA_77837
ccctccctccgtccgtcgcagctccagnatttccttccccatggctccgatcaagatcggcatcaatggtttcggccggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggttatcaatgacaggtttggcattgttgagggtttgatgaccacagttcatgccatgactgcaacccagaagactgttgatggtccttcc

SEQ ID NO: 77838 - DNA, 122 bp, Triticum aestivum
  Clone ID: PAT_TA_77838
ctattgctctctgaataaactattagctctaggtggtttgctgcgtctgccacaatgagcgtacttctggggaaaagctgtctcgaacttataaataagcattatttttcctaaaaaaaaaa

SEQ ID NO: 77839 - DNA, 623 bp, Triticum aestivum
  Clone ID: PAT_TA_77839
agtagatccgtacacatgcaatataattaactaagacaatgatgcgctcggcagatcaagacctaattaagctgctcgatcgctagtacctggaaggctggaactagtattgcataccgtccaagaaatcaccgtcttcgtcgtaatcgccatcgtcgtcgcattctcctgcgttgatgcacatcatctcgccgaggtcgtagtactccccaccagtcatcgaagccgacatgaggccgccgttctcgcgtctgtgctccatgagcaccgacgttccaccacccctcgccttcatcgctttctccgcatcggcttccccctttcccgacccggcagccagctccgtctccttgagccggcggccttcacgctccaccgatgatagcgacgacatgccatcttctcccgctctagcggcgttgagccgagaggactcggataggcggtcgatggctggcttggactgggtgagcagccagtccaccgtcttgctggccttgtcaaagccaagctggtcctgcagcgcgaagaagtcacgcgcgacgtcgagggagagccgcatccggcggtcccggacgccctgcgccgtccggatcttgctgtgccggtccgtcctgaacggc

SEQ ID NO: 77840 - DNA, 634 bp, Triticum aestivum
  Clone ID: PAT_TA_77840
gcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctg

SEQ ID NO: 77841 - DNA, 527 bp, Triticum aestivum
  Clone ID: PAT_TA_77841
acggcaggtaagggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccgaaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggcgaagcgcgcc

SEQ ID NO: 77842 - DNA, 624 bp, Triticum aestivum
  Clone ID: PAT_TA_77842
gcaggagcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcataag

SEQ ID NO: 77843 - DNA, 671 bp, Triticum aestivum
  unsure (1)..(671): unsure at all n locations
  Clone ID: PAT_TA_77843
ttcggcacgagggaaactctggtggaggctcgaancgatactgacgtgcaaatcgttcgtctgacttgggtataggggcgaaagactaatcgaaccatctagtagctggttccctccgaagtttccctcaggatagctggagcccattacgagttctatcaggtaaagccaatgattagaggcattggggacgcaacgtcctcgacctattctcaaactttaaataggtaggatggcgcggctgcttcggtgagccgtgccatggaatcgggtgctccaagtgggccatttttggtaagcagaactggcgatgcgggatgaaccggaagccgggttacggtgcccaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgcacgccgtgccaagggtctaggaatgcacgtgattgcacacgatccatatgcctctgctgatcgtgctcgcgctattggagttgacctagtaagcatggaagaggccatgacaactgctgactttatctcgttgcatatgccccttactccttcaacaaacaagatgctcaacgatgaagccttcgcga

SEQ ID NO: 77844 - DNA, 598 bp, Triticum aestivum
  Clone ID: PAT_TA_77844
gaaaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagt

SEQ ID NO: 77845 - DNA, 481 bp, Triticum aestivum
  unsure (1)..(481): unsure at all n locations
  Clone ID: PAT_TA_77845
gggaggaacaagaggaccaagcgcgtcgcgcccaagtncgacgatgtctacctcaagctcctcgtcaagctcctcgtcaagctcttcatgagcaagaccaaccgcccgccgctctccatgcgccgcctctccaacttcatgaagggaaaggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacacgatcctgttgaggggacccaagaatgcccgtgaggcggtgaggcacttcggcaaggcgcctggtgtgccgcacagccacaccaagccctatgtgcgctccaagggtaggaagtttgagaaggctcgtggtaggaggaacagccgtg

SEQ ID NO: 77846 - DNA, 553 bp, Triticum aestivum
  Clone ID: PAT_TA_77846
gccgaactcaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagaggaaggagaagg

SEQ ID NO: 77847 - DNA, 576 bp, Triticum aestivum
  unsure (1)..(576): unsure at all n locations
  Clone ID: PAT_TA_77847
gggctgcaggnaattcggnacgagggaactgtgcctgttggccgtgttgagactggtgtcatcaagcctggtatggttgttacctttggtcccactggtctgacaactgaggtcaagtccgttgagatgcaccatgagtctctcctggaggcgcttcctggtgacaacgttggcttcaacgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcacacattgctgtcaagtttgctgagctggtgaccaagatcgacaggcggtctggtaaggagctggaggccctgcccaagttcctcaagaatggtgatgctggcatagtgaagatgattcccaccaagcccatggttgtggagacctttgccacttaccctcctcttggtcgttttgctgtccgtgacatgaggcagactgtggctgttggtgtcatcaagggcgttgagaag

SEQ ID NO: 77848 - DNA, 493 bp, Triticum aestivum
  Clone ID: PAT_TA_77848
gacgagatctcctggccactcccggcagaatatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgtgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagtttgaggccaagcgcgccaagagcaaggcaagcagggagaggaagattgccaggagggaggagagattggctcagggcccgagagatcatgcaccagcaccagcggct

SEQ ID NO: 77849 - DNA, 583 bp, Triticum aestivum
  Clone ID: PAT_TA_77849
cccacccgagcggcagccatgacccccaaggcagacaagaagccggcggccgagaacaaggtggagaaggcggcggagaagacccccgcggggaagaagcccaaggccgagaagcggctgccggcgggcaagacggcgtccaaggaggccggcggcgaggggaagacccggggccggaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcccgctacaacaagaagcccaccatcacctccagggagatccagacctccgtccgcctcgtcctccccggggagctcgccaagcacgccgtctccgagggcaccaaggccgtcaccaagttcacatcctcctagactgacggcgtgcagttggtttctgcatctgcatctgtactcttgactctgcttatctatctatctgcaagtagtggtggtggtagtagtacctgtgctgggt

SEQ ID NO: 77850 - DNA, 549 bp, Triticum aestivum
  unsure (1)..(549): unsure at all n locations
  Clone ID: PAT_TA_77850
caggcggcggcggtgcccgagnngnagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacct

SEQ ID NO: 77851 - DNA, 602 bp, Triticum aestivum
  Clone ID: PAT_TA_77851
gggcgcgcgcataggaggcgaagcagcagcggagccaagccccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggc

SEQ ID NO: 77852 - DNA, 539 bp, Triticum aestivum
  Clone ID: PAT_TA_77852
gcccgtttattattccccttcccgcagccgccccccgtgtcccgcgcgcaccttctcgaagcctcctccctccctcccccatggcggaccagctcaccgacgagcagatcgccgagttcaaggaggccttcagcctcttcgacaaggatggcgacggttgcatcaccaccaaggagctcggaaccgtgatgcggtcccttgggcagaaccccacggaggcggagctgcaggacatgatcaacgaggttgacgcggacggcaacggcaccatcgacttccccgagttcctgaacctgatggcgaggaagatgaaggacacggactcggaggaggagctcaaggaggcgttccgcgtgtttgacaaggaccagaacggcttcatctcggcggcggagctgcgccacgtgatgaccaacctcggggagaagctgacggacgaggaggtggacgagatgatccgggaggcggacgtggacggcgacggccagatcaactacgaggagttcgtcaaggtcatgatggccaagtgaggtggcgag

SEQ ID NO: 77853 - DNA, 611 bp, Triticum aestivum
  Clone ID: PAT_TA_77853
ggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctgg

SEQ ID NO: 77854 - DNA, 176 bp, Triticum aestivum
  unsure (1)..(176): unsure at all n locations
  Clone ID: PAT_TA_77854
acctcgccggcggcgtncgcggncaggaagatggctgncggctttcgggtgctgcatctggtcaggcccttcttggccttcttgccggaagtgcanagtgctgacaggaaaataccatttagagaaaaagtgatctacaccgtcatttctctcttcattntcctggtgtgcagtca

SEQ ID NO: 77855 - DNA, 576 bp, Triticum aestivum
  unsure (1)..(576): unsure at all n locations
  Clone ID: PAT_TA_77855
ccccagcaaggagcaagcaagcaagatggacggcagcaaggcgaagaaggtggcggcgaagaagttcggcgggccgaggaagaagtcggtgaccaagtccatcaaggctgggctccagttccccgtcggccgcatcgggcgctacctcaagaagggccgntactcccagcgcgtcggctccggcgcccccgtctacctcgccgccgtcctcgagtacctcgcagccgaggtgctggagctggccgggaacgccgccaaggacaacaagaagacccggatcgtgcccaggcacctgctgctggccatccgcaacgaccaggagctcgggaggctgctgagcggcgtcaccatcgcccacggcggcgtcatccccaacatcaacccggtgctgctccccaagaaggccgctgagaaggctgagaaggccggcgccgcccccaagtcgcccaagaagaccaccaagtcccccaagaaggccaccaaggcctagatccggccgtgccggtgaactgatggtgctccggcagccctcgtgtgcctagtgtctctgtgttaagttagctatggtgtgttcca

SEQ ID NO: 77856 - DNA, 594 bp, Triticum aestivum
  Clone ID: PAT_TA_77856
attggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttcccttcgtccccatctctgggttcgagggtgacaacatgattgagaggtccaccaaccttgactgg

SEQ ID NO: 77857 - DNA, 680 bp, Triticum aestivum
  Clone ID: PAT_TA_77857
gccgccgccgcctcccctccgttcgttcttcttcttcgggttgggtagtttacgtctacccaccagccatgggtaaggagaagactcacatcaacatcgtggtcattggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccaccactggtggatttgaggctggtatctccaaggatggccagacacgtgagcatgctctccttgctttcactcttggagtgaagcagatgatctgctgctgcaacaagatggacgccaccactcccaagtactcaaaggcacgttacgaagaaattgttaaggaggtctcttcctacctgaagaaggtcggctacaaccctgaaaaggttcccttcgtccccatctctgggttcgagggtgacaacatgattgagagg

SEQ ID NO: 77858 - DNA, 422 bp, Triticum aestivum
  Clone ID: PAT_TA_77858
tacgcccagcgcgtcggctccggcgcccccgtctacctcgccgccgtcctcgagtacctcgcagccgaggtgctggagctggccgggaacgccgccaaggacaacaagaagacccgcatcgtgccgaggcacctgctgctggccatccgcaacgaccaggagctcgggaggctgctgtccggcgtcaccatcgcccacggcggcgtgatccccaacatcaacccggtgctgctccccaagaaggccgccgagaaggctgagaaggccggcaccgccgccaagtcgcccaagaaggccaccaagtcccccaagaaggccaccaaggcctagatcctagtagtgtgcgaccgtgccggtggtgctccggcagccctcgtgtgcctagtgtctgtgttaattaagttagctgtggtgtgttccag

SEQ ID NO: 77859 - DNA, 601 bp, Triticum aestivum
  Clone ID: PAT_TA_77859
ccaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgcgggcaccttcatggccaaccacttcgaccgccactactgcggcaagtgcggcctcacctacgtctacaaccagaaggcttagaggttgcttgcgattgctctgctcttttactctacctatcgagagtcgaactcacttagatgtgtc

SEQ ID NO: 77860 - DNA, 598 bp, Triticum aestivum
  unsure (1)..(598): unsure at all n locations
  Clone ID: PAT_TA_77860
cgatcccgaaccagggnaggaacccggcgcgaggagggcaaaggaagagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctgaaatcactgacaagcttggcctgcattccctgcgccagcgacactggtacatccagagcacatgtgcta

SEQ ID NO: 77861 - DNA, 572 bp, Triticum aestivum
  Clone ID: PAT_TA_77861
atctccgtcctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcagacgttaacattgtctcaaatgctagctgcaccactaactgccttgctcccctagctaagatcattaatgacaacttcggtattattgagggtttgatga

SEQ ID NO: 77862 - DNA, 397 bp, Triticum aestivum
  unsure (1)..(397): unsure at all n locations
  Clone ID: PAT_TA_77862
agtgcatctcgatccacatcggccaggccggcatccaggtcgggaacgcgtgctgggagctctactgcctcgagcatggcattcagcctgatggccagatgcccggtgacaagaccggtgggggaggtgatgatgctttcaacaccttcttcagcgagactggggctgggaagcacgtcccccgtgctgtcttcgtagatctcgagcccactgtgattgatgaggtgaggactggcgcttaccgccagctcttncaccctgagcagnttatcagnggcaaggaggatgcagncaacancttcnnccgnggncattacaccattgnnaaggngattgnngntntgngccttgancgnatnangaanntnnnnncnnntgnnntgnnntnnnnnnnnnn

SEQ ID NO: 77863 - DNA, 515 bp, Triticum aestivum
  unsure (1)..(515): unsure at all n locations
  Clone ID: PAT_TA_77863
aggcaaggnaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaagggtg

SEQ ID NO: 77864 - DNA, 442 bp, Triticum aestivum
  unsure (1)..(442): unsure at all n locations
  Clone ID: PAT_TA_77864
ggttgttgaggtctccacctccaagactgggaagcatggtcacgcaaagtgtcactttgttgccattgacatctttaatggaaagaagctngaggatatcgttccttcatcccacaactgtgacgtcccccatgttgaccgccaagattatcagctgattgacataactgatgatggatatgtcagccttctaactgagagtggcaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatctagtgcttctgggtgtttgagatacacatacataggcatcaa

SEQ ID NO: 77865 - DNA, 488 bp, Triticum aestivum
  unsure (1)..(488): unsure at all n locations
  Clone ID: PAT_TA_77865
acgaggaccacccctccccccaatncccactcgcgcagcagctccaagaggatcgtcggcgaccatgtccggccgcggcaagggaggcaaggggctcggcaagggcggcgcgaagcgccacaggaaggtgctgcgcgacaacatccagggcatcaccaagccggccatccggcgcctggcgaggaggggcggcgtgaagcgcatctccggcctcatctacgaggagacccgcggcgtgctcaagatcttcctcgagaacgtcatccgcgacgccgtcacctacaccgagcacgcacgccggaagaccgtcaccgccatggacgtcgtgtacgcgctcaagcgccagggccgcaccctctacggcttcggcggctaggccgctggcccccgccagacggtcgtcagtcttcgtcgccacctgcagattccgatgtgttagtccgcccgttcctagtagtgttgcgctcaagaaatctcagatggaaacc

SEQ ID NO: 77866 - DNA, 524 bp, Triticum aestivum
  unsure (1)..(524): unsure at all n locations
  Clone ID: PAT_TA_77866
caccgccgtcgaancacccatggcacccaaggcggagaagaagccggcgccggagaagaccccggcggggaagaagccggcggcggagaagaggcccgcggccgggaagacggcgtccaaggagggcggcgagaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctggcccgctacaacaagaagcccaccatcacctcccgggagatccagacctccgtccgcctcgtcctccccggcgagctcgccaagcacgccgtctccgagggcaccaaggccgtcaccaagttcacctcagcctangcgtcttcctcgtttcatgagctgatggcggcgttctgtgtgtagttagcagtgcgatgttacaatctctgtaagaattgtgctg

SEQ ID NO: 77867 - DNA, 564 bp, Triticum aestivum
  Clone ID: PAT_TA_77867
caaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacagaggaagcaaagaagagcaacaatgtccagaggaagcttgagaagcgccagcagggacgtacactggactcgcacattgaggagcagttcagtggtggaaggc

SEQ ID NO: 77868 - DNA, 493 bp, Triticum aestivum
  Clone ID: PAT_TA_77868
tcggcacgagggcaaagctgcggcggcgcgcgcatagggaggcgaatcagcagcggaaccaagccgccgacgccaccatgggtatctcgcgtgactccatgcacaagcgccgggccaccggtgggaagcagaaggcttggaggaagaagcgaaagtaagagcgaatcccctccctttcccccttcccttacggttcgtgaagatgtgtggatgttctacgtaggttagatccgtgtttacttagatcaggcgtggataaattgtcgttgctgcggtggatatctgggtttatccgacgcgtctgtactctttaggatgatagctcggtaactagcattttctagatctcgtatgatagcttggtggtaactagcctggtaattacgcgagtagcgcgggtattccgctttctggtgacttgataaccttatccgtttacgcacatctatggttttggctacatgcgaacttctgatgtgttcatgttaatttg

SEQ ID NO: 77869 - DNA, 632 bp, Triticum aestivum
  Clone ID: PAT_TA_77869
gaggaattcggcacgaggcctcgatctgttctaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaagatgctcccatgtttgtctgtggtgtcaatgagaaggaatacaagtctgacatcgacattgtctccaacgctagttgcaccactaactgccttgctcctcttgctaaggttatcaatgacaggtttggcattgttgagggtttgatgaccacagttcatgccatgactgcaaccc

SEQ ID NO: 77870 - DNA, 672 bp, Triticum aestivum
  Clone ID: PAT_TA_77870
ggcggcgcgtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaagggtcgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacaccatcaagctcgacctggagaccaacaagattgttgacttcatcaagtttgacgtcggcaatgtggtcatggttactggtgggcgcaacactgggcgtgttggtgtgatcaag

SEQ ID NO: 77871 - DNA, 628 bp, Triticum aestivum
  unsure (1)..(628): unsure at all n locations
  Clone ID: PAT_TA_77871
gtctcctttccccaacccaaaccggnagcgccctccctcccccagccgcccgccccctccccacccaggaaaccagccatgaagggggccaaatccaagggcgccgtcaaggccgacaccaagttggcggtgaagagcaagggggcggagaagccggccgccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagtgctgctgctgctgccccaaagaaggcggcggccaaggaggtagaggaggacgatgaggaggaatccgacaagtccaagtcggagatcaatgatgacgatgacgatgagggtagcgacgaggacgaggacgatgacgagtgaagcggacaatgcgggagctgctgtgcgagaagcgacctgagctgtgtgcggtggtgtcataagg

SEQ ID NO: 77872 - DNA, 555 bp, Triticum aestivum
  unsure (1)..(555): unsure at all n locations
  Clone ID: PAT_TA_77872
ttgggtagtttagctctacccaccagccatgggtaaggagnaagnactcacatcaacatcgtggtcattggccacgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggacggccagacacgtgagcatgccctccttgctttcactcttggagtgaagcagatgatctgctgctgcaacaagatggacgccaccactcccaagtactcgaaggcgcgttatgaagaaattgtcaaggaggtctct

SEQ ID NO: 77873 - DNA, 485 bp, Triticum aestivum
  unsure (1)..(485): unsure at all n locations
  Clone ID: PAT_TA_77873
cacaaccacaccaatttncacgattaccattacaaagtcaaatcccacaattattcagtaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtancgcttnatgtgagagataaactgnttnttgtnaaaagcangttgctnctgaanacggaaggngtnaacaatgtnaanc

SEQ ID NO: 77874 - DNA, 633 bp, Triticum aestivum
  unsure (1)..(633): unsure at all n locations
  Clone ID: PAT_TA_77874
gtcccccgggctgcaggccgnaccggnagcgccctctctcccccgccccctccccccaggnaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgc

SEQ ID NO: 77875 - DNA, 541 bp, Triticum aestivum
  Clone ID: PAT_TA_77875
cccccaccgtctcgccgccgccaccaccgccgcagctagataagaagaaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcggg

SEQ ID NO: 77876 - DNA, 701 bp, Triticum aestivum
  unsure (1)..(701): unsure at all n locations
  Clone ID: PAT_TA_77876
gntagcatgcatattaaccaggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtacttgccgtggcgggggtcacacttggccatcatagatgaaggctcaaaggcgctgttggtgatctcagcaacagacagctgctcatggtaggccttc

SEQ ID NO: 77877 - DNA, 642 bp, Triticum aestivum
  Clone ID: PAT_TA_77877
catgcatattaaccaggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtactttgccgtggcgggggtcacacttggccatcatagatgaagg

SEQ ID NO: 77878 - DNA, 410 bp, Triticum aestivum
  unsure (1)..(410): unsure at all n locations
  Clone ID: PAT_TA_77878
ttcaaacatacaaggttgcttacaacacaacaggttgtaaaacaaacaccacaaagcaaatgttcaaacagacagataacagataaagccactcgggcagatcataggattgcagcagcatgccttgggaaagcaccaggaggcaggctctagtactcgtcgccctcgtcaccgtcctcaccctcgtcaaactgagnaccaacttcttcatagtccttctccagggcagcaagatcctcacgggcctcagagaactctccctcctccatgccctcacccacgtaccagtggacgaaggcgcgcttggcgtacatnangtcaaacttgtggtcnatgcgggagaagacctntacnacactgntggagttggagatnatgcacacagncntttgnaccttgncanggtnacc

SEQ ID NO: 77879 - DNA, 362 bp, Triticum aestivum
  unsure (1)..(362): unsure at all n locations
  Clone ID: PAT_TA_77879
catattaaccaggtgcataacaggttcaaacatacaaggntcttacaacacaacaggttgtnaaacaaacaccacaaagcaaatgttcnaacagacagataacagataaagccactcgggctgntcataggattgcagcngnatgccttgggaaagcaccaggaggcaggctctagtactcgtcgccctcgtcaccgtcctcaccctcgtcaaactcagcaccaacttcntcatagtccttctccagggcagnaagatcctcacgggcctcagagaactctccctgctccatgccctcacccacgtaccagtggacgaaggcgcgcttggcgtacatcaggtcaaacttgtggtcgatgcgg

SEQ ID NO: 77880 - DNA, 643 bp, Triticum aestivum
  unsure (1)..(643): unsure at all n locations
  Clone ID: PAT_TA_77880
catgcatattaacncaggtgcataacaggttcaaagatacaagggtcttacaacacaacaggttgtaaaacaaacaccacaaagcaaagattcaaacagacagataacagataaagccactcgggcagatcatgggatagcagcagcacgccttgcgaaagcaccaggaggcaggctctagtactcgtcgccctcgtcaccgtcctcaccctcgtcgaactcagcaccaacttcttcatagtccttctccagggcagcaagatcctcacgggcctcagagaactctccctcctccatgccctcaccgacgtaccagtggacgaaggcacgcttggcgtacatgaggtcaaacttgtggtcaatgcgggagaagacctcgacgacactggtggagttggagatcatgcacacagccctctggaccttggcaaggtcaccacctgggacaacacctggtggctggtagttgataccacacttgaagccagtggggcaccagtcaacaaactggatagtgcgcttggtcttgatggtggccacagcagcgttgacatccttgggaacaacatcaccacggtacatgagacagcaggccatgtactttgccgtggcgggggtcacacttggccatcatagatgaagg

SEQ ID NO: 77881 - DNA, 217 bp, Triticum aestivum
  unsure (1)..(217): unsure at all n locations
  Clone ID: PAT_TA_77881
atgtttggccagaacaaaaccacaaaaccgatacagcgaccatccaacgtcgacactaaagataaaaacaactaggcggtgcagggcatgaacatccgacgacaggcagacttggcgcttagtcgacctcctccatcttgctctcaccagcgtcgtcctccaggggcggcatgtnggtgtcgttctcatttttttttatcgtcctcgtcaatgctca

SEQ ID NO: 77882 - DNA, 187 bp, Triticum aestivum
  unsure (1)..(187): unsure at all n locations
  Clone ID: PAT_TA_77882
ccaagcttatcagtgatctcagcagcattcatggcatttggaagatcttgattnttagcaaacacaagcagnacagcatcacgtaactnatnctnattcannatnctgtggagctnatncnttgnttnaacaacacnnnncntatnnnnnntgnncacannananatnanancntnnnnnnnnnnna

SEQ ID NO: 77883 - DNA, 707 bp, Triticum aestivum
  unsure (1)..(707): unsure at all n locations
  Clone ID: PAT_TA_77883
gttactgatgacagcaaggnggtgacatcagnatcaggnaacactacatgccaccatggcacgaacagtacactacaaacacgcacaatttcaccgctgaacacatctggctaagacgacgactaacagacgacgacgcacagagcttaggccctctctccacggatgcggcgggcgagctggatgtccttgggcatgatggtgagttgttacacactccttagcggatttcgacttccatgaccaccgtcctgctgtcttaatcgaccaacaccctttgtgggttctaggttagcgcgcagttgggcaccgtaacccggcttccggttcatcccgcatcgccagttctgcttaccaaaaatggcccacttggagcacccgattccatggcacggctcaccgaagcagccgcgtcatcctacctatttaaagtttgagaataggtcgaggacgttgcgtccccaatgcctctaatcattggctttacctgatagaactcgtaatgggctccagctatcctgagggaaacttcggagggaaccagctactagatggttcgattagtctttcgcccctatacccaagtcagacgaacgatttgcacgtcagtatcgcttcgagcctccaccagagtttcctctggcttcgccccgctcaggcatagttcaccatctttcgggtcccgacaggcgtgctncaactcgaac

SEQ ID NO: 77884 - DNA, 815 bp, Triticum aestivum
  unsure (1)..(815): unsure at all n locations
  Clone ID: PAT_TA_77884
cggggtccactgcccatccatggaattgttttacgattgtttttcccgctgcaatacacgggcacattgtaggaggaatatgtatgcgttggtgggtgctggaggttccctgcaacacccgaggatccgatggcgagccgtaggtcggggaagtcgtcagcatacatataaggagatggaggtggaggtggcggtggagggagacgggcattcactactcgtcngagggcgagggcacggaggacaaccggcatgacgattaccacgccttcctcccgtcgaatcactcaagcacgacgtcctggtcctctctatccattggccccctccaacatctaccatgatgaccacatnttgtttgtgtagcagaagcggcggccatccatgatcttcttttgtgccgacctgctagaaacaggttgggctatagacaactagagattggtcacctgtctagcagctcatttctgaaaacaaagaccaggtctatgtgttcaaaatcatgaaggaggatgtcaaagtgtttctgcagcgcatcangcggaagaaaaaagcaacatgaagttcccatctacatcaaactgctttcacttatattctgccaaatttgttccatctataggactgtacatggagattatctataanggttatgttccgtgcnaggagattntcttatnngacaggcntatnagcccccattagacatancagattttcaacagaanaagntcctncactgctactggccaaactntaancaaaaagaccttncnctttncttgcttatggggngcactcaaagatggctncaa

SEQ ID NO: 77885 - DNA, 783 bp, Triticum aestivum
  unsure (1)..(783): unsure at all n locations
  Clone ID: PAT_TA_77885
cggggctcccccangctaggnaatttcgtatttcagcctgtgaggatagaatattgaggttagagggaggattggacaataagttctgtaaatatgagaatgtgtgcgaagtttgagtgattttagtgtgcagctaatcttgacgaaggcaagttgtgtggcttgcttgaatgatcaggtattatgcctagtattgttgttgtacggaggtctaatcctttttatggtatatttgcatccttgcgagatgctggttgtaaccctgccatttcagaggattggacaccggtttctagttgagatgaacaagtcctgttacggaagttgtacatgattaggtgatgtgttggccatcaaccgatgaatgttgtacgagcaatttcggatgtaaataccctgtatccattttatcatgttggggcaggtttgagtcgaaattctgtttccaaaaaaaaaaaaaaaaaacggtccgcggccgccaccgcggtggagctccagcttttgttccctttagtgagggttaattgcgcgcttggcgtaatcatggtcatagctgtttcctgtgtgaaattgtantccggctcacaattcccacaacatacgagccggaagcataaagtgtaaagccctggggtgccctaatgagtgagctaactcacattnatttgcgttgcgctnactgcccgctttccagtcgggaaaccctgtcgtgcccgctgctttantgaatcggccnccccccgggagaaggcggnttgcnttttgggngctcttccgnttcct

SEQ ID NO: 77886 - DNA, 678 bp, Triticum aestivum
  unsure (1)..(678): unsure at all n locations
  Clone ID: PAT_TA_77886
gggtcccgggcccccccctncgnggtncgnacggtntcgnttaatcttgntatcgaattcccggggcgaatccccccaaccccgnntcagccgantcatcgntggcccccangcggnagaagaagccggcggcgaagaagcccgcggnaggaggnagccgacgacggnagaaggccgagnaaggccccggcggcgaagaagcccaaggnccgagaagcggctgccggcgggcaagaccgcctccaagggagggcggcgagaagaggggccgcaagaagggcaagaagagcgtggagacgtacaagatctacatcttcaaggtgctcaagcaggtccaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctcctcgtagattgccatgttcgcatctcagaaactgtagtttgctgccgtgtatctaaaactagtgnntattgctgaatggaaattccgtggaatgctgttaaaaaaaaaaaaaaaaaaaa

SEQ ID NO: 77887 - DNA, 844 bp, Triticum aestivum
  unsure (1)..(844): unsure at all n locations
  Clone ID: PAT_TA_77887
ntntatgggtncncgggcccccccctncgnggtncgaggtntcgntaatcttgntatcgaattcccggggnacgggnagcggcaacttcacgacggtggggggaggcggtggcggcggcgcccaacaacagcgatacgcggtacgtgatccacatcaaggccgggggatacttcgagaacgtggaggtcggggccgagaagaccaacatcatgctcgtcggcgacggcatgtggaggaccgtcatcaaggccagccgcaacgtcatcgacaactacaccacctttcgctccgccacgctagcggtgatcgggacggggttcctggcgcgggacctgacggtggagaacgcggcggggccggccaancaccaggcggtggcgctacgggtgaacgccgacctgtccgccttctaccgctgcagctttcgcggggtaccaggacacactctacgcgcactcgctccgncagttctaccgngactgcgacgtttacggcaccgncgatttcgtcttccgngacaccgncgtcgtgctccanaactgcaacctntacgcgcgccgcccgggccccngncagaagaacgttttnaccgcncanggacgcganggaccccaaccagaacaccngcatcaccgtgcangggttgcaagatnngtngccgccgccngaccttntncccggtgcaggccaaccttntnttnctnccttngngcggcccctggaangacctacttcccggnaccgngttcntngcagtccaagantgganagcctgggggcaccccgnccgggttggcttcgagnggaacgggaccntccggctnggaacgctttattccgcct

SEQ ID NO: 77888 - DNA, 1126 bp, Triticum aestivum
  unsure (1)..(1126): unsure at all n locations
  Clone ID: PAT_TA_77888
aaaatccgttccgggccccccctcgggtcgacggtatcgataagcttgatatcgaattcccggggtgccattcggcgttggcacccaagttggtgcctactgataagaaaatatctctagtaatatatagttggatcgccgttgcttagtcgatgggcatgtcgatgtagcggtggcaaataaagtgtcacacaatgtcatgtgtgatccgcacaaacgagtttaaattatgaaataaaatacaaataaagtttgatctaaaaaaaaaaaaaaaaaaaaaaacggtccgcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttctcgctcactgactcgctgcgctcggtcgttcggctgcggcgagcggtatcagctcactcaaaggcggtaatacggttatccacagaatcaggggataaccgcaggaaagaaacatgttgagcaaaaggccacaaaaggccaggaaccgtaaaaaggccgcgttgctggcgttttttccataaggcttcccgccccccctgacgaagcattcacnaaaaaatcgacncttcaagttaaaangnnggcgaaaaccccgccnggacttttaaanaaatcccagggcgtttccccccttgggaancttcccttcgngcnnctttncttgttccganccttgcccgtttaaccggganaccctgttnccnccnttttttnccctttcgggnaancgtgggcgcttttnttantaacctcaccnctgggangggtttctnaattcnggnggaaggnccgttcccccccaacctgggcttgngntgnccnaaacccccgttnancccngaccgntgggccttnttccgggnactnttgg

SEQ ID NO: 77889 - DNA, 800 bp, Triticum aestivum
  unsure (1)..(800): unsure at all n locations
  Clone ID: PAT_TA_77889
ttttgggtaccgggcccccccctncgangtncgnacggtatcgcttaagtcttgntatcgaattcccggggcaaccgggnacaaagcagccagggtactactcaacttctccgcaacaattaggacaagggcaaccaaggtactacccaacttctccgcagcagccaggacaagagcagcagccaagacaattgcaacaaccagtaacaagggcaacaaggtcagcagccagaacaagggcagcaaggtcagcagccaggacaaggggagcaaggtcagcagctaggacaagggcaacaagggcagcaaccgggacaagggcagccagggtactacccaacttctncgcagcagtcgggacaagggcaaccagggtactacccaacttctccacagcagtcaggacaattgcaacaaccagcacaagggcagcaaccaggacaagagcaacatggtcaacagtccaggacaagggcaacaaggtcaacagccctgacaagggcancaaccgggacaagggcagccagggtactacccancttctccgcancantcanggacnagagcaacagctatgaacaatggcancantnnntgacangggcanccagggnactttcccanctttttccgttgcangccaggncaaagggcagccaagggtanctancccanctttntnncnaancataatngganaaggngcagcancccangaanaattggagcaacncanccctggggcaancatggncnggnaacannnacaggggcatcaaggtcanatancaagacaaggg

SEQ ID NO: 77890 - DNA, 495 bp, Triticum aestivum
  unsure (1)..(495): unsure at all n locations
  Clone ID: PAT_TA_77890
ttgggtnccgggcccccccctncgggtcgncggtatcgnaagncttgnnatcgaattcccggggtcagctgttaaatgaacttctggctgtgtggtgctatttgttatctcacaactggcgactcaaccaggatggcggcaatgccattttgctactggcatgcttcttcttcttctttcctttgagatgagatgtacgatttgatgagttggctaacatttgaaatattgtgagttagttttgaagaaattaaaaggtctcacttattattattggcaaaagggaaaaaaagatgaatagtttcggttcttgcgatcaggaacaaggatagttaaaccaaaaaaaaaaaaaaaaaaaacggtccgcggccgccaccgcggtggagctccagcttttgttccctttagtgagggtnaattgcgcncttggcgtaatcatgggcatagctggttcctgngtgaaattgttatccgctcacaattccncccacatac

SEQ ID NO: 77891 - DNA, 907 bp, Triticum aestivum
  unsure (1)..(907): unsure at all n locations
  Clone ID: PAT_TA_77891
gggtaccgggnccccccctncgngtcgacggtatcgntaagtcttgnnatcgaattcccggggnaggagggagagttctctgnaggcccgtgnaggnatctcgctgccctggataaggactatgaagaagttggtgctgagttcgacgagggtgaggacggtgatgagggcgatgagtattaagcctgcctcctggtgctttcccaaggcttgctactgctatcctatgatctgcccgagtggctttatctgttatctgtctgtttgaacgtttgctttgtggtgtttgttttacaacctgttgtgttgtaagaaccttgtatctttgaacctgctttgcaccttggttaatatgcatgctatctggttatctacaaaaaaaaaaaaaaaaaacggtccgcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaaatgagtgagctaactcacattaattgcgttgcgctcactgcccgctttccagtcgggaaacctgtcgtgccagctgcattaatgaatcggccaaccccccggggagaggccggtttgccgtntttgggcgctcttccgctttcctcgctcactgactcgctgcgctcggtcgttcggctgnggcgagccggnttcagctcactcaaaggcgggtaattccggttttccncagaatcagggggtaacccnngaaanaacctgtgagccaaaagccnncaaaaggccaggaacccgtaaaaaggcccccgttgctggcgtttttccttaggctcccccccc

SEQ ID NO: 77892 - DNA, 885 bp, Triticum aestivum
  unsure (1)..(885): unsure at all n locations
  Clone ID: PAT_TA_77892
gggtaccgggccccccctcgaggtcgacggtatcgataagcttgatatcgaattcccgggcccaaccccaacagcagttgcagcagcaactcgggcaacaacctcaacaacaacaattgacacatggtgcctttttgcagccacaccagatagctcagcttgaggtgatgaattccattgcactccgtaacctgccaaggatgtgcagtgtcaacgtgccgttgtacgaaaccaccactagtgtgccattaggcgttggcatcggagttggtgtctactgataagaaaagatctctagtaatatatagttggatcaccgttgtttagtcgatggatatgtcgatgtagcggtgacaaataatgtgtcacacaacgtcatgtgtgacccgctcaaactagttgtttaaattctgaaataaaatacaaataaagttgtatcaagacaaaaaaaaaaaaaaaaaacggtccgcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacatttaattggcgtttgcgctcactggccgctttccaatcgggaaacctgtcgngccagctgcattaatgaattgggccaacncnccggggagaagcgggttggcgtatttggggcgcttttttccgctttcttngnttaacttganntngcttgggcctcgggncgtttcggnttgnggggngagcgggttttaagcttacctnnaaanggnggnaataccgggttttccn

SEQ ID NO: 77893 - DNA, 931 bp, Triticum aestivum
  unsure (1)..(931): unsure at all n locations
  Clone ID: PAT_TA_77893
cgggcccccccctcgaggtcgacggtatcgataagcttgatatcgaattcccggggagagagagagagagagagagagagagagagagagagagagagagagagagagagagagagagagagagagagagagagagagagagagagaggagagagagagagagagagagagagagagagagagagagagagagagagagagagaggaggagagagagagagagagagagagagagagagagagagagagagagagagagagagagagagagaganagannagancagcagnnagngagagagagaganancgannntnttnctcccccgnttnttatatatgntcgcctctgngcatcgtgcgaccgcgccccctcttctcttctcggcttgctccnctggntttatctgtganactnnnctgtgcacacatggtgagtgggttctngnacactnccttcnatgcnctcgtggtttctngtggcggtgagagtggngcncacacacagnntnntntctcacactcctccttgtctcgttggattggncctccccntgnagcttctnctgngngatcatatcnntcgctcganatnactngatgtgcctttgtcncnctcncggtnttttnctcccgggtggccgtgancgcactntntgtgggggngccnctcctctctccntntcttggtgcccgttnccccntntttgtnttngngattttctctccccccccctntttacanagcttngagtnnctttctcttntcgcttntcccgccctnccncttgatcncatttnctnggggangnttgtnncccttttctttntccttgttttgcnccnntntgnttcctgggccgcnccccttccctccttngcnttccctccntgtntttcttnggnnncttnngntgnccctcccnctttc

SEQ ID NO: 77894 - DNA, 629 bp, Triticum aestivum
  Clone ID: PAT_TA_77894
tatgggtaccgggccccccctcggagtcgacggtatcgataagcttgatatcgaattcccggggctcgattcatgagcctgcaaggacaatcatgagctgcaccataagaaaagagagtacttgagacttgagaggatggcttctgtgcagtgggaaggaagctggagctcactcttggggctagcgtgcacttttatctcggcatttcggggctctttccatcacggttcacggccttcagtgtcacgttggcctcgcggtgtagcgcacatcgccctcgatctgcggctggctagttacaacaagatcctccgaatgccgcccgcaaagcttgggaccatgcgtggtactttgttctgagcaccatcgatgctctcctcgtgtaggacctgccgagcatgatgcctctgccttgcttttcgaaaggaaaagtgaattcttccatggaattcaatcatcagttcggcactaggagacggaaagtatatttgtactgcgtgatttagcgcatgcatgttcgaatcggtttaactagtccaacacaggagctaaccaaattttgtttgtggtgctttagagcactttccttgacgatgcagggaagcatgcaggttctcttggtgccttt

SEQ ID NO: 77895 - DNA, 916 bp, Triticum aestivum
  unsure (1)..(916): unsure at all n locations
  Clone ID: PAT_TA_77895
gggtaccgggccccccctcggagtacgacggtatcgataacttgatatcgaattcccggggactaacaaacagtgatactgcattcttaagaatcagcaccccctgcatactgggctggctctgccttggcaaatggttggaaaaatggcaaagctgttagctaggtttccagtattctcaatcaagattgtagtagaatttctggatgttgcatgttgttctttgtcgaatctctgaactgcattttcagactcgctattaataaaattctgcggctcaccatctcatgcgcagaaattctccttaaaaaaaaaaaaaaaaaaaaaaaacggtccgcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaangccagcaaaaggccaggaaccgtaaaagggccgcgtgctnggcgtttttccatangctccgcccccctgacnagcatcacaaaaatcgacgctcagtncanaggnggcgaaaccccgacaggacttttaagatcccaggcgtttccccn

SEQ ID NO: 77896 - DNA, 852 bp, Triticum aestivum
  unsure (1)..(852): unsure at all n locations
  Clone ID: PAT_TA_77896
cgggccccccctcggagtcgacggtatcgataagcttgatatcgaattcccgggcttcgatgcttcggagagtcagttcagagcggattctggagtatcagagagaaatacaaagggtaaaacattactttgagtatgaagatctgaatggaccagtgaatcaaatatggcgccaagtttccatgaaagcaccacttatcaagctgttgattaaccggaacaaacgcctagttgaaagaggcactaatgaaactgattgctcgtgcatctgttcaacaccgagcgagatatctactgctggctaggcaataggatggtttttgtggcctgaaggaaacttttgtgcctacattgcctgaattttggatgttgcagcgctatacatatatacggacagcaaggaccccttttcagttcctgattgtacatatcctgctaatgcccttcagttcttcagtagatattacaatggagtccgcatttgaagaacaccgttttgattggtgtttttgtatttgtttgttttatgttgttagcttgtcaggatgtcatgttaaatcagaatgtcttattcacaacattgattacagcgtgtcttagggagacatccaagttgtaataggaattatctaagggaagcaatcttgagatattgcttatcgtaaaaaaaaaaaaaaaaaaaacggtccgcggccgccacccgcggtggagctccagcttttgttccctttagtggagggttaattgcgcgcttggcgtaatcatggtcatagctgtttcctgggtgaaattgttatccgctcacaattccacacaacatacgagccggnagcataaagngtaagcccgggg

SEQ ID NO: 77897 - DNA, 775 bp, Triticum aestivum
  Clone ID: PAT_TA_77897
cctcaggagccactgtgctgtgagcaaggaaggcaaggatcataatcagggtgaaaaagccaaagcatgagttttttctctatattgattactatagggagaaggagaaggcaaacggaagaaagttaaacgctcgagatgcaagtaaacaggctaagtggatgtggaaaaagatgagtgatgctgacaaagccccctacaaggcagaggctataagactaagtgcagaatacaaagaaaaaaaagggaaggatgaactgctcttcaccagaagtggtctccacgcccccaccggtgaatgacacggcttcagaggtgatcgccacgcctccagcggtgaatggcacgccaccagctgtgaatggcacacctctacaggtgatcgtcatgccaccagctgtgaatgacacgccaccagctgtgaatggcacgccaccagctgtgaatggcacacctctacaggtgcccaacttcagtgacccgtcttggcttcaggatcttccagcacctccacaggagccagtattcagctttagcggaagttcaatggacccggtgtctatgtatgtttcaactgggccggaagcatcaagcgattcgaagtctttgtttaagaaaggaaaaggtgatggcgtgcggccttcgcccccgtcggtgaacaggccagctgtgaggcgaggtagcaagtagaaaagggagcaagacaaaacttgtgttaccttgtggacgctgcacgtcatggcagccagacagcgtgcgattgagctccactact

SEQ ID NO: 77898 - DNA, 627 bp, Triticum aestivum
  Clone ID: PAT_TA_77898
tcatacctttcgtcaacttgttgaagctgttgcttatatgcattcacgtggtgtggctcatcgtgatctatctcttgaaaatgtcatgcttaataaaggaaagcatggtttagatgcatatgtgattgatcttggagtggctgctgttaatccattaggtcctgattcacccacattcccttgtcctggtgcacgattagcatctgaaaaacctggtaaagctatgtatatctcccctgaattatggtctggacaagattgggaagcctattctaatgatgtattttcacttggtgtcatcttatattgtatgttggttgggcgtcaaccctttaattcctcgattgatgtttgggctcaatttataacatctggtaaatggatgaaattattacaacattgtgcatcggggaaaatttcaccatcatccattgatcctcaaaattataattattgggttgcagcatatcaacatctatcaccaacagtattggatcttgttgctaaattattatgtccgatgtcgaaacgatatacattacaacaaattatcaatcatccatggatgaaacaacattgaactagtgatcaacacacatcacacaagtcaccagattgggatcattt

SEQ ID NO: 77899 - DNA, 443 bp, Triticum aestivum
  Clone ID: PAT_TA_77899
gggcctcaccttgacgtggtgggagtagacgacgacgttgggcccgtggaggcggagccggcgcgccggccctctcccccgtgaccggccgccgcagcacctccgccgtcgccatccccgccggcccagtgggtcagcggagcaagaggcaggcccaggcgagcgagggagcgtggcgggccgaggcccggtggcagatggataagggagtgagagcactcccgtgtcgcttcggcttcctcggctcgccattttgcgtcccattcccttcccccggaccgagccgaaccaaaccaaaccaaaccaaaccgcaggcaggcaggcgcacgcccaccaaccaaataacaccacacgcctccttcccaccccaccccgcccccctcgccgccgccactcgccaccgccgccgcagcggccctcgctccctccctcctcggcgcccc

SEQ ID NO: 77900 - DNA, 492 bp, Triticum aestivum
  Clone ID: PAT_TA_77900
gccttcgaaaatgttcaactctgcaaatggcttcttcaagttttcctccgaaatttctttcatttgtggcattaaatcgctaattttgtacaacaatccatcggcagcctgaatgcttggattacgaaaatggaagtctctcttcaaattatccaacattttttcaaaagtgtcagtagtcgaaaaacgcataatttgagcttgttccccaccacaaactaaacaatcaggagaacgttcaacttcgacaacattgcaagtggctccatcaatatcttgaaagttcaaataattctttaattgaagagccgtgttagacaacaatttaaaagtttccaaaacacatgaattggcgatgattgcattagtcgaagcaacagcgggaataacacgtttcaagacgccgacagtcaattgcatagtaactccattgatgccaaatttctttgctcgctcatctgccttgccaaaaacccatttgatgtgatcagg

SEQ ID NO: 77901 - DNA, 628 bp, Triticum aestivum
  Clone ID: PAT_TA_77901
tcacctcggttccatcgatcaagaagccgtagtacgtgaggccagtgacctatggggaactcgtacagcaacggcggctcgtcgtcgggccacctgcaggcgccggagctgccgctgcacctctgcttcttcctcctcgtgctgttcgtcttcctcggcttctcctggtacatgagctacgagtcggtggcggagaccttcgccgaccagggcaagctcctgctcatggtgtccccgctcgcgctgctcctcgcggtgcggctgctgtcgggaggcgacggcgacgggcggcgcgtcgaccagctgatgtccatgtcgatgccggagagggactccatccaccgcgccggggggtcgccgtggggcgtcgggctcctgctcgtgctgctcatcgtcatggtctcctaccagtccaacttccgggagaggtggttcgcactctagtgtcatagtcaccgggtgatgactgatttccatcggaaccgagatcgggagattgagcaaatgagcatttactacctgtgtaacccgaaatatgtacatggctacgcgcaagcacccgtgtaacccgagctaaggccatttctaacacatcccaataaacagaggaggatacggtggaataaaa

SEQ ID NO: 77902 - DNA, 703 bp, Triticum aestivum
  Clone ID: PAT_TA_77902
atgcggactgcagccggtcggaggaatggcatctcgttcggccaacatattggtggcgtcagcggcgctccgacctccagcttccgagccgccgacccgcgtcttcattttctgcccctgggcagagagcattcgtcaagttcatagaattggccatcgcgctcggaactgcaccaaccccctgaagacgccaccaccgcctccacctcagacgcttcgcctgcggccaccgtacaacggttgcctagttcttctgcagcatgcctgcaccccgctggaccaatcacccgctcgcatcctgtcgacggagagccccgccatcgagaaagacatgtgccggcgccgggtcgccacgatgacgacgacgataatgagtgtggtgcggttagccctgcttcgggccgaagggcaaggaacagagcgcacgaccgctcgcctgacgcgtcgtcccgagactctgttgccgctgccaccctggattctcgcggacgctcacctccgccatcgccgcgcaccacctctcgagacatctcgagatcaagactaccagctctgccatggtctcgcctccgccattgccgcgcaccaccgctcaggacattatcgagatcgagactaccagctctgccatgggctggctctgtggaaccaccgccggtctagatgccaggatccagccgtccttctcgctggatgattgtga

SEQ ID NO: 77903 - DNA, 233 bp, Triticum aestivum
  Clone ID: PAT_TA_77903
tttcgtttggttgttgatgtcacagtgtggctgcacttgaatgccatgacaagtccactccacagcagcgccgtttggtttttcatctcagtggggatctgctttttctcttggatgcttttttgcgcgtccatctcttgtctcatgtctcatatatgcgagcgatcatcactgtcattgattttgtgcttcctttccattttgacattcatacaaccgacatggactattat

SEQ ID NO: 77904 - DNA, 698 bp, Triticum aestivum
  Clone ID: PAT_TA_77904
accaatctgcagtactgcttgtgcctcctcgggtcctacgagaatctcctctctgctatcaagcgcaaatcctacattctctcgtccaacgtctagagggttatcaagcccaacatcgcggtcctgcgagagtttgggcttggtccttgtgatattgccaagctgtgccatgctcagccatggctcctcacctgcaacgcagagcgtgtccgggcgatggtagtgtgcgtcgaaggtctgggtgtaccccgtagatctgggatgttcgggcatgcgctgaatgctgttacatttgtcagcgaagagaaaatcgccgccaaattggagcacttgaagaaaacgttcaggtggtcggatgctgaggtgcgcattgctatttctaaggctccaatggtgctgaatagggctaaggagtttctgcagagaaagtcagagttcctgatctctgatttggggttggagccggcatacattgctcatcgcccggtaatgcttttgtacagcctggagggccggttaaggccccggtgctacgttgtgaagtttcttaaggcaaatggattgctaggtcctgatcgagacttgtattccgcagtcgcattgagtgagaagttattcatagagaagtacatatgccctcacaaggaagctgcaccctgcttagctgaagactatgctgatgcttgcaaagggctagt

SEQ ID NO: 77905 - DNA, 603 bp, Triticum aestivum
  unsure (1)..(603): unsure at all n locations
  Clone ID: PAT_TA_77905
cgcgccctcctcaaccctgtccagatccaggccgtccctgtcggatccatgtcgccccgccgcaagtccctggagagttgccgccgcactttcttcttccaacgcgagggagcagcgctcaagcgcagcgacgaccgctcgccaggatgcgttgacccgcaagccccccgctcgcctggacactctgctcgtcgcgttaaccgcactggttcgcgcgtggcacgcatcacacctagccactgcacgcccgctcgcctgcacgttgcgccgagggcccagccccagttgctcatccgcatcgagaccgaaggagacgaacgcttgcctcctgttcatctacgcatccacgaccgaggacgaagccgtaagctcgctccaacctccccgcccctgatctcacacctctccgcggctgggctgttcgtggcagtggggcggcggctgggctgtgttttaaggggggccacgccgagatccagcctcctgcctctcgcgcctcanacaagcttcgctccggtgtccgtcgagtgcacgccgtgctccagccggtgccccgcctcggcgcggacgcccgccgcagcgccggcggcgcgtgccccgcgg

SEQ ID NO: 77906 - DNA, 174 bp, Triticum aestivum
  Clone ID: PAT_TA_77906
atgagcagctcttatggcggcgtgtgcagcggcggcaccatgagcggtttcctgggctcctactactcgttcccgtcctcctccgtgtcggtggccaccgtgccgtcctcctcctcggcctcctctgcgccgggccactactactcgtcgccgcacgactcgcagcagcagcag

SEQ ID NO: 77907 - DNA, 755 bp, Triticum aestivum
  Clone ID: PAT_TA_77907
aactcttttcctatctctcctcttactctccctttctctttctatctcctgcagaaccgcagaagagtggagaacaagatctatctaccagatcatcacagatagatttgcccggacagataaggaagcaaccccatgctccgacctcgggaactattgcggcgggactttcaaaggtatcgaaaacaaccttgactatattcaaggtatggggttcgacgctatttggatttcccctgttgtcgcaaatactccaggcggatatcatgggtactgggttagtaacctctacacaatcaacgaagaattcggaacagaagaagaattgcatcaacttatcgaggcttgtcacgctagagacatctgggtgatggtcgacgttgttgctaatcatattggatatgtacaaaaccttgacttttctgctattgttcctttcaatgatattgcttactttaacgaagataaagactgtgcaccgttctttgagatcatggatcaagatggaatcgaaacatgctggctgagtggacttcctgatttgaaccagaatcatccattcgtaaaatccactttgatcgcctggatcaaagaattcgttcagaaacacaaattcgacgctcttcgaatcgacacaatcgctcatgttccaaagcaattctggcacgaatttagcaaggctgctggagtgtacacaatcggagaagcactgaaccacaacatgcactacatctctcaataccaaggacccttgg

SEQ ID NO: 77908 - DNA, 720 bp, Triticum aestivum
  Clone ID: PAT_TA_77908
gaggccgccgccgcctccacacaaatggccgccgccgccgccggactccacatggcgaccgccgcgcgtcggaggctttccctaggttacgaatcctgcatctccttcttctccaaaggcaattcgccccccctgtcgccgacatcgacaaagatctccgacctatggtcctccttgtacggcttctccggtaacagctctatcgtggtgatgctcgccgcgtatctctgcaacctccacacgccggtcagcttctagggtctgtggctccagttccagtaacccaagctgcaatgctgctatgctggtcctgaagcgggcgttacatgggtcctggggacctcatcattctggatcgcattactaccatggggaacctcagaggataattgctcccgtctggcaaatctcgtaagtaggccatttttgcatctaaaatatagcttatgtattcgttcgtgcgctcttttggccttttgcctctcctttgcgtgactcacttacattcaatcttgaactggatcggggtgatgtgtttggatgagttctgcgatacgtttccaatctggaaagaaatccagcacaagcccttggtgaggtcgacagataacttgcgtgtactgagtgagccgtggaggtggtttgtgaagtccctcaacactgttggatcgttccatcactgctatggagtcaccgcctgcccctcttttacaaaagaca

SEQ ID NO: 77909 - DNA, 486 bp, Triticum aestivum
  Clone ID: PAT_TA_77909
ataatgggatccatgcaatggctatctcaaaagggaaaaggtttgtgtgcagaatatgatggcaagtgtggcatcatcagtatattcgcattgcaaattgatcacaacacggatccagttgatctaataatatatctgtttcccaagttcagaacaaatgcagacaccgatgaaaaacatgaaagcccagcaagatttgcagacacgaagatgtgtttccatgacgagaattgttgtgaggtgaccttgaatgattctcaaaaagaaaaaaaggacccttcaatcatggaagcagaagatactcaactagataacaccctgatcacacactcacatttcattgtaaaagcaaaagggtcaagatcgatgaaacatgcaagaatagatgtgatgatgaaaacacaatgttcaccacagttgataatgggagcaatggactggctatcccaaaaagcgcaaggtttgtgtgcagagtatgatggacag

SEQ ID NO: 77910 - DNA, 279 bp, Triticum aestivum
  Clone ID: PAT_TA_77910
atgccgcacgctagcacgctaggtatcgagtagctcgtagcgtagccgtgcgagggagggaggtgggtcgatgcccgcggccgtgcaaccacagcaaccgcgagccggtggtgttcgccatggggaataagaagggcgggtcgtcgtggctcaccgccgtcaagcgggcctttcgctcgccgtccaaggaggacagccccaagaagtctgcacgcctccgcgaggaccctgacgccgacgaggacaagaccaagcgggagaggcggagatggctcttca

SEQ ID NO: 77911 - DNA, 519 bp, Triticum aestivum
  Clone ID: PAT_TA_77911
cgcgccgccctcacctgtcgcgcctctctccgcgccgtccgctcatcccccgccttccgccgccgcttccgcgagctccactcggccccactcctcggcgtattcctcgacgtcttcgagtccgacactcccgctttccgcccgctccgcctgcattctgacccggaccttgccgcggccgtccgcggcggcgatttccacctcacccgactccccgacgagatcgagggcgtcgcccccgagtggttaatccaggactgccacgacgggcgcgtcgtcctcgccagctacaaaaccgggcacatggccgtctacgaccccctcacacgagccctggatctcttccccaggccgcccggcgagatctgcgaagacatgtacgtcgagtaccacgtcctcccctccgacgaagaacgcggcccgttccgcgtcatctgcgtctgccacgaagcttgcggtgcgcaagccgccgtcctctcatcagagaccggggagtggcaggtcttcccgtttgtggag

SEQ ID NO: 77912 - DNA, 234 bp, Triticum aestivum
  Clone ID: PAT_TA_77912
ttggtaccttcctagttctattgggaatttgagccacctccaaacactggatatcaaaggcacgcatatatatgaattgccagcaactatcaccaagcttcgcaagctacaatacctccgtacaaccggtgttcctattggcgcagaaaaggaggatgccatgtttgattatgagttagttcaaaggtccataggctgcagacttttggtatttcagcaggccatttttttgct

SEQ ID NO: 77913 - DNA, 308 bp, Triticum aestivum
  Clone ID: PAT_TA_77913
tctccctcttcttcctcccaagaatccctgcggctcaagcaaaggagggaagcaggggcggttgccagcagcaccggccggccggcgcaccgaccccctcccgctgtatcgcggggctcctcctccgtgccggcgatggcgctcgaggaggccgcgccgggcggcggcggcggcggcgggatccgggtgctcctgcggcggaagcaggtggactccgaccgggcccgcgccgccggcggccagcagctcgccaaggagctctccatcacgcagctcatcgttatcggtgttggttcgacggttggagc

SEQ ID NO: 77914 - DNA, 519 bp, Triticum aestivum
  Clone ID: PAT_TA_77914
cgaggctctcctcttcctcagctcccttcccgggtcgcctccaatggcgtcctccctcctccgcgcctcgccgctctccctcctctcccgcctgaggccgctcagccgcaggcctcccgcctcgcacctccgctgcctcctcctgctctccggctccgcctcggccccctcacgctccacgcccacgccccgaaccctagcggccgccaccgatgcggcgaccccgccggaggaggcggcggcgccccccgcggccgaggcgaggctggagaggatgcagcctctgcagtggccccagcgggacgcgctctgcggcgagctcggggcgggcgacgcggggcgccgggtccggctctgcggctgggtcgccctccgccgctcccacgccggcctcaccttcctcaccctccgcgactcctccggcatggtccaggtgacgactctgccagaataccctgaagtttacgctgttgtgaacaagctgagagtggaatcagtggtttctgttgagggggtggt

SEQ ID NO: 77915 - DNA, 662 bp, Triticum aestivum
  Clone ID: PAT_TA_77915
gcctccaccacgtcgccggcgccctcccacaccgcgcgctgatgcagctgtctcgccggcatgggcagctgatgcacctcatgctgggcgaggtccccgcagtcgtcgtgtccagccctgaagcggcggcgctggtgatgaagaccaacgacctcgcgttcgcgggccggccgcgcggcgtgatgctggatatcttcagcagtggcggcaggggcatcgcctttgccccctacggcaaccatctgcgccaaatgcgcaaggtctgcgtcatggagctcctcagctccacgcaggtgaaacgcatggagggcatcagggccgaggaggttggcagcctcctccgcgacatcagggccgctacctcggtcggccacaccatcaacgtcagcgagaaggtgagggcgctcagcaacgacgtggtgaccagggcggttttcggcggcaagttctcacagcagggcgagtacctctgcgagttggacaaggcgtttaagctgctgggcggcttctgtctcgtcgatctcttcccgtcgtcgaggttggtaaggtggctgagcaatggcgagcgccagatgaagaagagctgtggccaaatgcagcgcatcatttcagagatcatcgatgagcgcaaatccgcgcgagctgctggcgttggcatctcc

SEQ ID NO: 77916 - DNA, 606 bp, Triticum aestivum
  Clone ID: PAT_TA_77916
tgcttaagccccgcaagttcgacattgccgattccaacatcgccaacctcggctctgacctcgagaagaaggtcaagcacgccgctgccgagactgaggatgcctggaagggagccggccagcagatcggcatccagatttggaggattgagaagttcaaggtcgtcccctggcccgagaagcagtacggaaagttctacaccggtgactcgtacattctcctcaggacctacaagaagacccccgactctgagaagctgagcttcgacgttcacttctggattggcagcaagtccacccaggacgagtacggaaccgccgcctacaagaccgtcgagctcgacgactacctcaacggcgacccagtccagcaccgtgagatccagggatacgagtctgagctcttctgctcttacttcaaggccatcgagttcctcgagggaggagtcgacagcggcttcaagcacgtcgaggccaaggagcacaagaaccgtctcctccacctcaaaggcaagaagaacatcgtcgtccgtgaggtccccatgaccaccgactccctcaactgcggagatgtcttcgtcctcgatgccggcctggacatctacc

SEQ ID NO: 77917 - DNA, 369 bp, Triticum aestivum
  Clone ID: PAT_TA_77917
ccgaaactcgtcgtcccagagggcatctcaaagaagcaatataaaaagcagctaaaaacggagaggtataatgcagaaaaagctggtacgccgggcggaggaaaagctcaagcgaaaagagaagaaagcgaagctaaaagccgagggtcgcggaaacgagctggctggacggcgaaagcacaataagatggcaaacagcacatccaagcaacgaatcgctgtggacatgcagttcgacaatctgatgattggacgtgatcagaaccgaacaatcatccagttatcgtggtgctattcgataaatcggcgcgccgacaacccgctgcaattctacctcgcccattttgacggcgaaagcaaaaagtattt

SEQ ID NO: 77918 - DNA, 711 bp, Triticum aestivum
  Clone ID: PAT_TA_77918
cccccgccgacggggcgctgaccgcgccgccggccgctgattgaagtgcttggtgggaatgactgagatgcagagaaattcagcagagcggtgggttactcaaatggtcaggaaatctcagaaggaagctctcgggactgttacgggacaagacagtactgatgatgtaggccctggtggcgataccacttgctctgctggtgaaaataggtaccctgattggcctggaactacagtcttcaggatgctaatttctgctacaaagctcggtccgataattggttacaaaggagagagggttagaagactgtgtgaggaaacaaaagcatgtatccgtataataggtggtcatcttgcgggggcagaaagagctgttatcattttcgcaaaggagcaaccagatgaattaatacctccagccatggatgcactattgagagtatatcagcacataatttatgatgatggcttaaacatgggatctgatagtacagttgtggcacggatccttataccaagtgaacaggcagtgagccttattggggagcaaggtttgatgatatattctatcgaggaagcttccaaaactaacatttatgtccttgattgtgacttgccgcctgttgcaattgaagaagataggattgttgaaatatggggacaacctgcacgcgtgcggaaggctttggaacttgttgcttctcatttgag

SEQ ID NO: 77919 - DNA, 690 bp, Triticum aestivum
  Clone ID: PAT_TA_77919
cgttctgcaattatctttcattaggaaccaagacggcaatcctccaaacttttcagcaatttcctatgttttttcgcatgtaggcataataaaaagtttatagaaacactatttaatttttaaggcctccttaactagtttacacatgttgttaggtatatgtatatttttaggaccataaatatgtgtttttttgaactgaaatatgtgtttctaaacacacaccaaagtatatttttttacggcataaggatctaaattcttggcgtcggtatttgctcaaacaggagattactaaaaaaaatacatgtattttcaaggtggcataattttgaatggggctttgtgctaccaaactaaaatgtgtacattcatctcattactctctctgttcggtaatataagtcttttttagaaatttcaatatggattgcatacggatgtatatagacatagtttagagtgtagattcacttattttgctccgtatgtagttcatagtggaatctcttaaaagacttatatttagaaatgaagggtttagacaacaagccactgttttttctcttgttaaaggaaattaaatttgcttcatatgtgcttgcccacaactaataaaccaattaaatcatggattttgttttgaatacaactctgtgctaccaaactaatatgtgtgtctacatctca

SEQ ID NO: 77920 - DNA, 648 bp, Triticum aestivum
  Clone ID: PAT_TA_77920
gagggtgctcttgccgtgaagacctcgtctttgggcatccatggggttcctcagcctcgtgggcaactccttcgggtgctcggcctccggcgagcgcctcgtctcagcggcccgggacggcgacctgcaggaggcgcgcgcgctcctcgagtacaacccccggctggcccgctactccacattcggcggccgcaactcgccgctgcactacgccgcggcgcagggtcaccatgagattgtttctctgttgctcgaatccggtgtggagatcaacctcaggaattacagggggcagactgctctgatgcaagcttgccaatatggccactgggaggttgttcagacactaatgctcttcaatgcaaatatccacaggacagattatttgaatggcgggactgctatccactttgctgcgctgcatggtcatgcccggtgccttcgtcttgtgcttgcagattatgtgccaagcatcccaaacttcttaaaccagacgaaccacagatcgactgaagaagtttcagatgctgattttgatgatgatggtttggtcaagatggtaaactggaaggcagatggaggcctaaccccacttcatatggcagcgttaaatggccatgtagagtgtgtacagttgttattggacct

SEQ ID NO: 77921 - DNA, 741 bp, Triticum aestivum
  Clone ID: PAT_TA_77921
atccccggtcatctcaactgtgggattagcaagcaatacacacccgccccacaaggcaggcgaaagagagcgtctgtctgtcagatgcatcaagacaagaagttgcagggtgcgtgaagagcaagaagaacacaggacaggagaaagaaagaaagaaagaaagaaacggtcaagccgcctgctctgctctgctcaagccggtctcttttgtgctgtaaaacccagtgccctgaagcaaggcagccaggagcacaaagagtctccctactgggagtgggagatcgaggcagcaagactttcggcttggaggtcgaggatggaggaggccagcagcagttcgggccatccgaggcacaggggccctcctcctcatcatgttcttggctatggcggcttccatgccgccatggccatgccaaccaactccatgcctcccgcagccttcttcagcgagcaagacggaggaggaggaggcggcggcggcgcctacttcggggagctggaggaggccctcatgcaccaggtcgccacgctcagcagcaacggcaggatgatttcgcattcccattcccagcaacaaactgcaacggccacctccacggatcatcctcatcaccaccaccaccaccaccatggacacaaccacgccatgcccttccccagtactgtggctgatactgctacagcggcagcggcagcagctaggccgcctcccacactggacatcttcccctcctggcc

SEQ ID NO: 77922 - DNA, 725 bp, Triticum aestivum
  Clone ID: PAT_TA_77922
ggcacgaggtacgactttacaagattctaccccgacatctgttcaccctgtcacctcccgatctagcaggttacctgatagtaacaacgtaaacgatagcgacgttcgagttctacaagcattaccgtcgtacacctaccatcaacatggcgtccgtgtcttccctggataaggatcttgcgaaactccggctggggaaatacacggtacaagcttcgaacgaagcaaaatcatggatcgaaagcactctcggcgaacagctgccagctgatgacttgatggatgctctacacgatgggacggtgctctgtcggttggcgaacaagttggtgccaaatagtaccaaaccgaagaagtccgagatgcccttcgtgcagatggagaatatcgccatgttccttaaagtctgccaagacgtactcaagctctcacagcacgacctctttcttaccgtcgacctctacgatttcaaggatccagcacaagttcttcaaacaattggagccttctctcgaatcgctcattctcaaaacccctcggcatttcctactgctatcggcccgaaagcatccgtaatatctccctctggaactggcaaatcgaaaccaccagtccccgcaaaaacggccgtttcctcttggtctaagcccgtcgatgagcttacaaccgctccggcatggaatattcaccaatatgggtacatgggtggtgcatcccaaggaaca

SEQ ID NO: 77923 - DNA, 728 bp, Triticum aestivum
  Clone ID: PAT_TA_77923
acgaggccactctctactcttctccggtgcagatttgcagcctccggaggctactggaagccttgtagcctttacctgtgagtaatctggtttcttttattccattcccttgcttgttctacttggtaaagttcatgtagtttcagagctcaccttagcttccgcttaagtttgtgtagtttcattgttctctgttgcttagtttggatcggtttctccttagaggctctttccctctgatgctaggggaagcaggattcaagtccgagagctagattgccaaattttaacagcgctgtaaaccttactgtagtggggctgagcaacccctctcctccgctctcgagtgctcccggcatgcctcctagtgtacgagccggcggccctctaacttggtatttcacctacctatcaatgcaatgatacgcacccaggcgtattgcagaaaaagaagattgccaaattttagttcttgcctttttgtaaattgatgacttgctctagtattttaaagatactttagaatcaataatgtagagaaacatgcgtcagaagcttgatcttgtgtggaagtgtctttttgtatgttctgctcgcagaaggtgtttctgtgcagcaacagtttcttctttgtgcgaattgcgaaagcaaggaattccctatttgccgcttgtttcgtagaactatcgacgctacgccgctagcaatccgatctgggccggcccatt

SEQ ID NO: 77924 - DNA, 760 bp, Triticum aestivum
  Clone ID: PAT_TA_77924
ctttgtttgatgttgttatcgatgaagctgcacagtaccgaatggatcctgacattagcagattcccaccgtatgaataaacagctggatggtgctcagaagactgagaaatcaggttattctatgatcacaattgtcttggtccattcatgttcttcgatattgctgatggtcgtaagcgttgtggaaccatgattttaaatagcatgacatagcatttagaagaggtccgccgccaagagtcatagcccgctatatttaaaactatgtgtggaacaaatgctgctgcacagtcactctgtaatcaattagaaggtgatgcagcacttgaaatactgtcatctttaaagaacaagggtattgtctttgctttcatggtttcgccacctacttgagatggtcttattttgcctgcctacttgaggggcggtcttattttgcaggtaactgaggtttctatacttgctttgtgaacagatatacatcagatttctcctgtagaaagatattagggatcatagctccataaacaagtcaactctcttagctgtgcttgaggttcaattttttttgtggcttgagattgttgctgagatggaaatcaatactgtggatggatttcaaggtcagtaagttgacatcttgtaccagagataaccttaattaaacacagcatgtgcctgatttagcctgcgttttctgttctgaaacagaaacttgtggtcacctgtcttttaatgttcagttactctggaggcga

SEQ ID NO: 77925 - DNA, 776 bp, Triticum aestivum
  Clone ID: PAT_TA_77925
tcggcacgaggcagattagtaccatccctcttctttttgtttgtgtatcatcaatctagggtttgtgcctcaatcgactctaatgtgggcagggttcctcacagattagcaccatccctatatttgtttatgtattcatctatctaaggatgctttgcccagattgctcttcacactgtcagagtgcaaatggccgaagcttcagcttgcatcttcatgatgccgatgaaacctttgtggttatctgttgactcacaaataggtagcctttttctgtactgttagaatctgcatgtttttttttcatttacaggggtgtttctgcatgttttccaaaagaagagtacaggatctttttttccctccaaatatccacctatcgttatttgtgtggctctgctatgtttttcgcctgcaccgtttgaatcggtgggggagagagacagaagggagcaaagaagagggtgagaagctccaagacgatggcatgtgacgtcgccgccgccgagatccgtggcatcgggagcatccccgaagacttcacgtccgccgttcccacggtggtcgtccagccctgcgcgcccgacgagcaccgcggcatccgcatcttcaccgagcagtctgcgaccgacgagcctcctgctatgggcgccgctcccgagctctgcgccggacgctccggtcaagaagcttgcaagcaaagatacaaattctgaccagttgtagttgaacaacaataatcaacgacatgactcaggaaatgacagtatgactga

SEQ ID NO: 77926 - DNA, 691 bp, Triticum aestivum
  Clone ID: PAT_TA_77926
gaggcgcctcctctctcctcgcggctgcctgctccgacgcctgtccacggccgccgcagcctcgccccatccaccgcggcgcccgctggccgattcactctaccgccgcgtcactgccgtatggaacccgcgcctcccgctgactcccgtgctggagcaatgggcggtcacggagggccgggccgtcgagaagaacagcctcatgtccatcgtcaagcagctcgtccgcctccgccgcttctcccacgcgctcgagctgtcaatgtggatgaccgaccggcggtacatgtacctgtcgcctggcgacgtcgcgtaccggctggagctgatcagcaaggtgaaaggcctcgagagtgccgtgaactactggaagggcttgtcgatccaggtgaagaactctcattgctacggatccctcctgaaatgctatgcggaggcaaaatccgtcgacgaggccgaaaagctcttcgcggagatgcatgacttgggaatgatgagttcatatccttacaatgtgatgatgaagctttactgggagaccgggcaggttgagagggtgcacgccatgtacagggccatggaagagagcagcatcaagcctgatgtattcagtatcaagcattctgttgacggtgctcgcagctgctggaaattttgatggcattgaggaaattgtcaagaaggtcgaccc

SEQ ID NO: 77927 - DNA, 779 bp, Triticum aestivum
  Clone ID: PAT_TA_77927
tgtcctcatcatcgtctgtccaatctgacttgactcctgttgaaacagacgaagaggatgtgcaaggttcatctattacaggccatctggtggagtcagcgttagcagaactatcttcacatgccacagaatatgtagaagaatctcgaccagcacgaaaagaaacaagtagattcagtttagaggatgatgtagtgggaagtaatgaagtgagcgaaccattggtctctgaactccccgttgctgttgaattgcagcgatcatttgataatcaggcactcaagactatgctcagtaaaccttacctagagcatatgcaaccggagaagaattctgctgataatcgagcttcaacggatgaagacatccgagcagatgctgcagctctctgccagctacctaaacaactgacagctgtgcaaaatgcagatgtatatgattctgtattagctgaaagtacctcagaagttgaagctgatggagtgaaagtcaatgctagtgtggagtctgtaatcactgaaagtagggaggacatgggagctcatgaagaccttcaagggcctccggagtcttgccttgattgcactacaggaaatgtagctgaaaatgtcgaggctgctgaaattgacgatgttgagaatattaatagtacatctcattgccaatcaattttagaagcttcatcagatggtgaacttacggagcaatcaaagtctgtgctaactgattctaatctacaaaatgatgagttagcaagtgtccataacaatggctccttc

SEQ ID NO: 77928 - DNA, 688 bp, Triticum aestivum
  Clone ID: PAT_TA_77928
cgagggctaatctaactgagttgacccttcgcgccactgaattggaatctgaggagcacctgaaagttacctctcagttaccaagcctgctctaccttaggttgcatcacagtgcatacaccggaagagcactcaccttctctgcgtcagagttcccaagtctcaaactgctcaccattcatctcgccgtataccaggcattgaacctgaggtttgaggaaggcactgcacctaagctccataggctggagctatctttcttcgaaaatgcttccatccggcagccttcaggtatcaattttcttgcaaatcttcaggaggtcttggtccacgctgatccatgccataactcggaagctatggtgcactatttgaggaatgaagctaggaggaatcccaaccaacctactgtcactttcaaggcgaaacaatggaagtcagcacggacaggtccagcaatagattacagaggaaacatctggttttgataatacgggcaccgctgaacatgcgtgagctgtactcttgacaggattcagaatttccgacacgtcaatatttggttaatcaggtctcaagtgccaatagccaaatctttttttttgtttctggtgatctgtacagatatgtggacatcaaggatgagttgttgagacggtttaccgtctgtcttttcttctccaatgga

SEQ ID NO: 77929 - DNA, 664 bp, Triticum aestivum
  Clone ID: PAT_TA_77929
ttacctgaactaaatgtgacaaaatatcttaaacaagctctgtgatttcctatgctctcttatattatcaaagaaaaaagaactgctcttatattttatttgttagttcctttatactccaaaagaaaatagaactgactaacaaaactctgttgatgatgaataatgcagtgtatataattctggggccccttttctttcatttgttgctcagttagcttgttgttcttacctgctgttctgattttgttttctgggtgctgtataggatactatggttaaagattgctctgatttatattgattttgttgattatcaaaatcagtggatattatctagggtgcttctcctttggatttgatgtactatgtctttccagcttatactagatgatttcttttcatggtttttgataattatggatatgtatctaataatcttattttggcgtcaacaaattactcatctagcatttcttctattacagctctgtatctttttctttacatggttactgcactattgaagtagttgattctggactctttccattttaccttgcttggctgaccagagcccaaaaataacatttaggttctggttgttttgattgagtaagtgacacctaactgtcattgatttctgggattgttcattatcttg

SEQ ID NO: 77930 - DNA, 724 bp, Triticum aestivum
  Clone ID: PAT_TA_77930
attgtttattttgacgaaactgatttaaacaactgtcagggttaccaaggctgtctttcttactctagttatatttgtaccgacgacggtatttacaacgctacgtttactgatccaatcggacaatctacagtgattaattcaatcaacgtgacgctcaaaggtatgactggttgcgactatactggagagtcaagaactattaccttttacctgaacaataaagccattggatcatggagtgctacaaatgtgtcgtacaactgttactgcgatgatccatgtgatgcaaatccacccagtgtattataccaaaatactggaagtctaaactataattttggtgctagtaatactcttttcatgtcaatttcatgtgatggctgcgatgcctgctattacggatacaatctgactataaattatggctcgtcgtcttcgtcaatggacacttgttgctactacgtaaatcaacaaaacgcaacgcttactcgctcgttatgtgcagcaccaaaagcacagtgcccgtcaatctcaaacttccaactagttacaagtacaccagtttctgactgttcacaatgcacaacttcaccagtatgctgtttgtacgaaagtagcacagatccaagcgacactgaggctgaatgtgagggtcctggaactgcaacttgtccttcgaagcaggttactcagtcatttctcaattcgatgttcctgactg

SEQ ID NO: 77931 - DNA, 421 bp, Triticum aestivum
  Clone ID: PAT_TA_77931
tcggcacgaggcgagatcgtgctcatcgacgacgacctcaccggctgcatcccgccgcaggtggggatgctcaggaaggtgaccgtgttcgatgtcagcggcaacggcctgcagggcccgctcccggccaccgtcactgggttggtggccgtccaggagctcaacgtcgccgggaatctcttggagggcgcggttccggcgagcgtctgcgggctgccgagtctgaggaacttcacctacgaggacaacttcttctccggccggccgggatgcgccgtggcgacggcggacggcaggtggaactgcatcctcggcgctcccgcgcagcgcccgccggcacagtgcgccgcggcggctgcccgcccgttcgactgcagcagggcacaatgtcaggcagcaccaccgccaggcaggcgcggag

SEQ ID NO: 77932 - DNA, 380 bp, Triticum aestivum
  Clone ID: PAT_TA_77932
ggaatgggtggcgtgggaaagacagggatgttctacggagaaggagaaatgtcgcgggaagacgtctgaagatggatagcctcttagcgtctcgacatgaagcctttcactaagctcaaggactatctccctgacttggatggatggaactacatgttagagtgattgtcgatatatgacattgtgtccgtttagtccatactttctgtatgacaaaactttgagctatgcacggtgtaactttatttgtgatgtaattaaaccatcctcctcctcgacaagcgaaaatcactctagttagggcattttggggtacgataagctttgttatttatgcttatgatatgttgtttctaattttgcccacccctcccattcca

SEQ ID NO: 77933 - DNA, 480 bp, Triticum aestivum
  unsure (1)..(480): unsure at all n locations
  Clone ID: PAT_TA_77933
cttaaacgaattcncccttggaatgggaggggtgggcaagactatggcacgctccaagacgcggcttaaaccgcactaggggcttcccactctgttatttttctctttcaggactttaatctctgaaaccctgtccggcagcatgattgccgaacacatgatgcagcaaccaaggaggcagaaagctacgtcacaccacggaactcccgggtggattacgataacgagtcaaatatttgccttaatactattcctcagcttgcccttggaagggacatgtcaaacagtcctactttttgcttatcgcactacttgtatcattatgttttaacgcacctttttgaataaacaatgcatagcattaagactattattgcattcttcctttttatatatatgttcattcacgacatctagcacccatagactctggtacggccaatacgctaggggcttaagcataccccataatacggcgtg

SEQ ID NO: 77934 - DNA, 382 bp, Triticum aestivum
  Clone ID: PAT_TA_77934
ggaatgggtggtgttgggaaaacagttcccagtggggggttggatgaacaggaccccgtggtgttgccactagatgaacaggaccccgatcgatcgagccggttgggcgtggatgaacaagaccccttggagggctacatgaacaggaccatgtggagggaaggttgaatagtagtcggtggaggactggttgaacagtagccggtggagggctggataaacagtagtctatggacgggtggttgaacaggatcccgtggagagggctagttgaacagtagccggtggaggagcgcgcggtggaggctggatgaataggagcccatggatgaatagtcactggtggaggctggaggaggtcgacggtggatgaacagtagcc

SEQ ID NO: 77935 - DNA, 438 bp, Triticum aestivum
  Clone ID: PAT_TA_77935
tattccctcaagttctattgaccaccgatacaactctacacacacttgacgtttgctttaccaagaacaagaataaaactagaagtactttgtaggtgtggataggtttgcaagataagaaagaacgtgaaaataaaagttaggtgttgttttaataaaagttcaatttaataaagcgagtgtggaaaagtggtgataggatttgcggaattgtccctaggcaatcaataactagaacggtaatcattcttgcaattttatatcagggagaggcatgagctaaaatactttcattacttggatcatacgcacttatgattcgaactctagcaagcatccgcaactaccaaagatcattaaggtaaaacccaaccagagcattaagtatcaagtcctctttactcgggtatgtgcatctttcctactccccccattcca

SEQ ID NO: 77936 - DNA, 480 bp, Triticum aestivum
  unsure (1)..(480): unsure at all n locations
  Clone ID: PAT_TA_77936
acattcatgcggcantatccatcaatagtaagctcttgtatttcttcatcgnctgtctttgtatgtgcttntctctggacgacacctgtagncattgcaaagtcanccgtcccaccaacaatagcccattcgtntgatttcccaagagatgctcccattatttgaanagtggaccctttgaacctttcaacctctaacaccatggtgaaccgattnngccantcgcnagaatacgtgtgcatgccttanncataggcaaccagctttgcctccgaacccgatgccacgtatatttcccaattgttaacagcagttttacctaaccctgtaacagtatnngcctctattacgtctgatcgatncctgnccnaatatctgggnacaaatacaacttgccgaagtcaatntatagcnntgtgtacctcggncgacancangctaagacaaaatctgnttatatccnncacactgggnngacgg

SEQ ID NO: 77937 - DNA, 716 bp, Triticum aestivum
  unsure (1)..(716): unsure at all n locations
  Clone ID: PAT_TA_77937
acgcgggctataaaatgaattttttcaactaatcataaagatattggaactttatattttttatttggaatttgatcaggtataattggatcatctcttagaattttaattcgattagaattaagacaaattaattcaattattaataataatcaactatataatgtaattgttacaattcacgcttttattataatttttttcataactataccaattgttattggtggattcggaaactgattaatccctttaataataggatgcccagacatatcttttccacgattaaataatattagattctgattattacctccttcattaataataataatttgtagattcataattaataatggaacaggaacaggatgaactatttatccaccattatcaaataatattgctcataataatatttcagttgatttaactattttttctttacacttagcaggaatttcatcaattttaggagcaattaattttatttggtacaccactgcctcacttgacaatatacgtgggagaatatccacaaagctatgcattggaagttgattcgggtgtatacgatcctaaaggaangttttcttccccaaaagtttgaggaattattcaaaacatattgcaatactnccgaccanatgcgttgacacttgcanaaatgcattgcgatgctccttggctaacgagatctanancccgatatn

SEQ ID NO: 77938 - DNA, 531 bp, Triticum aestivum
  unsure (1)..(531): unsure at all n locations
  Clone ID: PAT_TA_77938
actatgataaaaagtttagtctagttaactgtttaactacttatattaaactaagtattaattaggtgttagtctagtgccgtatcccatactatcttacccttcctttgcatcccactcaaaaaaagagggcgctccggaggcagaaatagaactcgccaagagagctccaaaaattgggtattaactgagacaaacaacgggcaaactgtttttaaagggaagggagaggtagactgtccctttcgtttcatttttattttctgcagggtagggagaagccttgcgccttctttttttgaaggcaagtgacttcgcaaactgctcaattttgccctctagggccgggagctaatgaataaaaaagggttggatacgcccctctaccatatctagagaaatagaatactccttttatacagactgctaagtgcggagacgggaatcgaacccgtganctcaaggttatgagcctcgtgagctaccaaactgctctactccgctctgtagtacctcggccgcgaacacgct

SEQ ID NO: 77939 - DNA, 198 bp, Triticum aestivum
  Clone ID: PAT_TA_77939
cgacccacgcgtccgtggtgggccggagtcgcaacagctttcagttactttccgatgagaggccgtggagccgcgaattcggccattgtactgtgaaaattgctgaattggtttgtgagcgggtgcttttcgtggtgacagacactacctgcttcctgcttcctgctgggcttggtctgggcagtggccgtttactgt

SEQ ID NO: 77940 - DNA, 503 bp, Triticum aestivum
  Clone ID: PAT_TA_77940
cccggtcgacccacgcgtccgcgccacggcgccatggtgaactcctcgacgtgcggctacgccgggtgcgtgggcgacgtgaacgcgctgtgccccgcggagctgcaggtggccggcaaggagggcgcccaggaggggaggacggtggcgtgccggagcgcgtgcgaggcgttcgggacggccgagtactgctgcacgggcgcgcacggcgggccggacagctgcgggccgaccaggtactccaggctgttcaaggcggcgtgccccgccgcctacagctacgcctacgacgatcccaccagcaccttcacctgcggcgccggagcgcagtacctcatcaccttttgccccgcgcagcagtagtccggccgttcgattttggctagcagtgtcgttcgctcatcgttatggtgtctcgatttttggttagtatcgttcatccgaattacttaccagatgtttattggtttggtcgtgtcaatatgtatacttttgattcatta

SEQ ID NO: 77941 - DNA, 338 bp, Triticum aestivum
  Clone ID: PAT_TA_77941
cccacgcgtccgaccaaacgcccccccgttccatccctcccaataacaccaccaccaagcaagatccaagccccaagatcggcctggcttcctcggagcaagagcagcatttgtagagatcggtggagctgcggcggttggatcagggagagggagggagcggcgtctgggtgcctgtggtggaagtgcaagtggttgcgctcgcttgcgcaggagtgagggtcaagttcccccggagcttttctttctccttttcccttttcaccacaccatccacctgaaacccatctccatctgaatcccccaactccatccatccatccatccatcctccatag

SEQ ID NO: 77942 - DNA, 489 bp, Triticum aestivum
  Clone ID: PAT_TA_77942
cgacccacgcgtccggcatcgagttgcttcctgtaccaacccgcctaggtgccttctctgttcagtttccggccacgtctccagccagtgtgagctgagatcaggcgccccaagcagcttccgccggctgcccggccgccgccggtcatccccgccgtcccaggttgcccgtcgtctctgcctgccggtgcgggagttcctgggaacgccgctaccagcgccgctttcctcgacgcggtggtagctgctcccgccgcaatggtgaaccctgtgagtgatgtcagcctccgccccagtatggtgtcggcgtcggttccctggacgccggcgctggcgggcgcggagcgcgactttgagccgcacgcggtggtggccacggtgctgggcaacaggccgtcgttcacggtccaggacgtctccgttgcttcctcgatgcagtttggcatcacccgcgacaggatgcacgtccccgtcttctcttcgggggga

SEQ ID NO: 77943 - DNA, 300 bp, Triticum aestivum
  Clone ID: PAT_TA_77943
tgtaacggtcatgtttcgaaaacgatttgatttttcttgtcaaacttgccatgatgcgtgacacaaggtgtctcagctcgagctcatacgatctcggatgacagtaaaatccaaacaaaatcattaaaaatactgattttttttctttgtggcaaacattgaaaaatgtttgattgttggcaaagtgtagtcatggaatgacatttctagaggtcatgtaaaaaaatgatacttcaaaaatgccattttcaaaacatttgtcaatgtttgccaccaagaaaattaagtttttttgattaa

SEQ ID NO: 77944 - DNA, 531 bp, Triticum aestivum
  Clone ID: PAT_TA_77944
atcatgtcaaaatttatggtgaaagtgagcgcctgttgggatctgttttttcacttgccaacaatcttcctgacggaggtattattttcctagatgaggtagactcttttgctatatctcgagatagtgaaatgcatgaagctactcggaggatattatcagtaattctgcgacagatcgatgggttcgagcaggatagacgtgtggtggttattgctgcaacaaatagaaaggaagaccttgatcctgctctcatcagccgttttgattcaatgatttgtttcggcctaccggaccagcagagccgtgcagaaatagcagcccaatatgcaaagcacctaacaaaacccgagttggttcagttttcccttgccactgaggagtaagtacttcattctgaatcttcaattaggatgtccctgtgttgctacagagccgctaataaaaaaaccaaaaataaaattatatacataaattttccttttcagaacaaagcgaatgtttgcaaaaccacattgacagttcactgga

SEQ ID NO: 77945 - DNA, 177 bp, Triticum aestivum
  Clone ID: PAT_TA_77945
gacccacgcgtccgcacaaaactcaaaagaaaatctcataagctccattagtataagaaaataaatcaccacttttggtactattgtgaactcattctttatttataatgatgtaatatctactgtattcccacttttccatggttcatacccccccgatactagccatagattcat

SEQ ID NO: 77946 - DNA, 447 bp, Triticum aestivum
  Clone ID: PAT_TA_77946
cgacccacgcgtccgggccggcgccgcgttgtgcagccacatgggcgtcgacaagctggcgttcaccggatcgactggcacgggcaagattattcttgaactggcggcgaggagcaacttgaagccggtgacgctggagctcggcggcaagtccccgttcatcgtcatggacgacgctgatgtcgaccaggccgtcgagctcgcgcaccgggcgctcttcttcaaccaggggcaatgctgctgcgctgggtctcggacgttcgtccacgagagcgtctacgacgagttcgtggagaagtccaaggctcgcgcccagaggcgtgtggtcggcgaccccttcaagaaaggtgttgagcagggacctcagatcgatggccagcagttcaagaagatcctgggctacgtcaagtcgggcgtcgacagcggcgccaccctcgtgaccggcgg

SEQ ID NO: 77947 - DNA, 458 bp, Triticum aestivum
  Clone ID: PAT_TA_77947
tggatgtacaataagtacctcctgctgagcaaagtgtgtgatattccagagtatctttttcatgtatattagtttacagagggagtaccttccagctaagtgaagatgcatctttttcagcatgtgcaaactaatttttggttatatctatttcgacgatgtgtgtgtatatctgacataagtagctcttttttgtttatgaatatgagctggaccatccaaaaacacttcgttcaaatgcagagatgttggatgtagtatctgattatctgttctccatttttgcatcctgtatgcatctcacattctttttatttttagtgtgataaaaatattcttttttgaacatgctatcactttgtcatatcatggagaaacttctctctttctcttatttggatacaatgtgttccctatggagaaaacatggtgttttggtctgttacatcttatttttc

SEQ ID NO: 77948 - DNA, 323 bp, Triticum aestivum
  Clone ID: PAT_TA_77948
gacccacgcgtccgggtcgccgtgcagagctccatagtactctgcctaccagccgctcgtagctggagtgtttgcctccgtctctccccgcctcccctgtccggtgattcaaacagtgttgtgtcttggaggagtagtctcctctcttcaatgcgaggagaaggcaccggcggtgggatgagcagcggtcgtccttgctgaggtttcctcaagctcggtccccgtccctgtcctcgaaagcgaacttcttggcgaccagcggcaaggaagcagaggaggggagggatataatggcctccacggaaggcggcggcggcggcgga

SEQ ID NO: 77949 - DNA, 465 bp, Triticum aestivum
  Clone ID: PAT_TA_77949
ctccggttcatcccgctgcccagagggagcgtgctgcctgacctcgaagtgtggtgttcatgaggaaacttcagcgctaccgacgtatgggggaaagtgaggggaagatgcgctacatcgaggtgtccaaaaagaagccctacgtggtcagctccttctccctcgacgacggtggcagctcctggacgctggaccacgaggtggcgttcaccacaatttgggatgatgaacccttgaaggagatgccggcgattggcgcaattgacccactcaacagccatgttgtgtaccttgtgtgcggcaaccagcttcttggcgtggacatggagaaggagaagataacagggagctctcgtctggctatacccagtgtccccatcctaccatgtgtgctcccgacgtggctggaatcaacccagattccctctgcagattggagcaagaagaccgctgtgaaaagggagg

SEQ ID NO: 77950 - DNA, 502 bp, Triticum aestivum
  Clone ID: PAT_TA_77950
ccttccctgcccttggcttctcctcgccgagtgagggttcagatccacgacgcgggcagagaagggagtaggattccactgttcaccgtcagtgtgttgtgttccaccgacgctgccactgcccaacaaaatccaaatcccgctagaatataattgactgggcgagctcttgagctatcacggccatatggaggcggctttggtaagcgccgcgacgggggtcctcaaacccgtcctggggaagctgtctgctctgctcggcgacgagtacaagcgtttcaagggagtgtgcaaggagatcaggttcctcatggatgaacttgaggccatgcacgcatttctcctcaaaatgtcagaggacgaggatcctgatgtgcaagacaaagtttgggcaaacgtggtcagggagctctcctacgacatggaggacaccatcgacgacttcatgcagaacgtcgatgacaaagacgccaagccagatggcttcattgagaaaatcaag

SEQ ID NO: 77951 - DNA, 243 bp, Triticum aestivum
  Clone ID: PAT_TA_77951
gatcttgttcttgagcaatatctcttgcctaattcgcctggaatagctggatttcgccttgattcctttggtgttataagacctcgagtaacccattcacctctgccatcagagttagatatgattgagtgttcattgatacgtatggagaggagggacacctaaatcctgcaattcttcatatacaagtcacagttgttaaggtaataaggcactggctatgtggtcaagctcacttgattt

SEQ ID NO: 77952 - DNA, 394 bp, Triticum aestivum
  Clone ID: PAT_TA_77952
atcggagcttgatctagagaaatcccttattggcgaagcatcatttccaccacctcatggctgggattactctgattatgtgcctgaagctattggatgggaaggagaaaagcccggggatgtttagaaagaaaagaaattgaaagaaatcaatcttgaatcaatgagcccagaaaggcgggatgaagaacaacaactgatgcacttgaagcttatgggatggcggcacttccctgttgatttgaagaacttatctggcattcgatgtcttctgttgggtgctggaactcttggatgtgaagtttctcgcttactcatgacctgcggtgtacggaaactaacagtggttgatggtggtcatgtttctatgcctgatgtactcaaacaatcactc

SEQ ID NO: 77953 - DNA, 413 bp, Triticum aestivum
  Clone ID: PAT_TA_77953
ccacgcgtccgcgccgctcgtcgccgctggaggtccgctgctcgccacctccccccctctcgatcgcttgctatgcagcctgggcgtcgtggtccaccgctcgccgcagctggatggctggaggtcgtcggcacccaagtaccgcccatgctctggcgcttgcacaccgcctgccctgccccatcccaccctccgccaccaccttccccaccccgagctcggatttacgacgcccactgccttccagtttgagctccgcctcgacctcatccctgctgccgtcgtcttccctgaaccaaggaagccctcatctgatacgctctcgtccgcgacgtgcttctccaaccattggtacgcgacggtggttcggtccgggaggtggctcctgcaatcctggcgtccccgcagcagtg

SEQ ID NO: 77954 - DNA, 339 bp, Triticum aestivum
  Clone ID: PAT_TA_77954
ttgtgcgcctcctacctgcccccatggccatggccagcagctggcaagaggggaagctcgaggccgtcgatctggagcacataccggtcgatgaagtgtttgagaaccttcagtgcagccacagggggctcacttccaagcatgcacagcggcggctgcagatctttggcccgaacaagctcgaggagaaggaggtcacgacgtttcattcggccaatataattttcttcttctcattgatgttacacactcgattaagttggagtgttgatggctgcaggagagcaagttcctcaagtttcttgggttcatgtggaatccactgtcattgggtcatgg

SEQ ID NO: 77955 - DNA, 170 bp, Triticum aestivum
  Clone ID: PAT_TA_77955
gacccacgcgtccgctcatttcaaaattcaaaacccacctctctcactcagaccagaccaaggagagagaaggcggccagcaaatcctcgaaccctccgcgacctcgtctcggaatccggcgaggagccccatagaaaaatcctgggcgtggggagggggacgcaggaac

SEQ ID NO: 77956 - DNA, 663 bp, Triticum aestivum
  Clone ID: PAT_TA_77956
cgtccgttttttgcaggaagacaaatccatgaagaaatagatacaactgatggtatacaaagtcagcattgtatccccaatgctctaattgaagaaaccatagcaaagattcaggaaatcgagtgcacgatgcaagaccagctccagatcaaaagaatcatggacaaaattgaagattgtttgacgggacaagatgaaaagatcctggttatcctcaaactcgatgctgactgggtatccagatggaaggagaccaaaaatgctttcagcatgtttggttgcatagccggtgcactgatgttgacattcaaagataagatagcacgagccaaagaatattgttggccactgcgggagcctatagactatagtcttcttggcttctaccatgatactgcacttgagcttacaaaaaaccacatgcttgaagataacccaaagatttatcttgacatcttggacaagtgtaagcaccatgaattctgcatgaagatcttcattcatgctttgcacgccaaccccaagaggagcaatgaggagctaagcaagttgcacaaagccctgcagccggtacatcaagcttcacacacatctgcacacaactcattggacagcaatatcattgctaagaagatgttcatgttctcttacagtgacctgcct

SEQ ID NO: 77957 - DNA, 478 bp, Triticum aestivum
  Clone ID: PAT_TA_77957
gacccacgcgtccgcgaagatgtgtgtgcatatgctcaaactcagattactgcttgtagtggtgatggcctatttttactagccgagtctttcagattcgtgattaatatgttgctcattcaaaagaaaacctggaaaggcagatttgagctgtgccatctggtcatcaggaatggcaagttcttaatcttgatgccgactgttgctgacgctagtgctgaaagcgcatttcttgatctaaaacaactgtatattctcatcaagccttttttcaaaaacaacggcagatttgcaaattacgtctcgagtctgaaaatgaccatcgatgaacgttcaaagaccgttactgattctcagctagaggttttcctcaccgaactgcttacccatatgtcatttggtgagccgcttgataatacgagtctccttattcaccttgttgtaatacacgaaatgctcagtggtagtgatctgttac

SEQ ID NO: 77958 - DNA, 257 bp, Triticum aestivum
  Clone ID: PAT_TA_77958
acccacgcgtccgcctcccggtccccgaggccccaatcgattgctcactccttgctctccaccgccccaccttcagattctgagatctcgctataatttcgaccacccttctttcccctttctttgagcgcgaggaatcggcttgagctgctcagcgccctgcttgctgctggttcttgagctgggcttcctgcttcttggagggggtggcattttgagctgatttggaggaggcggaggtgattcggtggagggat

SEQ ID NO: 77959 - DNA, 362 bp, Triticum aestivum
  Clone ID: PAT_TA_77959
gacccacgcgtccgcaattttctcccctggttccggcgcgggaacgaattcgtcgccacccggggggagcttgtgcgtatcttgttgttgcataaccgtgtgcttcgtggcgatcgcaattagggataagttgctaggtttactattgccaatccaattctgaacttgtgacctttaattcttgggagcaatttcttttaacggcaagctgaacaaatattatccttctgttttggtgtataaatgcataaaaaacggtggggttttcacttctggttaccagtttgtgttgattcatcatcatactgattatcatatgcaacaagaagaattctcgctcaatcaaattaaaatgtgtttat

SEQ ID NO: 77960 - DNA, 260 bp, Triticum aestivum
  Clone ID: PAT_TA_77960
aactacattttcttgaaagaacaaatgtagaacggttcatgaaaatgtagtttccctcggcttcttgtcaccactatcaatgctactatggtattcttcttcctgttcaagttgctaactggttagcacttgaactgttcccattagatgtcacctacttcatcttgacacctccttctaaagaccagtacgcactgcagtattggtttgccacttctggacatgctcttggtctggctggtttggtgattgtctgccct

SEQ ID NO: 77961 - DNA, 321 bp, Triticum aestivum
  Clone ID: PAT_TA_77961
cgacccacgcgtccgggctgatgaagaagatatagaagaggaattcagaaacctcgaagcagaattggaggataaggtttctcctgtgcatgttgaagaaccagaaccagttttacatgcaaatgacgattcacctgaagaaactgttgagtcgctgagcaataacctgtcaagcatgaaacttggggccatgtaatgctcttttttctacttgttgaatgtgacatgtacatcatgtgatttggtatgttttggcctatcaacgtgtaatgtatgccttctgataactaatatgagtgacatgaactttcatttgtggtg

SEQ ID NO: 77962 - DNA, 602 bp, Triticum aestivum
  Clone ID: PAT_TA_77962
ttccggtccggattcccggtcgacccacgcgtccgcgctcttcgccattcgcaccacgggctagggaagccgaggtggctgccaagaatgctcatgatgagaaagaccatgtcgtcaagctactgtttcgtcaggcctcgcacctctttgcgtgtaagcagtggctgaaaatgctgcagctggagaacatatgcctccagctcaggctgaaagagcatcagatagcagccatgttcccggagcttccctggacggtgatgaaggatgagaaggccgagccagaaggggagcgaaaaggcagggcaaagaagaaaggcaggaggcagaacaaggaaggtggcttctgcaaggccatcatgtttgcagttggcgtaggcatcgtcggcgcgggattgctccttggctggacctttgggtggctgctgcccaggttgtaagttcttctacctagcgtgcagttcgacgaataggtggtaggtaaagaaagctctagatatctgctttgtggagtaggaggatgaaatgatggaattcttagaaccactcatatttggaagccttgctggtgatatctctgcgcggtccacgccacgcctttcgtg

SEQ ID NO: 77963 - DNA, 298 bp, Triticum aestivum
  Clone ID: PAT_TA_77963
ccacgcgtccgctgacctgacaatacatgttaaaccagaatctggattattgttgacggtctgttcatattcctgatgaagctgatgagagatgagggagctcccttcagtccaagcatggaggaggaaagagagaacaatctcccgctgcattcgctcattcgcacagtacatattgtaacatactggtatgccctggactagtctcatatctactgtgtgctcgagtgaatgagtcggcagctcgttcaatccccgctacctcccatgagtggactgaagtgagctccctcaaact

SEQ ID NO: 77964 - DNA, 212 bp, Triticum aestivum
  Clone ID: PAT_TA_77964
caacagcaggagatagcttgtcttccttgccatcccatgcactatatacactctctcgggtcctgagcgttttgcctggctaagagagctgatactgcaagggcagagatatgtacagggtcgatgcggcggtcgccgtggcgctcatcgtgctgacagcgtgcgcgtcgtcggcggcggcaggagacgggcggcgggtggaggagggagga

SEQ ID NO: 77965 - DNA, 248 bp, Triticum aestivum
  Clone ID: PAT_TA_77965
acaaggagatcacaagcagctggcagatggaatcgatggagcatatcaaggaaggccatgatgcggatggcacatgaattttaagtatctgggagcttgagcaaggaccatatccttcttgggtagtacttggtctctgctggtgtctttatgtggtttgaagccgctgaaagaaatgatgcacactctgtctgtcgattattgagtactcttgcttctgcaaacctcttttctctccttgcttgcta

SEQ ID NO: 77966 - DNA, 599 bp, Triticum aestivum
  Clone ID: PAT_TA_77966
cccgggtcgacccacgcgtccgcgggcgcgtgggtcgctgagcaagccggcgcccggagcagagcccgagatccctcgccaccgcgccggagctcccactagccgagctcgcaaaagccgctgccttccctccctctcctcgcgcgctcgggggagcaccggagccggcggcgcgcgccatggggtcggtgtccctgaagctgccggcgtcccgccgccgccacggcgggcccctctcctgcctctgctccccggcgccgctcaacctcctcatgctgctctccctcctctgcaccaacctcctcgccttcttcgccttcttcgccgcccctccccgccacgaccccgccgccagcacaacccccacctccaacctctccgcccacgtcgccgccatcgcgctcgagatcggcggcgcgtcctcctcctccggcgcccgcctcccggacggcctgcccccggagctgctcctcttcctcaccccgcacgcgctgccgctcggccgcgacgcgcgcacggggctcacccacatgccggcctccgtcgcggcctcctgcctccggtccccgtccgcgctggcgctcctctcggccttcatg

SEQ ID NO: 77967 - DNA, 548 bp, Triticum aestivum
  Clone ID: PAT_TA_77967
gtggggtaaagactacaccttggactggaattcagggaggactgatgaaaaccccactgacaaaggtcatggagacatattaatccggtcaaaaagagtaagatcacgtccaggacaaacaagtaaacaggtcccattggactattcacttcactcttatctggaagttatcttccggaatcctcgaatgaaaatcacagtgcaagggtctaaggtcaaagcgcgccctttggacaagagccttaacacaacttcagtgatttctggtgacattgcgggaaggaccattgagttgactattggaatgagcaaagtagaatgggaaagaacgaactgtggggttttcttgtattggcgtggtcgactaatagagtcttacaaacgagttggaggtcaaatgcataatgctgacacgggacgtggagtaataggagttgcagatattacagaactcgttgatgatgaagatggcaattcatgggttcttaacagcaaacaagggtttcaagattgtgagatgtatgctgagctggaggaatggctgggta

SEQ ID NO: 77968 - DNA, 648 bp, Triticum aestivum
  Clone ID: PAT_TA_77968
cccgggtcgacccacgcgtccgcgcacgagtagggcgagatgagcagcgcccgctcgccgtcggcggcgccggcgccgctggacgacgacgacctgctgccggagatcctcctccgcctcccgccgcagccgtcctccctcccccgcgcatccctcgtctccaagcgctggcgcagcgtcgcctccgactcagccttctcacgccgcttccgccgccaccaccgcctcaaccctcccctcctcggtttcttccgcgtcgagctgaggggccgcttcgagccccgcttcgagccttccctcgacgccccaaatcgggtcccacccgaacgcctctcctggcgatggaacgagggtgacgactgctacgaccttgttggatgccgccatggcctcgtgctagtcctcaacagagcgcacacgcaggtcctggtctgggaccctgtcaccggcgaccggcaccgcgtcgccgttctcccggggttcaaaattgctggagccccgatcagcgggacggtgcttcgcggtgccggagacgacgaccacttccaggtggtcttggtaggcactgatggtgaggagggacatattacagaagcgattgcctacgtttactcgtcggaaactggtgcgtggggcgatcccatctcg

SEQ ID NO: 77969 - DNA, 431 bp, Triticum aestivum
  Clone ID: PAT_TA_77969
gacccacgcgtccgggagcgagcggagaaccacgctccgccggccgctcgccgccaccgcctctcctccaccggtaccgggagcaagcggagatcccgccccgctggacggacagttgatacagccagctatggataatatcactccaattctaaaagatgctcaggatccggattatcaacataaggctagcagcagaaggcaagacggaagcagctccaagagcgtaatcgttccaacttcctcctgtccttatcagcagagctctcgagtgaggcaagtccacccgagtgcagatgccttgctggcattatcctgaagaactctctggaaggaaagtattctgaagataacagcctcctcatcaaacaatggaacaacctggatccatgtatcaaatcccagattaaggagtcattgctgataacact

SEQ ID NO: 77970 - DNA, 604 bp, Triticum aestivum
  Clone ID: PAT_TA_77970
cccgggtcgacccacgcgtccgctcgtactacgggctggcccagggcaccgccaagggggatcggccgcgtcgagggtggccatgtaccgcgtctgctcggacgaaggctgcgccgggtcggccatcctcgccggcttcgacgacgccatcggcgacggcgtcgacatcatctcggtctcgctcggcgcgtcgccctacttctccccggacttctccgaggaccccatcgccatcggctcgttccacgccgtggcgaagggcgtcatggtggtgtgctcggccggcaacgccgggccggaggcctccacggtggtgaacgcggcgccgtggatcatgacggtggcggccacgaccatcgaccgcgacttcgagtcggacgtcctgctaggtggaaatagcaccgctgtcaagggtggggctataaacttttccaacctggacaaatccccgaagtacccgttgatcgcaggagcatcagcaaagtctaattcagcttctagtacttctgactccgcaagtcactgcgagcccggcaccctggatgccagcaagatcaagggcaagatcttgctgtgcaaccactcgcagagcgacacgtctaag

SEQ ID NO: 77971 - DNA, 596 bp, Triticum aestivum
  Clone ID: PAT_TA_77971
atctcggcgcttctcccttcatacattcatcacttgtagcaggaagtcttcatctgatgacaagttacttctcatctcagtggcatgagcttgttcatattcttcttgcacatccaaaggttgatatctttatggatgtagcctttgatagtctgcacgaagatatgaggttattgagtgtcaggctatcgacattgggcaccaaagcctttcctgttggcccttttgactcacaactcacttacttcatatgccaacagtgcgaagcatcattgcaatttcttttgtcactgtgccagcagaagttattccgagatcgtattttaaaaaacaaggagctctgtagaaatggaggcatactgtcactctcgtttacgatattgaagttaggtgttccagaatggctgaaaggatcaactgatattgcttcttccatttccagacagaaggctaaaatcctttctatcttgttacaactgtgtgaatctgaaagtatttcttacctcgatgaagtcgccactttgccaaagagcatgcaactagggctggaggttcttgatttgctgaagatcgcatttggaagaaacaaaaacctg

SEQ ID NO: 77972 - DNA, 171 bp, Triticum aestivum
  Clone ID: PAT_TA_77972
acccacgcgtccgcagcacactcgcaacaacaagcagtgcagcttcgtccgtttgttcgttcgttcgtagcgaggtgaaagattctgctagtttggtttctcgtgtcgtgagggtggcggcaatggcgatcggcgcggacggcctggaggaggcgccgccgctgctccttg

SEQ ID NO: 77973 - DNA, 422 bp, Triticum aestivum
  Clone ID: PAT_TA_77973
tcaccacctgccaggcgctcctcgcgcagaaccccaggcacggcagccgcgacctcgtcgccgggaacaacctcaccgtgccgatccgctgcgcgtgcccctcgccggcacaggccgccgccggggtcaggcacctgctcacctacctcgtcatgtggggcgacagcgtctcggccatcggcgaccgcttccgtgtcgacacccaggctgtgctccaggccaacaacctcaccgctagcgagatcatatttcccttcaccactctgctcatcccgctcaagagcgcgcccacgccggacatgctcgtgtcgcgggcgccgccgcccgcaccagcgccaccgcaggcccagcagccgccggcatctagcagcgggaagtggattgccgtcggcgtcggtgttggtgtcggcgttcttgcgctg

SEQ ID NO: 77974 - DNA, 518 bp, Triticum aestivum
  Clone ID: PAT_TA_77974
cccacgcgtccgcgtcggccaccccttcacccgccaggagaacaccgtcatccagacatgcgtcgtctccgcctacggcatcgccttcagcggtgggtttggcagttatctattcggaatgagtgacacaatagctaagcaagcaacggaggctaatgatccttggaacatcaatgaacctcaccttggatggatgataggctttcttttcctcgtcagctttattgggatttttgcacttgtgcccatgagaaaaatcatgattgtcgactacaagttgacctatccaagtggcacagcaactgcttatctcatcaatggttttcacacacctgagggcgccaagcttgcaaagaagcaagtgaagatactgggcaggtactttatggtgagctttttctggggctttttccaatggttcttcagtggtggcgatgactgcggtttcaagaacttcccaacattaggccttgaagcttacaagaataggttttactttgatttctctcctacatata

SEQ ID NO: 77975 - DNA, 314 bp, Triticum aestivum
  Clone ID: PAT_TA_77975
cgacccacgcgtccgcgttcgaaagcttccccaaggataccacctcgccgcgattccccgcacccacccaattccccgagccccgccgccgcgcgatcgcccggccatgtccggctacccctacggcggcgccgcaggaggaggaggaggctacggggcccctccgccctactgttcctcccccgccccctcggccccgggggcggcgacaagccccccaaggaaggcaaggcctcctccccctatgcggctgcccgccccagacctacggcgccagcggcggcggaggcggctacggggccccgccctcgtcc

SEQ ID NO: 77976 - DNA, 545 bp, Triticum aestivum
  unsure (1)..(545): unsure at all n locations
  Clone ID: PAT_TA_77976
cccgggtcgacccacgcgtccgcttcctcgcgctgggccgcattacctgggacttccgccgcagtccgagcggcgggtggggcggcagcttcctcgccatgcccggggtcgccaacgtcacccgcctcgtcatcgagcgcgagccatgggacgccatggacgtcggcataccgtacccgaccggattccacccgcgcaccgcggccgacgcgcgcgcgtggcagcagcacgtcacgtcagtcccgcgccccaggctgttcgccttcgccggcgcgccgcggtcggccatcaagggcgacttccgcgcgttgctgctcaacgattgccangccgcgggggccgagtgcggcgcgctggactgcgccgagggcaagtgcatcaaggacaacgcgctcgtcctggagctgttcatgggcgcgcggttctgcgtgcagccgcgcggggacagcttcacgcgccgctcgctgttcgactgcatggtggccggggccgtgccggtgctgttctggcggcggaccgcgtaccttcagtaccactggtatctg

SEQ ID NO: 77977 - DNA, 537 bp, Triticum aestivum
  Clone ID: PAT_TA_77977
tgttctcaaccctccctccgtccgtcgcagctccagatttccttccccatggctccgatcaagatcggcatcaatggtttcggccggatcggcaggcttgtggccagggttgcgctccagagccccgatgtcgatctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgct

SEQ ID NO: 77978 - DNA, 422 bp, Triticum aestivum
  Clone ID: PAT_TA_77978
ttctcttgtaaaatccaaactgtttccgagcctatatgtttggtttaatatttttgtttatcatgcaatacttatcccgcagccatctaatatgcaaatttgataatagaagacgacctcatttatgtacatataaaatgcatattcttggactgggttttcttccgcactctcttggatcaggttacaaatacatcatactgactgggttttattcattcagtcatatagattcgaatactatactgttaaaccaatatgatggagggctccagtttgatgcactgttaaaattcatgttgaagttacaggaggtagatctattatggtttgcacaaaaatgatgcattgatcaacacattgttgtaaatatgcaaatttgagagtgaagaacattgttataaggatgcaaatttgacatg

SEQ ID NO: 77979 - DNA, 322 bp, Triticum aestivum
  Clone ID: PAT_TA_77979
tgcatctgggacacgataagggggaacgggaggagatggtagttcctgaagttattgagggagattcgaaagtgtcaggtgttggtggcgagggtgagaaggtgattttatcacagggtacatttgctgcgttggaagggcttgcattggaatgtgatgatggtccttcttgtagtctgttcaaagagggaactgaagactacgaatggttcaacatggatgctgagaccgcaaggaaatttgtgaaaactcgaaatcgccttgggcccccctgatttgcaacaaccggtttctggaaggcctaccttcgacagcacccccc

SEQ ID NO: 77980 - DNA, 224 bp, Triticum aestivum
  Clone ID: PAT_TA_77980
gacccacgcgtccgcgcgtgaaccgcttcgtcggccgcatcatcgacgaccaccgctccgccgctccctcctccgccgtcaaggacttcaccgacgtcctgctctccctccaggcggcgacaggctcgccgacgcggacatgatcgcggtgctctgggagatggtgttccgcgggactgacacagtggcggtgctgatggagggggtgctggcgcggctggtgc

SEQ ID NO: 77981 - DNA, 550 bp, Triticum aestivum
  Clone ID: PAT_TA_77981
cccgggccgacccacgcgtccgcccacgcgtccgttcactcgtcgtgtgtgagcagcccctgcattctgcagcactcgcctatcctgttatacgacggacgaccgtcttgcgagcgggagaggctacgacgatgagcaccggcaaggcgcccgcgctctaccacgtccgcgctcggtcgcttacgagcaaggtgctcgacctcgactcctcgccggcgtgcccgtccccgccaccgttccggtcacacgtcacggtgccgtttctctgggaggacgcgccggggaaacccaagctgcgcgcagcccggccgagcgccctgtcgctcccttccgcgagcccagccccagttcttgctgacggcggcccgactgccagagtggccggcggtcacgaggacggtcacggcgcccatgcgcgccccgtgctgctgaagctgaagctgccgccgcggctgcaagcggcggagcacccgctctcctcccccaggaccgtgctccagggcccctacttcggcggcggcggcggcggaaacaagccgccgaggccgct

SEQ ID NO: 77982 - DNA, 640 bp, Triticum aestivum
  Clone ID: PAT_TA_77982
cccgggtcgacccacgcgtccgaaaaggaatagttacctttttacatggcggcctcgttcggttacaccccgtatactattagtcaagtgagtggtcatcacacagaaacaaggacgccatgtaaaaagggaaatagttaccttttttttttgtcaaacagaggaagtaactagtaccttctgaaacaatatagattggttattgccacacttctaatcttacactggactgggcaaagagaggtgatttaaattcatgtttgatatttccacatgtctgttcttacattggaccgtatgcctacctttgtttgagacttggggcttacctgaagatgtcgtcgatgagctgaaatatagttctatatatgttaacctgaagcattgcactgggcatttgttcatctgcttgcttgcactgatatataggagttcaatggtttaacctattacaactttgttcactgctcctattctgctcactcctgaagagtctagtattttagggtaacaattgagcattaatttccatgtttaaaaataagtatgtggctctaattttttttcctgtgagctgaaaacaggacagatgatcttcataatgtcctttttttggcagatttcatgtatacataaatgt

SEQ ID NO: 77983 - DNA, 678 bp, Triticum aestivum
  Clone ID: PAT_TA_77983
cccgggtcgacccacgcgtccgataaattaaacagatatataagatggttctaaactgtctttgttaaaaagacctacactgtatctgcatatgtgtgtctacgtttttattctgggcgtactactctgattccaaagcatgtagtgagatagatcctgaggtgagtagtaccactcaccggctcttcaacttatgatcctgaggtgagttctcatggtcaagtgttgtaatcttcgtatcgatgaactcacgacaggttcattctaagatataccatttttcctttgtcactagattcccaccaacgagaggataaatgtgtgaccaagaggaatgcagtgtatggagcaacgcttgatgaggctgatacggttgtcctccttgaaatgaacaacaatggtcagctgattcagatgcatgttccttgatgtcaactgagtgctgggtactctcccgcaaaaaataaatatataacaagagatttatactgtcatttgattagcccctggtgtggaatcagaaggtcacacatttttttttgagttgaatggctgcccggctgtgtacgtatgcaccagaacagagcatggaatgaaggggacagccagggagttatcatggtccttgcggttgtcattcccatgactgtgccattcgcgtttgtacaggtatttctc

SEQ ID NO: 77984 - DNA, 323 bp, Triticum aestivum
  Clone ID: PAT_TA_77984
cccaagtgtgaagtgagcttttgaaagtttaagaagaggttaaccacttatccgtccatagccaccctagatatttatacgagttttgaagttattgtgatgcatctaatcatggacttcgttccgtcttgatgcaagaaggaatcttggtagccttcaaggcaactacgtcctcatgaatagaactgccctacccatgatttggaaatagcggtagtagtgcatgctttaagtatgtcttcttctagatgggaagatttgatcaaccactatgacgttgatatccattaccatcctgataaggccaatgtcgcagtggatac

SEQ ID NO: 77985 - DNA, 322 bp, Triticum aestivum
  Clone ID: PAT_TA_77985
acccacgcgtccgcttttgaccgctcaaacttgcttctctgcccccgtgatcgcggctagccatagccatggggttatgagtgacacagcgcttcctttggacgcagctgttcgtccgtccggcagcggcacggcacccgctgccgcatcataaccgccatcttttccgatcctttcttcagcttcagaggcacaccatgggggggtgatcgctcacgcggcaggcttccagcttcagggatcgagtgaagctcttcttcttcccgagcggaagaaaagctctggtgcaccagttttggcctcaagcggcagatcttcttcc

SEQ ID NO: 77986 - DNA, 524 bp, Triticum aestivum
  Clone ID: PAT_TA_77986
ggagaggaggacgcctatccagccaagctcgcactcggacctctctcctcgaccgtgtcggattcgattgcttcagggtgggttgctactgatccaatccgtacgtcattcatcttgggccgattgccagggaaagagggaaggatggagttcgggaggaggaagcccatgagccttctggagctctgcatccggaaggccatcgacaacctccgctacatcgagagcgtcgacggcatcgagatggatctgctcaagcgcatcctgccgcactgcacgctggagcatctcaccaaaatcgaggagaacaccaagatggatcttagctcggtaactgatccgctgtggaagcgattctattttcgagaattcggtgaggagcatacgaacaaagttatcgcgagactgaagagtctgaaggagactcggtcagacacgaaatacacatggtggaagctcttcgaggcgagacaaaagaaacagaagcaagctgaagatgagatggttgagaaattcacaaagaa

SEQ ID NO: 77987 - DNA, 550 bp, Triticum aestivum
  Clone ID: PAT_TA_77987
cagctacaacttacaagatgaactgctccgaagccttctgccttgtacatcagcagcaactcacctcgggagcaagcattctttcacggcacaaactacagagaggagacacgaacctcctatcatcaaacaactcacctaaactagtaaactacaactcatcaaaatataaacagcaaacataacgctgaatcctactggcgagccagcctacggactacctacgcgacaacgggctcaagtgtgtctggatgctcgcaaaaggccagtctcatcttaacgtgtatccgtcatgcggtcgacggtagcctcctgtcctccgcaggcagccgtgtgagaatttacaagcccagaaagtcaaaagtcccaccggtcatgctgcagcctagcttcggccatatccttctgagccttccttcgccgatagaaaatcggacaatcccgactcgtgcagagaacgtcctggtgcagagatccttggcactcctggcattgtgtccataacctcccaaagagcatctccaggtcagaaacatttgctactgttttg

SEQ ID NO: 77988 - DNA, 405 bp, Triticum aestivum
  Clone ID: PAT_TA_77988
tgttggaaaccctagagtcaggtaagcagccaattttcttcttccgacggcgtccctggaagaaaaagacaaggccaggcaagatccatgtttaaggtctgtaacacacatgcaactttcgctttttattaattaatgatgaaacatgtagtgtttcagaagcctttgaatccgcagatgatgatcatcaaatctgatgcatgtcaatagcttacggcaatactgtattattctttgctaattttgtttctgcacatcgagctatatctatgatagcctatacctcttttgtacgcaatcctttagcaagtatacaaatgcactacggttcacatctatggcgagtaacatacatcgcaagaaactgttattaccctatatttgatctgctgatgataaaaccta

SEQ ID NO: 77989 - DNA, 512 bp, Triticum aestivum
  Clone ID: PAT_TA_77989
cccccctccaactccaagaaatcgactgacgccaacgagaacgagacgccatcgctgccatgggtttgcaggaggagtttgaggagttcgccgagaaggccaagaccttgcctgacacaatttccaacgaggacaagctgcttctctatggcctctacaagcaggcaaccgttggcccggttaccactgggcgcccaggtattttcaacctgaaagacagatacaaatgggatgcttggaaggccgttgaagggaaatccaaggaggaagctatggccgattacatcaccaaggtgaagcagctgctggaggaggcttctgcatccacttcttaggctattatgaacaacaccatcaatagtgctgcatatatgtaccaataaacataaatactataccatcatcaggcgctttgtgatcatcccttctctgtacttgtaatagtttcaagcagactcggtcctgttaattgatcatgactgttattaagttaaaaaaaaaaaaaaaaaaaa

SEQ ID NO: 77990 - DNA, 436 bp, Triticum aestivum
  Clone ID: PAT_TA_77990
agagggacagtttgtgtggagaagcggctaaatggagtcagcagctctgtgagcacagttccagagggtggcgaggagcagagggtcactgccaaacttggatccctcaaagtcggttccaaggcagtggaggctgaccgtaagactaacacagttggtgtggtgacaatcggctcgatgccggtccgggttgacagttgtgacgtctagtggccagcaggagcttttgtttttggcttcacaattttttgcccttctgggttaatctttggtgcccaaggcttctattttcctttcttttggtagaatgcctgtcttggttggcggttcctagcttctatatgtcattaaaaaagggagaaaaaaaagatgaacaattaggttctagtttcgttgggtgaaaagctagttttgcaggcagcattctgatggtggg

SEQ ID NO: 77991 - DNA, 218 bp, Triticum aestivum
  Clone ID: PAT_TA_77991
tggctggacgagcgctgcatcagagagatcagagctgatggatgttggatggacaaccgtctgggtgcgcatctgcacagagtgggtcaccgccgcgttgtacatctggaccctcatcgccccactgctcttcccagaccgtgatttctcctaggcaccccgcaccgatagcctatgagttgtttagtattgttagttgcccattgtgaatatgaata

SEQ ID NO: 77992 - DNA, 337 bp, Triticum aestivum
  Clone ID: PAT_TA_77992
attctcagctgtccccggccgttcgtccgtccaaggaaggagagccatggtgggaacctcctcctggtcatcgtcctcgtcgtgcacgtcgtcgctcggctctctcgacgacgacgtcgtcgtcgcgtgcgtcgtcaaggcagcggacgccgcagtcgaggggacgtgcgtcaagttcctctgcagctacggcgggaggatcctccctcgccacgccgacggcgcgttgcgctacgtcggcggcgacaaccgcgtcgtctccgtcgaccgctccctccctttccacgagctgcaacggaagctgagggagatgtgcggctgggaggcggtgtgcctg

SEQ ID NO: 77993 - DNA, 486 bp, Triticum aestivum
  Clone ID: PAT_TA_77993
gagaacctatacagcacagaagtccagaaagtgaactatggagatcagcagcttaatgtgcgacgaaaggcagggaagttaactcaagtgatatttgacagtgggagctcatatacgtatttaccacacgacgactacacaaacctgattgcttcacttaaaagtctctctccaagccttttacaagatgagtcggatcgaacactaccgttctgcatgaaacccaattttccagtgaggtctatggatgatgtgaaacacctgttcaaacccttgagtctggtattcaaaaaaagattgttcatcttgccaaggacattcgttatcccccctgaggactacttaatcatcagtgataagaacaatatctgcctaggagtgttggatggaacagagattggtcatgactcagcgatagtaatcggagatgtttcccttcgaggaaagctagttgtatataacaatgatgagaatcacataggatgg

SEQ ID NO: 77994 - DNA, 546 bp, Triticum aestivum
  Clone ID: PAT_TA_77994
atggcggcgctgcgggaggcctcccgctgcctggcgtccagggggagccctgcggccgcgcgatccatgctcctcgcgcagtcgcgcggcatcacttacaagctcttcgtcggaggtttatcacaatttgcaacggaggaaagcctagcagaagcattctcacgttacggacaagtaatagaagctaccgtcgtcagggataaggtgaccgacataccaaaaggattcggcttcgtgaaatttgcctccccggaagaagccaataacgcgagggaagagatgaacggcaaggcattgaacggccgggtcatatacgtggacatcgcaaaggccaaaccggaccgtgctacagatgctctcccaatagcgagaggtcctcctaagccaattagcaacggctgataaaggaaggccctggtttgtagtttacatacttcctcagatatggatactcttagatgaaacgtgaagtgcaatattctgcagaatttcgaggctttgcttgaacataaataaagttcatttacacaaaaaaaaaaaaaaaaa

SEQ ID NO: 77995 - DNA, 462 bp, Triticum aestivum
  Clone ID: PAT_TA_77995
tgatccaaatgaagttagtgagatctccatggcgaactcccgccagaacatccggaagttggttaaggatgggtttatcatcaagaagcctcagaagatccactctagatcccgtgcaagaagggcacatgaggccaagcagaaggggcgccactcaggatatggaaagcgtaggggaaccagggaggctaggctccccaccaaggttctgtggatgaggaggatgcgtgtgcttaggcgcctgctccgcaagtatcgtgaggccaagaagattgacaagcacatgtatcatgatatgtacatgaaggtcaaaggtaactcgttcaagaacaagagggtacttatggagagtatccacaagtccaaggccgagaaggccagagagaagacactttctgatcagtttgaggctaagcgcgccaagagcaaggcaagccgagaaaggaagattgctaggaggga

SEQ ID NO: 77996 - DNA, 446 bp, Triticum aestivum
  Clone ID: PAT_TA_77996
tgaaagtatagtgaacacaacaagaaggcaagctctcttgcattccatggtgtgcggacctcagtcctcagctatgccggaaatggagactcaggccggccgggtcatgctcagcttcgaattgtccagctcacgcagcatggacatggcatgtgaggcagagtttttgtttcccctgtctaaattgaaaggagctagcttagctagtagtactaattaagtactactctccatcatcggtccatccggtcaaaagaaaactcacacatttgactttgcatggtcttccaagcgtatatttgatcactacgtactctactactccatgtttaggagtagtttcttgtagaatgtgttcttagtacaagccttcaattttaggagataatgtaagtattttcaatataaatccacatatgctattttttcaaaaaaaaaaaaaaaaa

SEQ ID NO: 77997 - DNA, 640 bp, Triticum aestivum
  Clone ID: PAT_TA_77997
ggtggtgcatatggagggttttgtgattttgacacccattcaggagtgttctcatacttgtcataccgtgatccaaatttattgaaaacactagaagtttatgatgagacggccaagttcctaagagagctagaaatggatgatgattgtctcacaaaagctattattggtaccataggtgacgttgattcctaccagctgccagatgctaaaggttacagcagtctaatgcgatacttgctgggcatcacggtggaggaacgccagcaaagacgtgaagagatactatcaaccagcttgaaggatttcaaggagtttgctgatgctgtcgaaacaattaacgacaacggtgtcgtggttgccgttgcatcacctgaggacgtcgaagcagcaaacaaggaaaatcccttgttttcagacgtcaagaagtgcctgtgaagctccttcatttctgctgcctttgcaggattttagtctagatctgcgctgagcacagaggttcttcagtctctcctcgcctacgaatgatgattctgatactgtaacatcatatcttacatagcgagagtatccagccatgattttttttctcgcaattttggggacaacagtagttcaggatgatgggcaaagtgtattc

SEQ ID NO: 77998 - DNA, 717 bp, Triticum aestivum
  Clone ID: PAT_TA_77998
tttgctgccgcagtttaatgcttcatatcgtgaacatgaaaatgaacgtcccatcagtccggaggagaaagaagggctatcaggaaatggttttgctgttaaaagtgatcccatcaaggtaccaccttccattgaagtccctgaattatcatttgaagaactgaaagaaaagaccgacaattttgggtcaaaggctttgattggtgatggatcatatggaagagtgtattacgctattctggacagtgaaaaacatgttgctgttaaaaagcttgacgcttcaacagaccctgaactcgataatgagtttttgacacaggtatccattgcctcaaaactaaagcatgataattttgtggagatgcttggatattgtgtggaaggaaatcagcgtctagtggcctatgaatttgctacaatgggttctctgcatgatatcttgcatggaagaaagggtgttccaggtgcacagcctggcccagcacttgattggatgcagcgggttaagattgctattgatgctgctaaagggctagagtatcttcatgaaaaggtgcagccttcaatagtccaccgggacatacggtctagcaacgttcttctgtttgaggactacaaagcgaaaattgcagatttcaatctttccaatcagtctccagatatggctgctcgtttgcattctactcgtgtccttggaaccttcggctacatgctccc

SEQ ID NO: 77999 - DNA, 569 bp, Triticum aestivum
  Clone ID: PAT_TA_77999
gtttcgcccacgcatactgatcgacgtatccaagattgacatggccacaacagtcctggggttcaagatttcaatgcccattatgattgctccctctgccatgcagaagatggctcacccagatggagagtatgcaactgcgcgtgctgcatcagcagcgggcactataatgacattgtcatcatgggctacttcaagcgttgaggaggttgcctcaactggaccagggattcgtttcttccagctttatgtttacaaagacaggagggtggtggagcagcttgttaggagagctgaaagggctggattcaaggcgattgcgcttacggtggatactccgcgacttggccgtagggaggctgacatcaagaacaggtttgttctgccaccatttttgacactgaagaactttgaaggcctggagctggggaaaatggaccaggctagcgattcaggactggcttcttacgtcgccgggcaaatcgatcgcaccctgagctggaaggatgtgaagtggctgcagaccatcaccacgctgccgatcctggtgaagggagtgatcactgcag

SEQ ID NO: 78000 - DNA, 457 bp, Triticum aestivum
  Clone ID: PAT_TA_78000
ttcctcgcttccaccacactgctgcctctccgccacccgcccttctccctttcgtatatctctcccaacatcagggcgcgagagcaggggatgcgggcctcctactgctcccaccacgccgctgcctccgcgccagcaggcctcgtcgccggcgagtagaggctcgtcgcaggtggtccgcggccggcgagcgcggatgcgatgtcacgggatctggatcgggaagaactgaagaagaggagcacgcgcgcagaaactccacaggcggctccacggctgagcaaggacggtgctcgtcgccggcgagcagggacggcactggcggccggcgggcgtcggggcctcgcggcttcagtgcttcacccgtcgcggaagaggcggcgcgagtcgggcgactgcgcgtccgtcccaggcgacacatatggccctcttaatggggtggggcggatccagcttg

SEQ ID NO: 78001 - DNA, 647 bp, Triticum aestivum
  Clone ID: PAT_TA_78001
tgaagctgaggtagtagactatgctaaatacaagcatttttgtagtacatattctaaggatccagccaaaaagtctgttttcttgaatcttggatttttctcctatttagctctgaatgaattttagaatcactggtgctggtgccatttgtcactagtgtcaatagtaaaaggaaacgaaatgttgcagcgtgatagtattataccactattatcaatcggattgctgttacaatagtaacttgcagtgcagtatattcaatttgctagtaattagcaacttggtgacattatttgctgtttgtgcttgtcataatgtagacgatctgtgtttcttgcctctgttttctgtgtttctttgggattcttgtagatggtggatgtgcctgggtgccgactactgtttgaacgaactgaccacgccctcattttctgccagcatcggatgtttttgactgactccagtatgtactgttgctgaggtttaaattgtaaaattctcatcccgtagttcgttccttaccaactaatgcacatgcacccaaggtgtaaaagaaaattcttgtaatttattcacaaatatttctatacaagtttgcagtgtaaataaatataacaatgttcgtttcaaaaaaaaaaaaaaaaaa

SEQ ID NO: 78002 - DNA, 679 bp, Triticum aestivum
  Clone ID: PAT_TA_78002
tactgacaaccctgaagacgacttgaagacagaatctcttgtgaagcaattgctttacaattccaagttaagatctgcatgtccattgccttttgatgaagccaaactctggcaaggagaaaatggtcctgagctaaagcaagagattcagaagcaatttagaaacattagtgcaattatggactgtgttggatgcgagaagtgccgtctgtggggaaagctccaagttcttggtcttggaactgcactgaaaattcttttctccgttgatggagacagccatttgaatcagccattgcagctgcagcgaaatgaggtcattgcattgttcaatcttctgaacaggctctcagagtctgtcaaatttgtacatgaaaaaggatcatcaattgaagaagtcattaaggaacagatcccttcaacttttcaaaagggtgcttccaagcccaatcttaaactggacttcctctgaagatgtaagagtgtagtttgtagttatacaaggacatgctggaagattaacatagacatgtatggatataccgaaagattaacatgtgctggaagcagtttcctagatacttctgttgcagctctattcaagagaatgagataagaccctttcgagctaaatgcgatgacacagttcacctggttttttcccccgttctttcatttg

SEQ ID NO: 78003 - DNA, 330 bp, Triticum aestivum
  Clone ID: PAT_TA_78003
gatgaacttgcaattggctactgtgtttttcacattttcccttggcactaagactcactactatgggagaatgttgcttcatggaggtgctcagtacagaggtactggtaggggatttgtcgtctttcatgcaaagtttgcagagaattatagactctactctcgcagccactttgttaaagggattgagctgatgattctgctcattgtataccaactattcgggcaatcttatcgctcaaccattgcctatatttttattacaatctctatgtggatcctggcattgacatggctatttggaccctttctattcaacccctccggatt

SEQ ID NO: 78004 - DNA, 215 bp, Triticum aestivum
  Clone ID: PAT_TA_78004
agaagcagttaaaatggtgtatgtatgggtaggaggcgaaaatgaaagcagcaagagtgttgaggctgttgattggcaacaggtcactggtgattttcttcatcgaaaaggcctcagtgatgctcttcctgtcaaggttttcaaggagcatgaaactgagaatcttttggaactactgaatgttagttaacattaggcagtaggtatcatgatat

SEQ ID NO: 78005 - DNA, 375 bp, Triticum aestivum
  Clone ID: PAT_TA_78005
cgcctggactccactctgctttgtgttcacaatattttgctcatcattctttctcggtgagattgttcacctcggcagcatcttgggtggaattttgctggtcggaagcctttacaccatgctatggggtaaaagcaaagaggttaagactgacaatatcactcatgatactgagaaagctgagcataagaattctgctgagagttacccagaagagcaacatcgtcatactacgccagaactatgaatgttctacaatcaacattgattggctcgtcagctttgcacgtccaagaactatgaatgttccatagattcaactaatgtacttaactccattatgtatataagctaaaataataataataatttctt

SEQ ID NO: 78006 - DNA, 535 bp, Triticum aestivum
  Clone ID: PAT_TA_78006
ttacccacaatgcgtcttggttttatcatgactcactgccctggaaatccaaaatttgatttccatagatacatggtaagggtattagaggctgattttaagaaagtagtaggcataagctggtacttgtgggtctttgtggtgatatttctgttgctgaatgttaacggctggcacacatacttttggattgctttccttcccctttttcttctgttagctattggcaccaagctggagcatgtcatagctcagttagcccatgatgtagctgagaagcacacagcgatcgagggtgatgtgatcgtaaaaccatcagatgaacacttctggttcggcaagcctaggattatcctttacctgatccacttcatcctctttcagaatgcatttgagattgcatttttcttctggatactgagcacttatggattcgactcatgcatcatgggacaagttcgttttattgtgccgaggcttgtcatcggggttgttattcagcttctgtgtagctacagcaccctgcctctgtatg

SEQ ID NO: 78007 - DNA, 546 bp, Triticum aestivum
  Clone ID: PAT_TA_78007
gacattgcacctcagagcatgtccatggttgggacaagaagcctgtccgcttccagctatcaacctccgacggtcagcaggcactgtctcagtgctacctggaggagcccgggagctgggtcctgtaccacgctggcgattttgtggcctcaaagcctgaccagccgatgaagctgaagttctccatggcgcagatcgactgcacacacacaaaaggcgggctgtgcatcgactcggtgctcatctatccgaaagggaaggggtttcagcaggagagggtggtcaggtctcagaaatgagactgtagattgttgtggaggtactactcacagtaggatgttagaccaaatgcagcttgcagcctgatcttatttttgctttgggctctagttcgcaacagaggtgaagtgtatatggttgtagaacttgagtttttgtgtggtcaggtgaccactagagtgctctgttaggcctttcccaagggcggtttcggcccccttgagctgaattgggacttcgagataaccatgaaactggactgaaatg

SEQ ID NO: 78008 - DNA, 206 bp, Triticum aestivum
  Clone ID: PAT_TA_78008
agttttgctttggttctaaaggctgaatcccccgagggctttgtgctaacccacatccaaaagacatggctgaatggatactcttcaggggttgagcaggcgtctaagctgtagagcaatatacagtctccgctcgcgattggagttttcttgaggatacaatagaataatgtatctacttcatctgagaaaaacttttttctctt

SEQ ID NO: 78009 - DNA, 487 bp, Triticum aestivum
  Clone ID: PAT_TA_78009
atgccggccaaccgggaggcgctgtaccgcggcatgctccgcggccggtccatgctcagggtcacctgctcctactagctaagctagcagggtagcagtagcaccacctgccggcggccccccgacgtaaccactccatcatccattaatctagacctctccgacctccagcaagcttgctcctctccgtgtctcttctctactcttgtgtgcgcgtgctgtgctgtgctgccaactagtggcggcgctgctaattagttgcccggaattaattaatcgggcctagatagctccctccctcgcccatttgtttgctgggaaagttttgtaattagtggccgtccccgcgaggcgagggagctgatccgtgcgtgctttactgttgatgctgtgttgcttgtatgtatggtagcttctttgcttgtactacattagtgttgtactgagtgatgatgatcagtgaaacgattcttcactgttccaaaaa

SEQ ID NO: 78010 - DNA, 215 bp, Triticum aestivum
  Clone ID: PAT_TA_78010
aagaacaaatataccaatggtttgatgtacctttttactgatgatgatcgttgacgacctggaatcaagtatcgacaaagtgctcttccatttccttaaatgttaactttggtgtgtgaacttaaatgttcattcgactggcttatatacttcaactaatggatctacaccctggctacttgattagccggaaataaaccctcactaatatttat

SEQ ID NO: 78011 - DNA, 580 bp, Triticum aestivum
  Clone ID: PAT_TA_78011
ccctggatttggcgatgggccccggcgtcctcgtcccccgcagcgcggtcccatacgcctccttcgctcgaggaaggggaaggagcgcgagcgggaggaggagcaggaatctggtgctctccgcttccttctccaacggtgcagcagtgccatccctgacaacagactcagagaagaagggcccagtgataatggaaattccactggaccaaatccggaggccactgatgcgaacgcgtgccaatgatccagtcaaggtgcaagaactcatggacagtatccgtgtcattggcctccaagtacctattgatgtgctggaggtcgatggggtctactatggcttctctggatgccaccgctatgaggctcaccagcgccttggtctgccaaccatccgctgcaaagttcgtcgtgggacaaaagaaacactgaggcaccatatgcgatgagttggatgttattgatggccacatcagctacaaagtgatctgtgtatctagagcttaaacagaaccttctatgggttttttttccatcggctgtaattctccatacctggaaatgttgcccaaacagagtt

SEQ ID NO: 78012 - DNA, 403 bp, Triticum aestivum
  Clone ID: PAT_TA_78012
tcagcgacgtccccgacggcacggtgatgaagtcgatcctcccggagaagggcggcaactgcctcgccaccgagagccacatcacgtggaaggacggcaaggtctcccaggacatcgtgctcaagctcaggaacaccgagaccggcgagctcgtcctgcacctgtcctgggtcaacatccccggcgtcgcgcggtgaatccgatcccctcgaccggcggggacggacccaggaggggcatatgaggaggcgacgcctgcccagctgattttactacaatatattatgatatgtgtataatgcgtgtttgcagaaggtatatgcataaggctcatgctactggcactggcagcaatgcctgtattcacttttgcttctgcgtgatttctgcgggggggtttttt

SEQ ID NO: 78013 - DNA, 562 bp, Triticum aestivum
  Clone ID: PAT_TA_78013
gtgcagacttcgtgaagagccagcattcagttggatacgtaaactcccagcagatatcaggacagctattcatcactccaaaatactgttttgcaatggctatgcttttgatgagttcttccctgatgtgatcgcgtcctctatcgactgtgcaattgattcgggaacagcagtgtttttcgatcctggtcctcgtgggaaatctctcttagatgggaccttggatgagcagagagcacttgagcatgcgctcaggttcagtgatgtcctcctcttgacatcagatgaggctgaatctctaaccaccatcagaaacccagttcaggctgggcaagagttgctaaagaaaggggtccgcacaaagcaggttgtcatcaaaatgggttccaagggttcgatcatgataactaagagcactgtttcctgcgcgcctgctttcaagatcaacgttgtggacacagttggatgtggagatagctttactgctgctatagcctttgggttcctccatgacttgccagcggttaacacattaaccctagcaaatgcagttggtgctgca

SEQ ID NO: 78014 - DNA, 662 bp, Triticum aestivum
  Clone ID: PAT_TA_78014
tgaaggacatagctggcacattggcaacggaggaggctgatgatcctgcacatgtcagtaaactccgttctgctctggagtctgtggatcacaaaaggagaaagatcatgcaacaaatgcgaactgacactgccttgttaacaaaagaagaaggtggttcaccaattcgaaatcctcctactgctgccgaggatgcgcgattagcctctctcatatctctagataacatcttgaagcaagtcaaggaagtaatgagacaaagctcttcaagacctatgagaaaatcaaaaaggaaagctttgctggactcattggatgacctcttgacacagatgccctctcttcttgatatagatcatccatgtgctcagaagcagatcatggaggcacggaaagttgttgagtcactggaagaagaccctgatgatcctgccccgcagtctaacgcattgggagagagcgaggtttcacagtggaatgtactgcagttcaacacgggaacgactgcgcctttcatcataaagtgtggagcaaattcgagcagtgagctggtgattaaggctgatctgcgagtccaggagcctaaaggtggcgaggtgatccgtgttggtccaagaccaacagttcttgtggacttgagttttgaggaataaaaggtgtgt

SEQ ID NO: 78015 - DNA, 601 bp, Triticum aestivum
  Clone ID: PAT_TA_78015
tttttttttttttttttttttaaacaagtgcattctgacacagcatgcattgcattgcgtgggtttacttttcttattctttttacagcagtgagccaatgatgcatcaagcagcaccagcagttgcgaaaagcatacaggttaactgcaaatgcaggatcaatttattctaaaatctaaacaggtttcaatgaaaatttacaacgatcgtgttcgaagtttcgattccaccctaggagcagtaagaaaacacagttgatttgccgaaacatgtttctgtgctccatctgattgcaagaattatggcagtatcaggttttgcctaaacattttcttcatagctctgccctggattcgtagtcgacattgctgtccttaagagtggccaatgtcctgatgatagactcgtatatcccaatccctttgaggtactcatctttgctcagaaactcattgtgatcatggagcaatatcggtgtgtttgtcattggagaaaaaccaaatgctggtatcccaagcacccgaaagtaacgagcatcagtagaggccgggaatatttccggcttaccaagtttgccaccggctctcttcacagcctctt

SEQ ID NO: 78016 - DNA, 745 bp, Triticum aestivum
  Clone ID: PAT_TA_78016
aattgttcagggagtatgcatgccttggtatatggtacagcacacacacggtttacacctcctctgataatgtttcctgatgtgtgtatctgtgattttcttcatgtgttactgcagggttcgaaacacattactgacttaactctttctcctcttatcttactaatgcataacaatgatttagctagcaccttttcatcggtaacagcaagctagtttgcaattgttggtcctctttttcggatcactagcagttgaattcaggtgaaaatgcattcatgtgtgcgaaataggtatgttgaatttttgtttccaaatggaatcaacacattcagagttactaactgaccaactctcactctcgggcactaatcgatttactgctcgagttttctgatgacctgtttgcatacatagcttaccttttggttcatcaggagtgcaaggcgctgatgccggcgcaaccgatccagccctcgagccttcagcagtcgaggaaggacagataggacctcatacgttgtgccccgtggtacttcacattctttcagattactgagacagagcaaaacacaacaaatgtgttgctactggaagctatacccagatgaagaaatgcgtcatctggaagagcgataataaagatcatttgtcatctgctgtcaatacatatcatcttgaagcatcagctgctatcgatacatataattctttcctcttcagttcagtccacacaaaataactg

SEQ ID NO: 78017 - DNA, 639 bp, Triticum aestivum
  Clone ID: PAT_TA_78017
ccttacatgtcctcatcaccggctccaccaaaggtataggatacgcgttggcaaggaaatttctggaggctggtgataatgttataatctgctcgagatcagctcaaaaggtagaatctgtggtcggtgacttgaagaaggagtatggagagcaacatgtggaactgtctgtgatgttagagatggaaaggatgtaaaggcacttgtggagtttgcacgtgacaaacttaagcatattgatttatggatcaacaatgctggatcaaatgcatatacatacaaaccactagtggagacctctgacgaggctctcatggaaatcatcaccactaacacccttggattgatgatatgttgtcgtgaggcaataaatatgatgaggaaccaacctcgaggtggtcacatattcaaccttgatggtgctggttctgatggaaggccaactccaaggctgaattgcagatgaatgaagtgaataatgtgatggtgcacaatctatcggctttgggacatgcataaatgcatgactatcggatggcattcttcctcagtaatctataaataatgttgaggaagcaatcatgcaaattatatgtatatcatgtgcagcctggcatggtcacaacagatcttcttatg

SEQ ID NO: 78018 - DNA, 405 bp, Triticum aestivum
  Clone ID: PAT_TA_78018
gagttgttgaaacaagttgacacatggcaaatgaatgttgaacaacagctggcagatattgaactagcaagtaaacaaaaggctgtatttgaaagcctgaagtctggaaacgctgcccttaagtctatacagaatgagataaacattgatgatgtccaaaagctgatggatgacacagctgaggctaaggcttatcaagatgaaataaatgctgttctgggcgagcagctttcagctgaggatgaagaagctgttatggccgagtttgaaaatttggaagctcagcttgccgttgagtctttgccagacgctcctgttactgaagtacgacctgctccggctaacacagaaactgcatctgaggacatcgatgaggttattgagcttcctgatgtgcctactaaa

SEQ ID NO: 78019 - DNA, 687 bp, Triticum aestivum
  Clone ID: PAT_TA_78019
accgcgagtgcctcatcgtcgagaaccccgtctcccgctgccctccatcggcggtgccgtgcaaaaatggccaagcaggcccaggctcttcgtcatcaccgtcatggctcctcgcggatctatgagtggtgagggtacttctgatgctttttctcttcctgattgtgagcttgttacttcctttgggcgaggcgcgctgtagatgatggtggcttccttcaggctagatttggtgtggtgacaatggcttcctcccatggcggacagtacccatgtgtacgtcgacccatgtgtcgtgccattagttcttcccttgggttttgaaagacaaaatgctatgtcatttgttgaagctttagtgttggtgcttgcaaataaacaggacactcagggtgcatgaccacatacaacaatcagcaaggtcaaggcttcttttggtgatgatgcattttggcaagttgtcttcctgcaatgttagtctgtgaattggtggatgtggtctcttgaattgaactgatgcatggtcttcgtcctgcgcagatatgtgaactgatgtaaggtttgatgcatgccagtggtgtgccaaacttcatatgtaactgatagctatgttggatatttagatgtatctgtgatgatgggacatctacctatttatgtgatggcatatttatatgtaaaaaaaaa

SEQ ID NO: 78020 - DNA, 532 bp, Triticum aestivum
  Clone ID: PAT_TA_78020
ttagctgatgctctagctcttgctcagcaccatgatgctgttacaggaacggagaagcaacatgtcgcaaatgactatgcaaagagattatcaattggctatacacaagccgagaagctggtttcatcctctctctcttgcttgagccagtcaggctcaaaatcacattgtccgtcccaaacaacgaattttgaacagtgtccgctcctaaatattacatattgccccccttccgagatggacctttctcaagggaaaagtttggttgtgcttgtgtacaactctcttgggtggaaacgggaggatgtccttcgcataccggtcatcagtgactcaattgttgttcatgattctgagggaagagaagttgaatcacaacttctgcctatagctaatgcatctttgtacatgcgggagaaacatgtcaaggcttacctaggcatgttaccagctgcaaaacccaagttttggcttgcttttccaagttccggaccacctcttgggttcaatacggactttatatcaagcggga

SEQ ID NO: 78021 - DNA, 672 bp, Triticum aestivum
  Clone ID: PAT_TA_78021
tatgttttaggatactctggatcgattatggtccctttaggctggatcggcggcacatgcggcctcctcctagctgccgccgtttccatgtatgctaatgctcttcttgcacggcttcatgaagtcggtggcaagcgccatatcagatacagagatcttgctggacacatatatggacgaaaaatttatgggcttacatgggctctgcagtacattaaccttttcatgatcaacactggttttatcatcttagctggacaagctctcaaggcaacatatggactctttagtgatgctggagttctgaaactcccttactgcattgcaatatcaggattcgtttgtgctctttttgcctttggaatcccttatttatctgccctcaggatttggttgggattctccacgcttttcagcctcatctatattgtgatagcatttgtgctgtcattgagagatgggataacctcgcctgcgagggattatagtattcccaaatcatcaggttcaactcatgtcttcactacgataggtgccgtagcagaccttgtgtttgcttacaacactggtatgctgccagaaattcaggcaaccataaggcctcctgtggtcaagaacatggagaaagctctatggttccaggtcaccgttggctccttgcctctctatgct

SEQ ID NO: 78022 - DNA, 440 bp, Triticum aestivum
  Clone ID: PAT_TA_78022
agccttcagcacagcagccaagaattgggcacattatccaaatatccatttcggtttaaactccggacgagagggtggcaagaagctcgtggatgaggctgttgcagcagcaccggctccgaaaaagatccaaggtttctactgatagatgtccgagctcatcaatcatcaactgggtggaagaattaataccacaaattataatttactgtaagtaaagaattaagggggaaagggaaagttaagttataattaccttataccttattaatgggtgaaaacttgtgaagagatgtaccgtacatagtaacagtggtgagtgataagtgggaagtgaagcatacaatcacatgaattgctattaggcgccatgcacttgcattggttgaactgagaagacttaataaaccatttgacgacctaaaaaaaaaaaaaaaaaa

SEQ ID NO: 78023 - DNA, 494 bp, Triticum aestivum
  Clone ID: PAT_TA_78023
gggtcttcccgtcccctccccgacaccacagtgacagttggtagttgcttttttcatttgatttcacactagtgtaagtaaattgggatagtggcagcttagagagagattattagtagtagtaggagagtgagagaagaaaggcgcccagctcgtagcttttcagctcgtgcttgcttctagagaccgagcaaccagagctcagctggcggcgcctcttgctagtatagagtagtatatttttttttccttcttcgctttatcccttttttttctttggattggatgacatggatatgcatccagctcctccagttgttgtcactcggtccagtggactggggtgtctaggatcttggttgctgctacttgctcgccattgccacccagttgcagttgctgtgctgctgaggtgttgctggcttggctcctatatcagtcagtgtgtgtacatttgttcatagtagtataatatatatatgattgatgatgat

SEQ ID NO: 78024 - DNA, 422 bp, Triticum aestivum
  Clone ID: PAT_TA_78024
tcctcgtccggaagccctctatctcctcagccacctctggaaatctgaacccaaatgtcctagctgagcttttttccttgtaccgcgaatggcaagaagagaatgccaagaaaattagccgaaagcaggaggaaatagaaaacaagatagaaacagctgatgcattggcagttaagcttctccagcggttcaactattctcttacttccatgagatccacctcccacaatcttgctgaagttcatccgctgcagatcgaagttggtgagttgaagggcagcttaactgaagttataagtaactgcgacgcactgtgcaagagaattgctgcagaaggaccggaaagcctacgatcatctggtcaacctttcattcctgctagagcagaggcataaggaagcggggcacttgacccaaaacag

SEQ ID NO: 78025 - DNA, 616 bp, Triticum aestivum
  Clone ID: PAT_TA_78025
tccataggttcctggagcttaatattgttcacgagctcattgacatgatgcaatgcaacatcgacgagctccaggattcagcatactatgctctccatcagatcatctttgcaaagggtggatcccttgtcttgcaaagattcctgcaacttggaaccatagagaaactggtgaacttgctcgaccgcaagtctttgaagaccaaggatctagccatgcaattcctggtggacattgcggaggttggaaccaagccctgcatcgagagaatgctctcttctcaagtcgtcgagaagcttgtggcccttgagaaagctggcgatcctttcggtggcgcagtgtcaaggtacatccagggactgaacatgtgcaagaaactccagactgctgagagggccgtgatgaagcaacatattctgaggaaggtccgatcagcagtgagaggtcataagctggaggccagcctagtagcttctgtggaggcctccatcgctgaaggctccagaggagccagtagtagtagtaggaaaaagaaataagcattttgctgcgcttttcagcagtcaagataatcactcattgatgtaaatatatataggtctctgggacattgctg

SEQ ID NO: 78026 - DNA, 273 bp, Triticum aestivum
  Clone ID: PAT_TA_78026
acaagctcgaccatgccatgacgaaaggcgacgggaaggatctgacaggcttgccttgaaggtgaggagcgcggtccactcgtttgtcatgcagcttctgccatctgctctttgctcttgctctcgctcatgggtggaagaagtggattgtgcatattgtaagaccaggaggatgaacactattatagcagctccttggaaccggcgatgagcagtcatcattttcttgttaataaaatttgacagacgtctctacaaaaaaaaaaaaaaaaa

SEQ ID NO: 78027 - DNA, 341 bp, Triticum aestivum
  Clone ID: PAT_TA_78027
ttctttcccgtgcgatatctcactatggagccaatcgaataatgtggggaagtgactttccctatgttgttcctgaatgtggctacaaaggagcaagggaggcaatttctcttgtcgcaggcaagatacctgtttccctgtcagatttggattggatcttggggaaaacggtgagccaactattccaaggtgcatgggttactccatgatcactgtagctggtaggacattgtattccaaatcaactatatcaaggggaatatttgtcctattttccagtgtttacatatactctctccgcttcaaataaaatgtgttttaataaaaaaaaaaaaaaaaaa

SEQ ID NO: 78028 - DNA, 250 bp, Triticum aestivum
  Clone ID: PAT_TA_78028
tggcgaatggctccatcgccatatctttcctggcatttgcagttttcgccatctgctcccttatctccgcatacaatctgttccgccgagacgtgtagctgctctttgtcaacttgatgcccttctatggccaaagttttcagtgcggacttcaacattgtgttgtacttgtacatgtatatatatgtgatgggaactctaaacttctagcaataatattatcaacatattgaaaaaaaaaaaaaaaaaa

SEQ ID NO: 78029 - DNA, 544 bp, Triticum aestivum
  Clone ID: PAT_TA_78029
cggatcgccgggtcgatacggccggagtcgctcaagaagttcgttgacaccgcggagaagtgcctcgcggagtacggcgtggagcggcccgccatgggggacgtgctctggtgcctcgagttcgcgctgcagctgcaggaggcgtcgctggacagctccggcacaaaggcgtcgccggacagctccggcacagacaacacgcagctagttctcaggaatgcgtccagattacatcgcaaccagtcgaacgccagcgacggggcagaggccaacttgggggacctcgatggtatgtccatgaggagagttttttcaaagatgatcaagagcgaggagggtaggtgaagctaaaattatcttgcatcttcgcatcatcccatgtacaggacggcaaaacggcaaagacaatagcccatttcggttccatatttgtcaatttcaacaagtatagaagaaacaatgtacattcacacatgtagaaacaatgtacgcacaatgctgcgcgtcatcatctgcacaagaggaataatctctcatatgaaaa

SEQ ID NO: 78030 - DNA, 543 bp, Triticum aestivum
  Clone ID: PAT_TA_78030
aaggcactggatggcttcaacttcagtgctgctgccaaggtttttgaagaggaaatcagagaagtggcttttggaacatttggagggctaggtattgctggactgtcagcttctcttttgacatctgttttgtcaactactcttgaagatcttcttgctcttgcgctttgctcagctggcgggttttttgttttatcaagtttccctggtcgacggaagcttgcaatacagaaggttaacaaggctgccgatgaactctcgagaaaagttgatgaagctatccaaaaggatatctcacagagtgctaatgacctaatccgctttgttgaggtcatcagcaaaccttaccaggaagcatgccagcgaaaaatagattggttacagggcgttcagggtgagctatctgctgtcgagcgtaagctccaaactttgaaagttgaaatccaaaatcttcatggatcgtgaggtctcattacaccttgcttatttgcaattaattctttggatggacatactaatcattttttgctgccttatactgca

SEQ ID NO: 78031 - DNA, 537 bp, Triticum aestivum
  Clone ID: PAT_TA_78031
ctcccggccaagggcgccaagcgcgtgttttctgacgaggcgcccccgccatctcccgctgccgctgccgggaagggaaagaaggtggcggaagaggaggacgacgacaagaaggttgcagcgacgccgcagccggccgcaaaagctcaggtggtgggatggccaccaatccgcagctaccgcaagaacacgatggctaccacccagctgaagggtagcaaggaggatactgaggccaagcagggccagggattcctgtacgtcaaggtcagcatggatggcgcgccgtacctgaggaagattgacctcaagacttacaagaactacaaggacctgtctactgcgcttgagaagatgttcagtggcttcagtactggtgagatgtctcgggttactctccctcttcggatggcgcgtcagtatgtaattgtgttccattttgatgtggatgctgttagaagtacatcaagaaacctttaaaaagcatcatacttgattcctaggataagcaataccttcaacttaccggtatttttt

SEQ ID NO: 78032 - DNA, 491 bp, Triticum aestivum
  Clone ID: PAT_TA_78032
atcctgctgccgccggtcggcgtcttcctccgctacggcatcggggttgagttctggatctgcctgctgctcaccatcctgggatacatcccgggcattatctatgccgtctacgtcctcgtcgcatgattatgattattatatataattatgatgtgtgataatgaccggccgggagctagattggttcgagaccacgggtttctgaattctgatccatccattccatacatgtagcccatgctgtatgttcttgtatcttctaaattagcttagctagcggttgtttctcttgtgtcctgatccattttgttgtgcccatggacaaggatgggagaaaggaactgtagcttcgatgcttcgtctatgcaagtgtgctagatctagtctagagtttctactctactaatttcgagtccagacatgtttctgaaatctgcatgcactgcgatgtttgtttaatataatatatgtggggatgctgatgcaaa

SEQ ID NO: 78033 - DNA, 406 bp, Triticum aestivum
  Clone ID: PAT_TA_78033
cacgcctcccgttctccgctactccactctacctaccgcagtaccgccccacgcttcagcgctcggccgccgccctccagtccgcacgcacgcacgcacggcacgagctcgccgcgatgtcatggctcgctcgctccatcgccgccacactatcctccgcccactctgacgacgacgatgaatccgagtccccctccggcgacaagagcccgccgcgcgcctctgaccccaccagcgctgacaccgtggagtccgacgagcagccggacaccccgagccgcggcgttaagggcgatatctcggagctgaccgagtccctcacccgccggttctggggcgttgcctccttcctcgcgccaccgccggttgagggagaggcgggggaagaggaggaggaggaggagga

SEQ ID NO: 78034 - DNA, 559 bp, Triticum aestivum
  Clone ID: PAT_TA_78034
catttggtgatgttgcactcttgggaaatgttgccaagtatgagacaatgcgatccctttggatgtcatcatgtgatgtcacattaaaggggtgccaagtccttgcatcgaagatgccgatgctcaatgtggagatcatgaatgaactagatggaagtagtgaaatggaggagaaccacacagacatctctaaagtggataagttacatgttagtgaaatggaggagaaccacacagacctctctaaagtggataagttatatgtttaccgcacaactgctggagcgagggatgatgcaccaaattttgttaaaatcttatagagctagctgcgactaccctggtatcttcccaccctaagatggtcggtggaatccggcatgcctgggaccggggcaacagtggtaagttcttgaatcgtctcccctttgcagggtcaggaaaagccccactggtgtgtgcccttatcttggagcaacatggctggatccatcatcatcctctgtaccaccgcccactctttcagtgtctggtcatatggccacccaggccctttatc

SEQ ID NO: 78035 - DNA, 226 bp, Triticum aestivum
  Clone ID: PAT_TA_78035
atccagcgtcgggccgcgcgtgcgagatgtcggccgccggggaggaggacaagaagccggcggggggagagggcggcggcgcccacatcaacctcaaggtcaagggacaggatgggaacgaggtattcttccgcatcaagagatctacgcagctgaagaatctgatgaacgcctattgtgaccgtcaggctgtggatatgaatgctattgcattcctatttgatgg

SEQ ID NO: 78036 - DNA, 523 bp, Triticum aestivum
  Clone ID: PAT_TA_78036
gaccgccgccgcctagagatgaatccgcaccaagagcaccaaggggtggtggtggtggtggtggcggtggtagctttgtcgattcagcgaacaaggtctatgtggggaaccttgcatggggcgttgataactcaactctggagaacctattcagtgagcaagggcaggtgcttgatgctaaggtcatctatgacagggagagcggcaggtcaagggggtttggtttcgtcacctatggcacagccgcggaggtcaacaatgccatatcaaaccttgatggcatccacttggatggtagacagatccgagtcacggttgcagaatcaaagccgaggcgtcaattttgagattttgtttacgcagtttacaggttaatagtgtgtttcacaagttttactttgtagcgtctattctttcctccatatgactaacaagaagatgatgataatgagaaactgcaagtgaaatatctgtacacaggaaaatatttttcccagccctacaatgaacacgattgcgcctt

SEQ ID NO: 78037 - DNA, 535 bp, Triticum aestivum
  Clone ID: PAT_TA_78037
gcatgaactatgattgtggaacatcgatccatctctacgcacggcatccaaaaggcaaaaacaaaaacataacgcatgaagaaaaacaaaacacagtatatgttagatgaggtgtatattcatacttgctgcagccacacgatagcataggaaggcacctgcatcaaaaagaccatggcataggaagggtcgctgtagtagccagaggaaggaaggccaccattgatcagggaagagggtcagcaccacctgatctgtccccagtcgccgatggccatgccgccagccaaaggctgcctgcccgctgatgccggagccgccatcagtggtgggatggagccctgacgccatagttgatgaagaggacgagccttgtgcggtggatccgctagggaaagaggcaactgccgtcgttggcttgcggtggagccgcaccacagacgagtcgcatccgcacgacggcacgaggcgagccgctcgcgactggatctgctagaggaggagggccaccgagcgcgctgacctgaccgtgctg

SEQ ID NO: 78038 - DNA, 530 bp, Triticum aestivum
  Clone ID: PAT_TA_78038
ggtcgtgctcatgggcttcgtcgagggctaccgcgtcggcggcggcccgctcggggaagggctcgacaaggtctaccccggcggcgcgttcgacccgctcgggctcgccgatgaccccgacaccgccgcggagctcaaggtgaaggagctcaagaacggccgcctcgccatgttctccatgtttgggttcttcgtccaggccatcgtcaccggcaagggacccatcgagaacctcttcgaccatgtcgctgaccccgtcgccaacaacgcctgggcttacgccaccaacttcgtccccggcaactaaagctgatcgagcgagcgagctgaagctgagcagagcatccatgcgtgcatgtcgagcgaggtctcttgtactctacttgttgttttcaatcgtaggcgtgtagtagttgcacgagatcgatgtaaactaagcacagatcgcatgtaacatcagtgtggatgaatcaatctatatcgatggcctgtaccatattcaattttcgatcaatcatcggtaattactc

SEQ ID NO: 78039 - DNA, 446 bp, Triticum aestivum
  Clone ID: PAT_TA_78039
gaacctacgtacaaaattcgtcatttttcgttctcccctgtcagagatcacaatcaagttggagcagtgtgcattgacagcaacagattgctgtttgctgcatcaacgctggattgatctgatgctgacctgaatttgttgctgtggcggaagttgccggcgaggcgtgccggctcgcaagctccggcgttgacagaattggagttggaagggcagacttgcttcctcttggtgaaggcagcgacgaatacctgatgaattttacacggttattagaagtagtagttttgcactctgagcagagacagtgcaaatatatttttacattgtttgcacaaagaaagcgcgtgactgaacattgaggcgcagatattgctcgtgtgacagcttaaacaaacattcagtcagttgtgtcgttaagaaaaacagaaaaaaaaaaaaaaaaa

SEQ ID NO: 78040 - DNA, 557 bp, Triticum aestivum
  Clone ID: PAT_TA_78040
cagacatcctgaattcatacttgaacaagtaccgtattgagcttgacccacagcttgaagccctggttggaaggcacagcaggaaaccttggtcaaagtttattaatgctgacaaccaacatctagtatccccagaggccatcgatttccttgacaagcttcttcgctatgatcaccaggatagacttactgcacgtgaagctatggcacacccatactttctccaagtgagggctgcggagaacagtaggcctcgtgcacaatagacaaaagaacgggactattgctgactgtcgattagcagcagtcatggagctgcaccgtattagtgacttagtccagtcacttgtattgggagtttgagattcggtaatggttgaatcacctggcaagaggattctgggagagcatgtaacagctcatgtgtgcttaaccgcaaacgtggattgtgatttactcgtgttgtttgtatctttgtttctgacgattgattgaaacacattgttcatgtaactcgttgagtataaatgtttttttttaaaaaaaaaaaaaaaaaa

SEQ ID NO: 78041 - DNA, 474 bp, Triticum aestivum
  Clone ID: PAT_TA_78041
gacgccgacaggtgtggccgtgtggtgcgcgagcacttgcgggggttcgcggcgccaggctgccagcgtgtggcctcccggctttccgccactgtcagttatatggtgagctgatgtcaaaggcacgtaatgctttagttgccactggattactggtcttcgctggtgctggtttatcatttccgttccttttcgtgaaatcaaagaacaggcctatcattgattcgtcaaaacctctgccaccacaggctacattccgaggaccatatgtgaatacgggatcacgtgatattggacctgatcctaccaactatcccaagaagtgatttaatcttccatgatgtttcgaggtcctgtgtgagctatgtggaaaagttttgagtctatgtaatttgcctcactcatatttggtccctgtatgagtgaggatcatgttttggaccaccctttttctctttaatacaatgaaacact

SEQ ID NO: 78042 - DNA, 249 bp, Triticum aestivum
  Clone ID: PAT_TA_78042
cggcggcgaaggagctcggctgccctctcccctgctgacaaggccagtcccggatctgacatcggaggccacttgacggccagtgctggcagcagctgcatgcagggccggcgagtaggacgctaatctctcgatcaaggacgactcgccggtttgttcacacgatatgtgattaagctgatattaccatggggtttccaaagcatatacgggacttgctcccattgtgcgatttcatttcaacctgac

SEQ ID NO: 78043 - DNA, 281 bp, Triticum aestivum
  Clone ID: PAT_TA_78043
tcctcctcctcctccccctcgcctccgccgtccccacgccaagaagcctgcgcctggtggggaggagccagctgcagcagcgcccgccggctctgaagctcacttctgctcaggagacggcgatcgcggcggcgatgaacatgggcaagcctatggcgaggatggtcgtggaggtgaacgactaccaaccgactggccccaacaaccgccatgacccacccaagggtcccggaagagcttgaacaacggagctcaactagacggaccacccaataatcctt

SEQ ID NO: 78044 - DNA, 620 bp, Triticum aestivum
  Clone ID: PAT_TA_78044
aggtgaggagatttatgtaggtccagtaggtcagcactcgtgtgaattgatcagatattttgagtctattgaaggtgtcagcaaaataaaacatggctacaatccatcaacatggatgctggaagtgactagtactgtacaggaacagataactggggttaacttcagtgaaatatacaagaattctgaactgtacaggaggaataaaagtatgataaaggagctaagctcacctcctgatggttcaagtgacctatcctttccaacagaatactctcaaactttcatcacacaatgtttggcttgcctatggaagcaaagtctgtcctactggagaaaccctccatatactgctgtcaaatacttctacaccattgtaattgcactgttgtttggaacaatgttctggggtgttggcagaaaaaggagcaatcaacaggacttgttcaatgccatgggctccatgtatgcgtcagttttatttatgggagtgcagaattcttcttccgttcagccagttgtgtctgttgaacgcactgtgttctacagggaacgagcagctcacatgtattcacctttgccatacgccttgggacaggttgcaattgaacttccataca

SEQ ID NO: 78045 - DNA, 527 bp, Triticum aestivum
  Clone ID: PAT_TA_78045
gggcctgagacggaggagaagtaaccaagcgtctcaagcaacctcccgcccccgcccctcgtttcctccctccctccatttcacacccaccgccccgccggccgccacacctcctccctcttgtcttctctcctctctctcgacaaagaaccagctagcgcacacagcccgagcgatccattcccatagccacccgccgccatgtctgcgtcgccggagttctacaagccagcgccgccggcgttctcgccgtgcagctcgccgctgctcctgcacggggcggtagcggaggagagcactaccgccggcgccgggaccatgtggccgcagcagcaggaggaggaggactaccggtgccggacgccgacgagcggggagagccaggtgaagccgctggggacgtgcccgccggcgccgcggaagccgcgggcgccagcggcccccgcgccgtgccggaagcgcctgttcgaggtggaggtgttcagcctaaggctggaggagctggagcgcctcttctggcgcccgca

SEQ ID NO: 78046 - DNA, 337 bp, Triticum aestivum
  Clone ID: PAT_TA_78046
ctttccttggaccacttgtacttcaacagaatgagctgttgacaactattcttctatttggtgcccgtgcgtgtgccatggggagctttacagttttgtgtctttatgctccagaggtatatccaacagttgtccgctcaaccggtgcaggaattgcaaccgccgttggtagaattggtggggttgtttgccctcttgttgctgtcgctatgctgcggagctgccaccagatggaagcactcattgtgtttgaggtgatattatgccttgctgcagttgcctgcatattcttccctgtagagaccaagggccgtggaatggattgattttgtagtat

SEQ ID NO: 78047 - DNA, 274 bp, Triticum aestivum
  Clone ID: PAT_TA_78047
cacgacttcaccgtcaaggatgccagcggcaaagacgttgacctcagcacctacaaggggaaggttcttctcatcgttaacgtcgcatcccagtgtggcttaaccaactccaactacaccgagctggaccagctctatgagaagtacaaggaccaaggctttgaaattctggctttcccatgcaaccagcttggtgggcaggaacctggaaccaacgaagagattgtgcaaattgcctgcacacacttcaaggctgattaccccatcttctaca

SEQ ID NO: 78048 - DNA, 263 bp, Triticum aestivum
  Clone ID: PAT_TA_78048
cgtgacagtgaggaggaaggaagaaaggcagggatcgacatgtcgaggcccaacaggagcgacgcgcacctctccgccgaggacgaggcgacgctggaggccgaggtgcgggggtactacgacgacgcggcgcccaagcgccacaccaagccctcccgcagcgagcactccgccgtgtacgccgacgcgctcgtcccggacgccggcggcaacacccctccggagctcgacaaggtccaggagctcgaaggccacaccgagag

SEQ ID NO: 78049 - DNA, 470 bp, Triticum aestivum
  Clone ID: PAT_TA_78049
gtggcgcatgaccccgtggtttcattcaagacggcgctctggctctggatgaccaacgcgcacaaggtgatgccaacgcaggggttcggcgccactatcagggtcctccacggcgccctcgagtgcaacggcaagaaccccgccgcgatgaaggcgcgggtgggctactacaaggactactgcaagcagttcggtgtcgacccagggaacaacgtcacctgctagatgtgccggagttgctcgtgaagaataaaatggcctggcggcggctggagtgaaactcagataggagtattcacggatgcgtagtagcaataaaagatacatggactgggtctgtgttattcgacctgaataacgaagagagtggcgtagacaagcaaacaacactcaacacccacctctcctagaaagaatggatcggttacctatcaacatttgttttactccataaaaaaaaaaaaaaaaaa

SEQ ID NO: 78050 - DNA, 587 bp, Triticum aestivum
  Clone ID: PAT_TA_78050
ttgatggaaactgcctagccgaagttgtttttcaggagatagattccctattacagaagatctgtgtgaacacttcagcgaacaagttgaccaaaacaaatggaaaacgaccagattctgtggatacagtttcaaaaaatgtatgcacaagataatactttagtttcatctgacttgtgcaagaatttttaatgtgaactacaaagatttggatctgtatggttcatatgcaccctacggctgttaaccaggaatggcgtggaattccaacaaggttgaataacattccacattctagggaaattagggaatacttctacaacgatgtggtaaaagctacaaaacttgctattgaagataaaaagactcggttgcagatagatatcaatattcctgagcttaaccctgaagtggatgtttatcgcataggaacccttatggaacttgtaagagaactttctctatcctttgctgacgatggaaaacgtgtcaagtcacttgatagcaggtctgtgttcaaggctccatggggcaaggtgcatttgctggcatcccactccaactggcaggaatcagaaaaattttgg

SEQ ID NO: 78051 - DNA, 250 bp, Triticum aestivum
  Clone ID: PAT_TA_78051
agagctccaacacataccagatggcagggtgtgaagaacagaagacctacaactatatcagcagctcctccttatcccaataggatgtaccctacctctcgaccttatactcagtataggagttcaataaaaactggtcttccctacggggacctacaggagtactggttatgattccaggatatatagatcgtgggggcttccaacgggggtaatatactttgttagccaccacaattttctccatatt

SEQ ID NO: 78052 - DNA, 685 bp, Triticum aestivum
  Clone ID: PAT_TA_78052
cgtggctgccacagctggaggtgtttctcagataagagcattatcaggatgcacagctggtggggaggatatacttcagaacataatgcgccatgttgttcccaattttgacaatttatatgctggccagacaatggatagaatccagtcgatgagtttactgcgaatggcaactcaagatgcaattcacaaactggttaaccaggaaactgtggagatcaatatagatttggggaatggccacaaagtgtccaaagtcctagaccattcagagtttgaacaagtcaaccgggcaatttttgataagtgtgaaaagatcatcaaccagtgcttggttgatgcgaagttagtaccagaggacatcaatgatgtcatattggttggtggttgttcgaagatccccagaatcagaagccttgtcctgggtctatgcaagaaggagatctcttacaagaacatagatgctctagaagccgctgtttctggtgctgcgctggaaggagccatcgcttcaggagtgaatgatccttcagggagcttggatcttctcacaatccaggcaactcctatgaacctgggaatccgtgccaatggcgatagctttgctgcaatcattcccaggaacacgacagtgccagccagaagggacatgctgttcacaacgacacatgacaaccagactgaa

SEQ ID NO: 78053 - DNA, 580 bp, Triticum aestivum
  Clone ID: PAT_TA_78053
atgttgcctgcagctactcgaaactcggccggatagaagctgggctttctgcactggaggaagccctgaaggcagggtatgaagacttcaagagagtccgcaccgacccggatctcgcgaacctgaggaagtcagaggaatttgagcccttgctgaagaattacgacgagtcgttcatcaatgagaatgccatcaacgccatcaaatccttgttcggattgggaaagaattgagcaactgaaacatggtggtaggccggtagcagcaggaggcaatgcctctcagctctggtcttgcagtttttgcatactgcagaagcctaccaaggcttaagctcatgcccatacagttcagctccccccactctgccagtagtttgcagttcacacctgtaccttagctattcttggtgaggctgactatctctgggagatgcctccttgccctcgtacttaaccatttgctgtttgatgcagatacattatgtatatgagtattatatccaatttgtaaaggaaacatgagtacattatgtaaagaaaatgtgcaggtgtgcttgtaagccatgccaaatatgtta

SEQ ID NO: 78054 - DNA, 621 bp, Triticum aestivum
  Clone ID: PAT_TA_78054
tctatgtgctggccagaagcgataaccacctatggacaatgaaaactcgcaggagccgcaacaagttgaaagggaacttggaaagcttttctcaaagggagggggttctggagttggaactaaatcaaagactctggctccaagtttaacatggttgttgaagatatcagagagggagtactgatatttgaggatgaggacgatgctgtaaaatactgcgaccttctgcagggcggcggtcaaggatgcgagggaattgcagagatagaagcatcatcagttttcaacatgtgccgtaacatgaaagcccttgctgttcttttccgccgcggaaggactcctccattgcctcagagcctggagcgtgacttaagggcgagaaagcggtcaccactggaagactagagctgtctgtttacactgtatagaatcgttaattgtattcatctagctgttggaagcatgggccctaggccttgtatacaacatagtagtacatagtagtccctagctgaaatggaaccagacgagtctgacagcaaacacagacgaaattgctcgataccagaagtttctttgaaattggattggatggatactcttgtaattatgagcaaccat

SEQ ID NO: 78055 - DNA, 377 bp, Triticum aestivum
  Clone ID: PAT_TA_78055
gaaggagatgaagttttacacattgagctgcgtaaatgggcagatattatggtgattgctccgttatcagcaaataccctggctaagatcgccggtgggttatgctgacaactctcttaacatgcatcgtgagagcgtgggactacagcaaaccgctctttgttgccccagctatgaacacattaatgtggaacaacccattcacagagcgtcatcttcaaacgatcaaccaactgggcataatcttgatccccccagttaccaaaaggttggcttgtggcgatcacgggaatggtgcaatggttgaaacctcgcagatctatacttctgtgaggcttgcatggaagacgcaaccacatgatgcaagcagttcactt

SEQ ID NO: 78056 - DNA, 502 bp, Triticum aestivum
  Clone ID: PAT_TA_78056
cttgtcgatgttgctggtgggctttgcggggccgctgctaccatagtggcggcgttcccggatttgaagtgcaccgtgctggatctcccacatgttgtcgccaaggctcccactgacaccaacgtgcattacgttgctggtgacatttttcaaagtattccaccggcaaacgcagtgttcctcaaggtacatacctcgcattcctgatatttcgcatgcaaattgagcttgacattaatttcatttccgtatgaatgcagcaactagcaaatacaccaacgtatatacagttatgcatctaaaatcgatcagaacgcaaaaacaaacactgataacgtcatgttgatgtgcttccttttcccccttaaatgacaagctacatatatacacacacttcaaataattgcttataattttgcttggttaacttgatgaatggctgcttgtttcatcagtggattctgcatgactggcacgatgatgagtgtgtcaagatactgaa

SEQ ID NO: 78057 - DNA, 540 bp, Triticum aestivum
  unsure (1)..(540): unsure at all n locations
  Clone ID: PAT_TA_78057
atttcggcctcgccaggaacttcatggatgatcagagccatctcagcaccggcctcgccggaacctttggatacatggctccggagtacatcgtccacgggcagctcaccgagaaggctgacatctacagctacggcgtgctggtcctcgagatcgtcaccggccggaagagccacaactcggtggcgtcgtcgacagaaggcctttcactcatggcactgatatggagacactacaacgccggcaccctgatggagctgctggacccaaacctccgggagcagtgcacggaggaggacgcgctccgggtgttccacgtcggcctactctgtgctcaggcgtcgccgaacctccggccgccgatgtggaaggtggtggagatgctgancggcagggatcatcacaaggtggtgcttccccggcctactcagccgccgttcatcaacgtcaaggtgtcgaagaacgccaagagcgacggcagctccgggtcggcgtcgctcatgtccaactccgacaagtcgccattgtcgctgaaccagc

SEQ ID NO: 78058 - DNA, 581 bp, Triticum aestivum
  Clone ID: PAT_TA_78058
acgagggttaatcttttattaatcaataagaggacgtgaatgttacacatatacgtttatactatttaccgaaagtttttacaattaatttaaaacaatgtctgttctaagaattgatacaaatgtttcacatgtggacattgatgatgaatttttagtgctgtgtacagaagctcttgctaaaactttccaaaaaccaaaatctgatattttagtatttgttaatggagaccaacccattattattgctggttctacagaaccagcagtaattgtatcattactcagcgtagatggaataaatgcaaatattaacaaactccactctgcagcattgtttccattgtttacaaaatatctaaaaattaatgaaaatagaattacaattgcattcagtccaattgagcctcatgccatgggacacaatggaaaaatgataactcaataaaactttattatttatattgtataaattattgatttaaaatgccactattggaaattggtgtattgttggtatttagaaggcaatttattatgaccaaataatatatatatatatatatatatatatataaaaa

SEQ ID NO: 78059 - DNA, 481 bp, Triticum aestivum
  Clone ID: PAT_TA_78059
tattttctaggtacgcagattggaaaccgagcgtgataacctaaagaaagatgccgccatctacaactacattcaagagcgtcttcagaagtcagcagcatacaaaatgatcatggagctcggtactatggagatggaggcccaagagatatcattcgaggagctgctggctaaggagaaggaggacaccgccttctggcagcgcaacgggaagatgagatcattctcatccaagtaggacacaatgtccctacctgggctcactgacgatggcagatctcaacatcggtagtctaaacatgaaatcctagcctgctccttgagagcagctgctgtatgcggtatgcctgcataccgtttggtgtaacgctgcgctcgtctgacaagatgttgggcccctgtcactcaggagtctcctggcatgattctgggcagattaataaaagagctgtgtcgtgataaaaaaaaaaaaaaaaaaaaa

SEQ ID NO: 78060 - DNA, 614 bp, Triticum aestivum
  Clone ID: PAT_TA_78060
ctggaggagtatctgggttcttgttgctgctgttgtactacatagttgatgttattcatattaagaagcccttcgtactattccagtggatgggcatgaacgcacttatagtctatgttctagctgcttgcgagctgttccccacccttattcaagggttttattggcggtcacctgagaacaacctggtggatgttactgaatctctgctccaggccgtcttccagtcgaaacgatggggcaccttggcgttcgtcctcctggagatagtcttttggtgcttggccgctggcttcctgcacatgaaaggcatctacttgaaactgtagaaccaaatcgtcgacagttctctgatggacggaatcgatgacctgtaaatattggtgaaacgcctggtaaccctgttttatctgtaaatgcaacacgactctggaaccatgggtctagtggttgatttcagcacgttgtggtgtcaaggtcgatatcatccgcctccaagtagacaaggaaaatgtattgctggaagttgcaagtgtttcaccacgtaatcttgctgtttcacactcgtaatcttgtgaaaaactcaaaaatacttcaaaaaaaaaaaaaaaaaa

SEQ ID NO: 78061 - DNA, 603 bp, Triticum aestivum
  Clone ID: PAT_TA_78061
ggggccttcggtgcttctgcgccatttgctcttgggaagcagatccacgccctggtcataaaaaaatgcttcggagggaacacctatgtctgcaatggtctgatcaatatgtattctaaatgcggtgaactacaggagtctatcgaagtgtttgatggaacgccgagcaagaatacagttacatggaattccatcattgcggcctttgcacgacatggtcatggttccgaggtttttggattgtttgagtctatgaaagccgatggtgttaagcccactaatgtcacattcttgtcactgctccatggatgcagccatgttggatcagccagcaagggactggagatattgaattccatgtcatcacaatatggaatccatccgaaggtggagcattatgcatgtgtggttgacatgcttggccgagccagccagctggatgatgccaaagcattcatagaagatggacctttcaaggacagcgctcttctctggcaggccttaatgggagcttgcagcttccataaggactcagaagttggaaaatatgcagcagagaagttgctcctcctggaccccgactgcactgccgcttatgtcttg

SEQ ID NO: 78062 - DNA, 297 bp, Triticum aestivum
  Clone ID: PAT_TA_78062
ccaggtgctcgccgcggcgcgcaccgacctcgtcaaccgtcttcagggcctacgggagaagctcgcgcacaagaaggctgaggcgagtaagactgattccgtccgtgcgcagattgaaaccatgcgccgggagatccagaagggcagagctgcggttgatttcgaaaagaaggcacactctgataacctcgaacaaagtaaagcaatggagaaaaatatgatttctgtggctagtgagattgagaggcttcgaggagagcttgcaaatgctgaaaaagggggcaccgctgtcaaccc

SEQ ID NO: 78063 - DNA, 571 bp, Triticum aestivum
  Clone ID: PAT_TA_78063
aatcttgttatcaaagatttctcctgtaccttgttggcaatccaatagaagaacaaaagttgtatgatgccgttgactgcatcctttattccatgaataaaggtggaaccttttcttcatatgaatgtcaaaggacaacttcttggctagagattcttaacccttctgaaaattttgtgaatattgtcatcgattatccatacgttgaatgcacatcatcagtactggaagcttttatattattcaaagagctatatcctttgtaccgtacccaagagatagatgaatgcataaataatgctgccatgtttattgagaacaaacaaaggaaggatggttcatggcatggcacatggggtatatgtttcacttgtggaaccatgtttgcggtaaaaggattagtggctgctggaagaacatatgatactagttcttccatccggaaagcatgcaacttcctgttgtcaaaacaacaaactacaggtggatggggggaaagctatctttctagtgaaacagggaaatatagtaatggagatacccatgcagtgaacactgcttgggcgatgct

SEQ ID NO: 78064 - DNA, 602 bp, Triticum aestivum
  Clone ID: PAT_TA_78064
ggcacgaggcaaatgctgttgctctggtggatgcgttcaactacacagaccactacctggggtcggtgctggggcggtatgacgggaatgtgtacccggcactgtatgaggaggcgtggaaggaccctttgaatgagacggtggtgcctgaggggtaccatgagtacctccggcccttgctcaagcagcagctcaagctctccaggctctgatctgtttggctacaccctgcaattctccatggcggttgcccttctcagagaatttgatacggtgaccccccattctgaatgaaagaatgaaataaactactaacgattcctgttaaagccaaggaagaggtggataaatataaatgtattctgtggtgaggatcatataagaagcacgttcaattaataaagaaagagcgagaggttgagcatctctctgctgttgctcaaatgttgtacgtagtgcaagcagtagaatgaatatgtacaagtgcatgtatggtgagttgaagtttcatttattagctaaaaatgtatcaggaaccaatggcttgatttgcctcatgcccaaaatgaaagccagattccaaacacataaaaaaaaaaaaa

SEQ ID NO: 78065 - DNA, 344 bp, Triticum aestivum
  Clone ID: PAT_TA_78065
acgaggttcggtatcggagcggtgccgattactttccctctccattctggattggggagcaggattgctggattagtgaccaacgcgtcgcatcaaaataaggcattctgagtgctgtatgatgtgtgtattctgaaagtgagactgcttttgttagatacaggcagcatggtaataatacataacgggtacccgctaggatgctacctgcagtccgtgttctgtcctctgttttttagtactcgtataatccccctgcaaaccatgtttacctgcagctcatgcttttgttatacagcatgatcatcgttaggagttaaaaaaaaaaaaaagaaacacaaaaa

SEQ ID NO: 78066 - DNA, 405 bp, Triticum aestivum
  Clone ID: PAT_TA_78066
gcacgaggcgcatttcacatacacaaaatatacagctcctcagctccacattgatcatttggccgttatatccagcgcggataaattaatccttgtcttcatcgctccatcgtcgtcgtctgaccgccgcccgccgtcgccgtgaccatcaacaatcaggctagctatagctcctgctgcggcctctgcatcgatcgccggcgccgcgactgccgggggagccgcgcgcggatcgtcgtcgatcggagccacacaagtacgcacagacatggctaagctcaaggcggcgcgcgccaccgacgtcccgtccgccttgccaccggagccggacatcgccgcggacctcgacggcctagcagccgccgcgtcgtcgtgctcgtgcatcagagcgggcgcggcggaggc

SEQ ID NO: 78067 - DNA, 401 bp, Triticum aestivum
  Clone ID: PAT_TA_78067
catggtctctgctgaagagtcttcagaggctgcaaagggcaagtctcaagtgaagttcagtgtgaagaaaaactcaagaatacagatcaagagattgaagggcaaaggcaggaagaaagccaaaaatgcaaaaccacctgcgaaggagaaagttgatgccatggtagaatgacggacaatactgcatcactggaattatgatatgaaccttgtatgttttctcagagcttgcagcaagggctgcagggactgacctcagggaacactggagcttgaactgcctcttgcatctactactgcctgaatgttcattagaagctacttaggtctggtgttagtgtatcgaacttcaaacatgaatgtacctttaatagtggaatattcatgttttcattcaaaaa

SEQ ID NO: 78068 - DNA, 446 bp, Triticum aestivum
  unsure (1)..(446): unsure at all n locations
  Clone ID: PAT_TA_78068
gatcaagcaatgaatgcactcgaggaggaattttccttcctgtcatcatcaaagcagattgttagcgacatgaacgagaaagataaggttattgtctttgaacgtggagatttggtttttgttttcaattttcatcccaacaaaacttacaagggttacaaagtcggatgtgacttgcccgggaagtacagagtagctctggactctgatgctttggtctttggtggccatggaagagttggccatgatgtggatcacttcacgtctcccgagggaatgccaggagtaccagaaacaaatttcaacaaccgccctaactcattcaaagtcctttccccgccccgtacctgtgtggcttactatcgtgttgatgaagatcgtgaagagctcangaggggtggagcagttgcttctggaaagattgttacagagtatatcgatgttga

SEQ ID NO: 78069 - DNA, 452 bp, Triticum aestivum
  Clone ID: PAT_TA_78069
ctcttgtcctgtgtgttttcctgggagttttggctcaagattttgcaaatggtcggctacgatccttgctccacaagctgtggagttctcttgttgataggttggaaaaaaaatctgttgttggagttgataaaacctgattcggaagggacttaactccctcattattctaggggcctggaccttgtggaaccaccgcacccgttgtgtgtttaatagggtttctcctagtatagctagagcacttcagcttgcttgtgaagagctacagctgtggcgcctggaggcatttcctacctcctttgttcttgagccagatctaagtgaaatcttaggccaagggcatgtacatattttaaaggtgtgcatgaagaatggggacagtgtggttgtgtgttgtagtgttcttaccgcctttatttcttcttcttaataaaatggcacacagttct

SEQ ID NO: 78070 - DNA, 532 bp, Triticum aestivum
  Clone ID: PAT_TA_78070
gggccagaatggccttcagaagagaaagttaagcgccgggaaatggttgccccagaagcacgatatatctttgtccggcaatcttcaaatgccattaccacccaaaatattatgaagcaagattcaagactagaatttacacatgaagcatatggagtcttctgcccaggggaaggggctgggaaaatttctaatggagttggtcgaacttatagcctgtaagagccaaatgggagcagtaatgttaacagttcagaaagctaataaccttgctatggctttctacaagaagttgagatatgtaatatccagtacttcgccatcgcaagtagatccattgattggacttgaaaaaaactatgagattttatgcaaggcatttgaatctgaagcaaagtccatattagaggaaggcaactgaaaactcccagcgcaatgaccaatcttgttacaatgtgatgtgatgatggatgttgttcttcactacagtattgacaccttaccgggtacagcgctacagctcacgcttgag

SEQ ID NO: 78071 - DNA, 359 bp, Triticum aestivum
  unsure (1)..(359): unsure at all n locations
  Clone ID: PAT_TA_78071
tcctaggacccagcaacacaacagctgagctttgtttaggcaagatgaacaggaagccaggagactgggactgcaggtcgtgccagcacctcaacttcagccgtcgggacatatgccagcgctgcagtgaaccacgcggagttgctgatcgtggcagtggtggtggaggtgactatgccaacttcggtggccgtggcggttcctccttcggaggtggctttggtgctggctctgatgtccgccctggtgactggtactgctcctgcggtgcacacaacttcgccagccgctccagctgcttcaagtgctctgcctacaangaggaggctgctgtaaacagtggtgctggtggctttgat

SEQ ID NO: 78072 - DNA, 431 bp, Triticum aestivum
  Clone ID: PAT_TA_78072
tcctctccctcagattgagctctgcccagaagtagaggctacgaggccatcaatctgtgtgcgtctagccatggagggctccccccactcgcgctccttctccgcatggagcgctaccagcccacacggtgtagatccactacccctgcgtcctccccacgccggccgccggtggctgccgcatagatccgttcctcccccacctgctgcacgcgacggcgcacgctaccatgccgttttggtgcagcccagaccgctgcccctaccctcgcgctctaggcagaggctcatttttcttggtggtgactacacgttcctcccaggtggtggcgctctctgcctgctgtcttgcgtttctcccagcggctgtgccctttgaccactacctcgaatcagtttcgacaatggacatttgaacaaaatcatatact

SEQ ID NO: 78073 - DNA, 688 bp, Triticum aestivum
  Clone ID: PAT_TA_78073
ggcacgaggcagctttcaacattagttcggactgcagctcatcgttctgtttaccttttagatcattagtttcacaatgatcaagtcacagtgatgttcttgcaggtatgcaagaatatgtattagtgagaatccaggctgccttttcattgcgaccaaccgtgatccaactgggcatatgacatctgcccaagaatggccaggagctggaactatggttgctgcagtaagctgctcagtacagaaagaacccattgttgttggaaaaccttcaggatttttgatggacttcctcttgaaaagcttcaatctggagacgtcaaggatgtgcatggttggtgatagactggacacagacatattatttggccagaacactggttgcaagaccctccttgttttgtctggttgtactagcttaccagaactgcaggatgcttccaataacatccatccagatgtgtacacgaacagcgtgtatgatctagttgggttactgcagaagtaatctcttggacgcattgcagcgtcagagctctgtcctgactatgttaccgcaatctcagtacgctttggatagcgcctattatcaggaattattacgtggataacttacatgaaaaggtagcagttgtgcttgaaacaagaaatctttctttgggtacctgttctcttgacaatatgtaac

SEQ ID NO: 78074 - DNA, 439 bp, Triticum aestivum
  Clone ID: PAT_TA_78074
ggcacgaggctgcttatgcattagcttctattttcaataaatatctacacagtccagagttttcacgcgagaatcagctggataaaatacttgatgatattcttgagaggtgtttctcaactgtattagccaacagctcctcaaagatatcccactcttctgctggcacttcagatgatgttgattcctcagatgtcttctctggaaacaagctttctaagattaatatcttgtctagtttggcttggattggcaaaggatacttatgagaggagatgagaaggtgaaggacatttcaatgtttcttcttaagattctatgctcagatgagattttggctagtattccattccatcaggaagaaccttatagcggcaattcatcagatacttctctttgcatatctgcagctagtgcattccatgtgatgatgagtgat

SEQ ID NO: 78075 - DNA, 691 bp, Triticum aestivum
  Clone ID: PAT_TA_78075
tttttttttttttttttggagagtaattttcaatgtttcattataaattgtgtagctacaaatagaatttgaatccaaatgcataattcttgaactagtaatgttttatagaatccccggtgaagccaaaaagaaataagagaaaggaaacatcaaatggtagcattgatccctggcctgtccaataatgagcttagcagctccagtgctgctgggaatgatattgaaactagcagcccttccacccctccagtccttagctgagggcacatcaacagtcttctgggtagctgcaaggatccacacttatcacagtaaagactacaaacacattgctaaatatgttttccatttaacctattttgtaaagcaaactgtgatggcatgaacaatggtcagaaatacaattgcagagccctatatttacaatttacattattccgtttgcaattatttagatgacctatatacatacttcactgcaaataatatacagtaaaaaaaagagcagcagcatagtcacatatataacaaattgcttctgtgatagtcactaacaaagcggcagcaaactaacacaaatcacaaaattgttgttcagtgctcgtggtgctgtcatggaggacagaagcctcttcttggccctgagtttgctgcagtggtgacggtgagggcggcatcaacattggtg

SEQ ID NO: 78076 - DNA, 459 bp, Triticum aestivum
  Clone ID: PAT_TA_78076
gaggctgttcgtcgactcgctcctgtgctagtgaggggaggggatatgcggagtcgtcggtccacaccaatcttggcgcgcgcggcggcgtctgtagcctgctgtacgtgtacggcgggtgtacgtatacacggtggcgtacacgctcgcctagcttcgcactcagatacgtacagaatacacacaacacgtacgctgtatacactggatcgtagtaggtgtatttagcttagtttaggaaatggaaatttgttgattcgttgttggaggcctttctgccacgcgcgcactgcacggtgcccttacatctcgtatgcggtatgcctacgcatacggttctgtgtctttttgtagcggcggtgccgcctgtgtgaaaaggccatacgtatatcaaatatatagtgagacaaagtcaataaagctgaacaaagattttgcgttaaaaaaaaaaaaaaaaaa

SEQ ID NO: 78077 - DNA, 603 bp, Triticum aestivum
  Clone ID: PAT_TA_78077
tcttggaatgcctattgttccagcagtaactgagcttattgctgctcaatttctatggctagattatgacgaccgcacaaaacccatttatctgtatataaactccactggaactatggacgaaaataacgaacttgttgcatctgaaactgatgcttatgcaattgctgattttatcaatcgaagcaaatccaaggtttacacaatcaatcttagcatggcatatggtcaggctgcgatgcttctttcccttggtgtcaagggcaaaagaggagtgctgccaaattcaatcactaaattacacctgcctaaggtgcacaaatctggtggagctgccattgatatgtggattaaggcaaaagagttagatacaaacacagactactacctcgaactcttgtctaaaggagttggtaaaccaaaggaagagctcgctgagttccttaagggcccaaggtacttcagagcacaagaggctattgattatggacttgctgatacgatcttgcactcactggatggttctttcaagccaaaggacctgactgcgcagctggccaaagcacaggcgatgcggcagtcaggtaagcgtgcagctgctgg

SEQ ID NO: 78078 - DNA, 684 bp, Triticum aestivum
  Clone ID: PAT_TA_78078
ttaatatatttaggaatattgcctttttgtttatttaaatcctttctagtgtctttgtttttttgctactccctacacagcttctgaaatttgtgatatgaaactaagtctggtttgccttccattgcattctttatccgcatggtgctgctgatggtcagggaaaactcgagatgtaagttcttattctgacttgtaaaaagtatgtgactattcgaagaactgcatccacttcatgtatgcaaatgcattcgaactctacgggaaaaatgcatatattgtttttacttacattacattcgttggtggtgctgattgctgaagataccaaaagagattgctctgcacttaattgggtcatcaaaggtgaagaaagaaaccatcaagaatatcatcagcctcacaattgccgaatatgtccaaaaggtaaatttgactcctatttcattagattattattaatttattatggatgagtatcttttttttcgttagggattcctttccagacattcaatctttagtaaaaatggcacagaaacttgtttacctccttttattttgtactacaggaggacctcgatgcatcaaaaaatctgaaggttctacagacctatgaggagcttgaagcagcattcgaacctggaaaagagttttgctttgatgcaacttttcatttacagt

SEQ ID NO: 78079 - DNA, 680 bp, Triticum aestivum
  Clone ID: PAT_TA_78079
tcggcacgaggcacaatgctgctccagtacttgctatgaggcgcaagaagaatgttcatgaagatgtgaagcccttggctgtcacaaacttaaatgcctttgaaatcatatctttctccacaggatttgacctctctggtctatttatcaaaaaggagtgcaaaaaggagacaagattcacttctgataagcctgctgctgccattatctcgaagcttgaagatgttgcaaaaatactgaatctcaggataaggaagatggataatggtgttgtcaagattcaagggaggaaggagggaaggaatggtgtccttcagtttgacgcagaaatatttgagatcacggcatcctaccatctcattgagatgaaacaaacaggcggtgattcacttgagtaccagaaactgttggaagagaacatccggccagcactgaaggacatagtctgggcctggcatggagatgatcaacagcaaaagtagtagtacctttggatgtctcagttttgttcctaaaatttgttagattttttagctcggagtgattctgttcgacatgtgtatgttcttttttagtaattgcattctttctctttctgtgaaccattctgttgcgcgataattgttgagaggctgagttgtccagtcgttccattctgaaaactgtttctgtcctgtaat

SEQ ID NO: 78080 - DNA, 757 bp, Triticum aestivum
  unsure (1)..(757): unsure at all n locations
  Clone ID: PAT_TA_78080
cggcacgaggccaacgcctagccgcccccgcagcagccatggcggacgccgccgccgatctgcgccggaggataaaggagcagcgcgccgccatcaagcgccggatcactgactcccgggaccgcaccgccgccgcctcctccaccttcaacgccgccctcctcgaggcgcgctccatcgccaaccagactgtctccaaccgagcaaaactcagccaacaaaaacaacacctccggaaattagaatcagatctagcacaggccctctccgtccaaacaagcagaatgtcaaatcataagctcatgactgagtcaatttcaaacaccattgcaacaaatgagcagctcagacgcttggttatggaccgtagggctacaagagatgcatgcatgaatgccatatcaaatcaactcaaagatattgaatcccttgaagctgagagtgacgcagatggggataagaacctagagaattctctcatgtggtacgataagtttcttggtttccaagttgttggaggagaaggggtgaaatttgtgttcaacaaaattgatgtgcaaagtcctgacaaggagtattctttttgcgtaaagcttgttgaagaaagatacgtcnttagtccggtgtgttccctttgtggatggcattgaagaattggtgaaggaacttaactgcaacaatgatctgtacaaatttgtgaggttcatgagaaacaggttccaagctgctacaatcagtggaaatcaattgtcaagct

SEQ ID NO: 78081 - DNA, 499 bp, Triticum aestivum
  Clone ID: PAT_TA_78081
cggcacgagggtggagccggccaaggtgctgcagcgcgtcaaggccacgggcaagaacgccgagatgtggccctacgtgccctacgcgctcaccacctacccctacgtcggcggcgcctacgacaagaaggcacccgcggggttcgtccgcagcgcgccgcaggccatggccgaaccctccgcacccgagctcaagtacatgaacatgttcagcgacgaaaacgtcaacgcatgcacggtcatgtgagcaaattccatgtatatatatggcgatggcgatggccatggcgatgaatgatcgatgatccatcacaagaattccatggtcctatgtatgtatgttatgtagtacgtacgcgtggtcaagtactagccagtgagagtgtatatttttgtttgtgtatatctctgtggttcgtccttcttctttcaaaaagacaagagaactacgaaccacgcccgaccggcttttttggcgagacaaaaaaaaaaaaaaaaa

SEQ ID NO: 78082 - DNA, 283 bp, Triticum aestivum
  Clone ID: PAT_TA_78082
gagggagagagagagccagccagggatcctacgtggcgcgcaaccatgcatggctgcctagtcagcttccattactttgacgccttgacggtggtttgtttatgagtcgtgacggtgcccctctattgtagtacgcatggagtttgccttttttttttcgtttctgtattgtaactttgtaagtacgtatggagcccggagttattattattaggaaataatggacgttgattacccaggcacaaacaatacattttacaaaaaaaaaaaaaaaaaaaaaaaa

SEQ ID NO: 78083 - DNA, 407 bp, Triticum aestivum
  Clone ID: PAT_TA_78083
cggccgaggcggctttgaccaagtcatcttactgatagcaacaacactagctggaacacttgggtacacgagttcagggatctagccagagctaattaagcggagagttattagcttttaatttgcttgagaggatggagaactaccaggggcagcacggctacggcgccgaccgcgtcgacgtgtacggcaacccggtcggcgccggccagtacggcggcggcgccaccgcgcccggcggaggccacggagcgatggggatgggaggtcatgctggcgccggcgccggcggccagttccagccggcgagggaggaccgcaagaccggcggcatcctccaccgctccggcagctcaagctccagctcgtcgtctgaggacgacgggatgggagggaggaggaagaag

SEQ ID NO: 78084 - DNA, 665 bp, Triticum aestivum
  Clone ID: PAT_TA_78084
catgtgcaacgtcggcgccaaccgcaaccaggccttcgtcgagtttgcagatcaaaaccaggcaatttcaatggtgtcctattatgcttcatcttcagaacctgctcaagttcgtggtaaaactgtatatatccaatattcaaacaggcaagaaattaccaacaataaaggcactggtgattcttctggcaatgtcctacttgtcacttttgaaggtgttcagcctaatgatgttaccatagaagtcattcatttggtattttcagcatttgggtttgttcacaagatagctacatttgagaaagcggctggtttccagtatactgatgccccaactgctcttgaagctaaaaactcattggatggaagaagcatcccaaaatatttacttccagaacatatcagtgcctgccacatgcgcatcaccttttctgcgcataaggatttgaacatcaaatttcagtcgcatcgcagcagggattacaccaatccttatcttcctgtgaatcaaacagcaattgaggggattgtgcagcccacagtaggccctgatgggaaggtaaaggagcctgagagcaatgtacttttagcatcaattgagaacatgcaatatgctgtgacggtggatgttctgcacactgtgttctctgcttttggtagtgttc

SEQ ID NO: 78085 - DNA, 450 bp, Triticum aestivum
  Clone ID: PAT_TA_78085
cggcacgaggggttcatgcttgctcgattgattgattgcaatagacaaaaactcttcttgtctcttcacctcgccaccggggccgccatacaattacctccataaatcttggatagaatgttaggagtaactaactctgcactgtgccattgctgtgtgtcagtgtgtgtatatatatccagctgccagctgcagagtgaagcataaacatcagtagacgacggcgatggcgcccaagcgacttgtctgcttcttggccgtggccgccgcgctagccaccacctgcacgggtggggcgccggcgccggcgatgtcgtgtcgtcgtcggcggcggcgctctcgttcgtggacaggctgaggcagatgatgatcccggcggccgtgggcgacggcgactactgcgacagctggcgcgtcggcgtggaggcgaacaacgtgcgggggtggacg

SEQ ID NO: 78086 - DNA, 663 bp, Triticum aestivum
  Clone ID: PAT_TA_78086
gaggcagcaatgtgctcaaatcaccaagatgaaaattctgctcttctgcactatattcagactcatcaggataatgtcaagcaaaatgttctacttcaactacttgctcttgttggcaagcagccagcttttcatcaattgcgatcagttgagcaacttggctacatagcgcttcttaggcaaagaaatgattcaggtgttcgtgggttgcaatttataatccagtcaactgttaaggatcctgccaatctggatgccagagttgtaaattttctcaacatgtttgaaggcactctctacaatatgtctgatacagagttcaagagtaatgtaagtgctcttattgatatgaaactggagaaatacaaaaatatacgcgaggaatcagctttcttctggggagagatttctgaaggaaccctcaaattcgatagaaaacaagaagaggttgctgcactgagggagctcaagaaggaagagttgatagacttcttcaatgatcatgtgaaggttaatgcaccacaaaagaagattcttagtatacaagtgtacggtggtctccattctgcggagtacgaaacaatagtgcaaaatgctccgccgccgcagtcgtgtgagataactgatatttacagcttcaggagatcgaggcctttatatgga

SEQ ID NO: 78087 - DNA, 706 bp, Triticum aestivum
  Clone ID: PAT_TA_78087
ttttttttttttttttttttttttttcactgctaaagccagttttcatcaactccataaatcgaaagcgaaggggcataacatcagttcctccatactttctacccagtttcagtatttttgtgcggtcgtagctaaccgcagggagcattcttttggcacattcaactattggaattcgatgaccatgccaaacatcttaaaaccttccatcaaccgaaagtacaagtacaacatacaacggatatagatggaaactttcgttcataaagtttggtatcggcaatgtatttactaccacttaacagatgcatctctggcatccctgcagtaaagaagcagtaataggaacagaagaaaggttttacaaaatctcacgggtatcatgatcatcagttcattgccaggtgtgaccatagataaaccacagcaagatgtaaccaggatcatgcagtcccgcaccagtaggctaagtgctcgtccttgcgagatgtgctaaagagcccaccacatttcaggcagatgaagctgctcccatcagcaaacgcatccaggatgatctgcttccttccactctcagcaagaatgcaggcctcatcagaattcagcatatcgacagggtctgacccaggtccttgtgaagggttagtatttgttgactgagcctctgctatggcacattgggcaagcaaagaggcaagctcatc

SEQ ID NO: 78088 - DNA, 661 bp, Triticum aestivum
  unsure (1)..(661): unsure at all n locations
  Clone ID: PAT_TA_78088
cggcacgaggcaagcgttcagcagtcagcacttcccttcctctttctatggcggcaggaagaagaccttggttgttgcttctttgttgacatgtagatttgctacgcttgtgatgtgcggtgcttcgctagcacgtatggctgcagcacccgttgctatgtactacaatgtgttcaggtttcttacagttgtcttgaccatccagcttccttgctgcggaataaggttattgcatgacattgcaattattttcttccacatgccaccccctggaaaccttgcctccacactgataatcatgtttgagtggatcctttcagtcttggttttagctgccagctgttccgcgctgggagttgaggtgtacatggacaaggacacaggtgcttgcatgttcatgcaaccacagccatgtaggtggtacaaggaggcagccatgctgggcttgctagcaggggtctttagctataccatctctttgctcctgttctgtctccagtcttctcggcacacccaacctcctgccccagcccccgctcatggccacgaccaaggctaggtacagagtcatccaaggcatgctcagaaactgccatgaagacaacgctnatttgaaatgaaccggtcaaggtagcttaggtagttagtatgtttggtgaaa

SEQ ID NO: 78089 - DNA, 291 bp, Triticum aestivum
  Clone ID: PAT_TA_78089
gaggggtgaactcctttgtgcttggttgcaggggcttagggccactgaaaagggctctccttggaagtgtcagcaactacgtagtcaacaatgcaacatgcccagttacagtggtgcgcggaccaactggatcgagtgcctgatcttttcttttcagcttaaaggtggaacttctgtagtgcaaggatcatttagtagaactgggttgacgtggtttgtgaggatgaactgttagttctggtaattaactacagtattatactaaaaaaaaaaaaaaaaaaaaaaaaaaaa

SEQ ID NO: 78090 - DNA, 684 bp, Triticum aestivum
  Clone ID: PAT_TA_78090
caatttgggctggcataacccagcatccatcacgattcaagctttgggtggttgtctttggtggtgcacttgctatgcttctcgaagtatacgactttcctccgtacaagggatacgctgatgcacactcgctgtggcatgcaagcaccattcctctcacatatctctggtggagtttcatcaaggatgacgcagaattccgcacatcaactcttattaagaaggcattttaagaggtaaaggcacagggttacaagcgatattcaactccatgcttgcaatgtatgcgaataatggattgcatagcaaagccacagagttgttcgattcaatcaagcagagcaggctgaaccctatcctgatcatttacaacagcttaatggacatgtatgccaagtccaacgagtcctgggaagctgagaatatactgaaacagctggaaagttctcaggtgaagcctgacgttgcatcgtataacactgtcgtcgtaaacggattctgcttgcgaggtctgatcaaagatgctcagaggatcctatccaagatgatcgcagatggcattggctccatgtgttgtaactttatgtatgacgcatcacacgctcgtgggaggatatgctagcctggaatgttcaatgaggccagagagacaggtcgtcagctacatgattcagcttcaaggtg

SEQ ID NO: 78091 - DNA, 662 bp, Triticum aestivum
  unsure (1)..(662): unsure at all n locations
  Clone ID: PAT_TA_78091
cggcacgaggaacttttcaggaaccttttactaatgcttttgttatgatatctattcttgttattatttgatattaccctgtgatgtcactataatgctctgttctttgtatgtgttaatctcactttattattcatatatatatttgtcttcatcttgatttggtaatgctatcactccatctggagcagaaaagcttgctgccccgtgctggttggtataactccaaaaattaaaatgcatgtttggtatcttctgatgaatttgtcatgcttttctaatatatgtcttcacctaagttgcttggcagttgttgtgacagcttggcacaggcagccagagtttttagcacttgatgaatatcaggtatagtggaggtgctgtgaattgttctgtgaacctaaagttttttcatttggtttctgcacaattttctactgacaaacagtaacgagtttctcatttttggtagttgatgtgtgcgcattagggtatctaagcatgcatgcatgctggaaaaatctttgatgaagagctcacagatatatattttatattgctaatgccttttttaacatcattggattttttgtttgcggntcaagtaggacatgctggcatgcagatctagtctggagtcttatgctcaagatgcatattgt

SEQ ID NO: 78092 - DNA, 392 bp, Triticum aestivum
  Clone ID: PAT_TA_78092
cgatcagcgtcgccgccggcacaccggccgccaggatctggccgcgcaccggctgctccttcgacggcgccggccgcggccgctgcgccacgggagactgcgccggcgcgctgtcctgcgccgtctccggcgagccgcccaccacgctggccgagtacacgctcggccgccccggcgccggcggcgacgacttcctcgacctgtcgctcatcgacgggttcaacgtgccggtgagcttccagccggcgaacggcggtggcgcccggtgcagcaaggggcgcgggccgagctgcgccgtggacatcacggcgaggtgcctccccgagctccgtgtccccggcggctgcgccagcgcgtgcggtaagttcggcggcgacacctactgctgccgg

SEQ ID NO: 78093 - DNA, 703 bp, Triticum aestivum
  Clone ID: PAT_TA_78093
gaggaaagctgacaagctgctatcctaagtgatgctactcgcatggttattcagcttcgttcagaagcacagcagctcaaggaaactaatggtagccttgaagaaaagattaaagaactaaaggctgagaaggatgagcttcgtgatgagaagcagaagttgaaattagagaaggagagtttagagcaccagatgaagcttatgacctcaactccagcctacatgcctcatccgaccctgatgccagcgcctttccctcaggcgcccttagcaccattccatgcccaggggcaagctgcagggcagaagctgatgatgccctttgtcagctatccggggtacccaatgtggcagttcatgccgccatcagaagttgacacctcgaaggacagcgaagcgtgccctcctgttgcgtaattgcttcggtcgactggccacgcttgcaccatgtgaattaatcacaactgaagcccccccctagtcgttgatccattgattgggtataactatttgttcttatgtggtagttcattggtaacgaagtaaagctgctgatataagcgtcctactatatagaggctactactgctgccccttcaatggctgtacaatttttgtggagaaaagaagaatgttcgttcttgttctccatagcaacaatgtgacgctatctatatgtcatatatatttcataaaaaaaaaa

SEQ ID NO: 78094 - DNA, 148 bp, Triticum aestivum
  Clone ID: PAT_TA_78094
gacgagggcggagcctcttctactccttccgccccgcaaaccaggttgctccaggaaatattggattctcttggtccatttgttgatggtttgaagttttctggaggatgccatagtttgatgggaaaggatttggttagagagatca

SEQ ID NO: 78095 - DNA, 418 bp, Triticum aestivum
  Clone ID: PAT_TA_78095
agctctcttcgcaagatattaacctcttattcagcagcttccagtcgtcaaaccatatttgcaagcgcatcgatccctcagcacaatcgctttctgcacgactgtgtacagcataaatggaccaagagtgatgtggttcatgttcatgtccaccctgtacagcccatgccttcgcacctgtgtcacaaatatgtgatctgcaccaagaaggaaaggttgcatgtcttactatccttgcttgagagggatgcaccaaagtctggaatcatatttgttgctgaacagtctgagagatcaaagaaggctggaaatcctccttcaaccaccgtcgtcgctgagttcttgagaaatgcatataagggaagcctagatgtgctgctgctggaagaagatatgaactttaacgctcgagctgcct

SEQ ID NO: 78096 - DNA, 307 bp, Triticum aestivum
  unsure (1)..(307): unsure at all n locations
  Clone ID: PAT_TA_78096
gctcttttattgatacattggccaagaatggtttggttgagtgtgctttgtctttgcttgatgagatgatcaagatgggtatcaagccaaatgttgtaacctacaacacaattattgatgcatttggcaagtcgaagattcttactgaggaggatcctggtaacatgggtattgttggggtttatggtggncagattgtaagggncactaatccagtgacaagaggagggcgctctgcaactgatgttcggatgaggaggtcacaggaattatttttcattctggaattattccagaagatggtcca

SEQ ID NO: 78097 - DNA, 516 bp, Triticum aestivum
  Clone ID: PAT_TA_78097
cacttactcaaaaactcaaggaactcatacctcggcaaatgtttaaagttcctattcaagcatgtattggcacaaaggtcattgcgagcgaagccctgtctgccatcaggaaggatgtcctatcaaaatgctatggtggtgatataacaaggaaaagaagttgctgaagaaacaggctgaaggaaagaaaaggatgaaggcaataggaagggttgatgttcctcaagaagcattcatggccgtgttgaaactggagaaggaggtgctatgaaagagctcatggaactttgtgtctctgtaaattaaagatctcttcttgtgcacaactccactccgcaagtttactcaagagagttttgagacaacatggcactgtgattcaacctggcagctctggaccaggggaaccagtctaactacagatcactcccagaacaaaagctgctaatctagcgactggcattcactaattttgttttgtatgtcaggttatgatggtaaacaatcatgttgaac

SEQ ID NO: 78098 - DNA, 464 bp, Triticum aestivum
  Clone ID: PAT_TA_78098
tgaaccatcagatgagaaatgcgacgttttcagctatggggtgatattatgggaactctgtacaatgcggcagccgtgggaaggtatgaatccgatgcaggttgttggagctgttggttttcagcaacgaaggcttgatattccaggcggtgtggatcctgctgtagcagagataatcaagagatgctggcagactgatccaaggatgcggccatcattttcagagatcatgggcactttgagaccattgttaaaaaacacgcttgccaaccaacctaataggaagcgggcacagcaaacagatgattaagaatatagtggtcagtatcagctgacaacacaaaccaaaaaagtgtgcattggtttgtgttggcttcccagcttcaagcaactggccatctgtaactattaccattggtttgtacagtacgccaaatgcgtatttgatgaagaacaggtgaaat

SEQ ID NO: 78099 - DNA, 451 bp, Triticum aestivum
  Clone ID: PAT_TA_78099
aagacttggagattatgtaaaccgacacaatatactagaaatcttaccctttccgagtaggacttcggcaattccttaactcatagatatatcttccgtaatttgaggtgaattcctaacaacatatacggaaaccaactgtatacgtgaaggtatattttatcagtatattccataagtcgtagaatagagggtatgccttatctgtaaccctaacaaacttaatatctttgtaccaatttggtgcaaatgattgtagtcctatgcactctatattggaatttgaaatgtaatattcgtctatatttacactaaagctcatactctatacggattagaactggacgcctcaaggttggagttggaggttccaccaagctttcatacctttgaaatattcgaagcattgtcttgatatggtataaatgtaattccttgttgatgtattatt

SEQ ID NO: 78100 - DNA, 529 bp, Triticum aestivum
  Clone ID: PAT_TA_78100
tccgtgattatttgtttcttgaagttgcacggcgagatttaagagtaataattgagaacaagcaacgccttgttctggcacatgcaacatcaggttacaagcatagtttgaaggaagttttggatacccctggtgtgatggcactgataaaagatacaaaagcagcacaagaggtccgagctctgcaggatttcttcaatatgcttactaatgacccagctcgtgcttgttatggaccaaagcatgttgagattgcacatgaacaatatgctgctgtccagactcttttaataactgatactttgtttcggaacactgacattgctacgaggcaaaagtatgtgaacttggttgaaaatgtcaagaaaagtaatagcacagtgcacatattttcctcaatgcatgtctccggcgaacagttagcgcaactgacaggaatagcagctatacttcgttttccccttcctcaactagaggacatcgagatgtgatgacaccaacctttttgctgcttgtttaacattctttt

SEQ ID NO: 78101 - DNA, 258 bp, Triticum aestivum
  Clone ID: PAT_TA_78101
gtggcgggcgcgtacctgggcggcgccagcatgctgaggtccggactgagggtgctcctgggcggctggatcgccatgctcgtcaccttcggcgtgctccggctgttcgggacggtgttccacatacaagtctcgtcggcgtgacagccctcccctcgggctgtggtggcaaaggaataatgggacaggcagggcctagagaagcgcctagctctgcttgacatcggaatgtgaaagactgcatgtcttgagtaggaa

SEQ ID NO: 78102 - DNA, 449 bp, Triticum aestivum
  Clone ID: PAT_TA_78102
ggttggttcctagaaaagaaatgctcagtgataatattgacacatctccccctcacaattcatgtttctacgtggaagacttcatcctttatctgactctattacacaagaattaaataaacatagtactgtacttaaaccactaaaagctaatgcaggttcatattttaccaggttttctacaaggcatcttaactctaaatcaggattattaatcatttgtcactccatcttgtatatattgtgaatagcacactgtatagtcgaattgataacgaaaaactgataggaccatgtaattagaatttgaatgctgcttttggtgaatgatgataaacctgtatggtaaagtttgagtgcaactgcacaatagggtaaggttttttgtaacagtagtatcatatagaaaccatcgaagtcgtagctcatatcaatttgtttcttctact

SEQ ID NO: 78103 - DNA, 413 bp, Triticum aestivum
  Clone ID: PAT_TA_78103
ccgttgcccttcagttcgtctgctatcctgcgctcgccaagatactaaggactcgaatggggctgccgttgccgtcggtcagggagacgattgcacagatagtggtatactccctcgtggaggattacctcagctactggatccaccgtcttctgcacaccgagtggtgctaccgaaagatccaccgcgtccaccacgagtttacggctccaacaggcttcgccatgtcatatagccactgggccgagaacgtcgtcctttctatccccgccttggccggccccgtgctcgtgccatgccacgtcaccacacaatggctatggttctccatccgcctaattgagggcatcaacacgcacagcggttaccatttcccattcagcccttccaggctgattccattctatggaggg

SEQ ID NO: 78104 - DNA, 408 bp, Triticum aestivum
  Clone ID: PAT_TA_78104
gggggctgacccaggtcttttaatactccactgttggctcaaggtttctgcactctccacgtgccatcgcaacaagccgggaatacctgccatggcaatacgaagaacagacaccccatggccattggagaaaccctactcactatgattacagaggctacaggccataggaaacgaactcatctaccaagtcactgttttctgctatcatgacaagtttctgtagatgatttatgtggagtggaagaacgaaatggatccacggttgtgctccgatcctgacgctagacgatgttcacctgaccaaactagctagtttgtatattctagtcttgagagagagatacaagtcctcaataaccttgcattgctagcctcacttgatcccaaaaaaaaaaaaaaaaaaaa

SEQ ID NO: 78105 - DNA, 348 bp, Triticum aestivum
  Clone ID: PAT_TA_78105
ctcgacaccctccgtgtgactccgctcacccccttcgcggagcaggacttcctgaacatgttcttcagggaccagtacaggccgatcccgaacgtgtacaacctcgtgctggccatgctctggaggcaccccgagaacgtgcagctggagaaggtgaaggccgtgcactactgcgcggccgggtcgaagccgtggaggttcacgggcaaggagcccaacatggacagggaggacatcaagatgctggtgaagaagtggtgggacatctacaacgacgagacgctggacttcaagggcctgcccctctcgcccgccgccgacgacgccgacgacgaggtggaggcggtg

SEQ ID NO: 78106 - DNA, 265 bp, Triticum aestivum
  Clone ID: PAT_TA_78106
acaagatcgacatcccttatgccgcttcagaggaggaactccgttatcacatggggctgagcaacttcaccactggcaagggcaaggttaacctgggcgagtctaacgtccgccccctggaggtgttcatgtgcagcgttgttcgcaagatggggtacggcgatgggtttaagtgggtgtcacagaacatcaactagtgttagctaggtaccggggaactccctggaccttagctaccacaagagagatagggagacacctgcct

SEQ ID NO: 78107 - DNA, 229 bp, Triticum aestivum
  Clone ID: PAT_TA_78107
gggacggctacctgaagccgtacgtgacgtcggagccggaggtgacggtgtacggagcgcgccgacgacgatgagtgcctgatcctggcgagcgacgggctgtgggacgtggtgaccaacgagatggcgtgcgaggtcgtccgggcgtgcttccggagcaacggcccgccgtcgccgccgggatgctcccgccccaaagccgtgctcccgccgtccgccggtgcgtcag

SEQ ID NO: 78108 - DNA, 434 bp, Triticum aestivum
  Clone ID: PAT_TA_78108
gttgaggaattttgatttccctcgtccgtctcatatccaggctatggcatatggccctatcttggaggggaggagctgtgttattgctgatcaaagtgggtctggcaagacactggcatatctttgccctataatacaaaacttaaggagcgaagaagttcaggggctccataaatcatcccctaggaaccccagggtgatagtattgacccctactgctgaacttgcttctcaggtccttaataattgccggttgatatcaaaatctggggttccattcaggtctatggttgcaaccggaggatttcgacagaagacacagttagaaagcctcaaccaagagcttgatgtaattataggaacaccaggccgattcttgtatctgcttcaggaaggctttgtgcaattagctaacctcagatgtgttgtgttgg

SEQ ID NO: 78109 - DNA, 308 bp, Triticum aestivum
  Clone ID: PAT_TA_78109
ccgggaggtgctccggtgggaggataagcgcgacgccgcaggctactgccccgaggagtccttctacagcaccaccgagctcagctcgtcccgcctcatcgtcgccgcagagtgatctgacatgtgtatagctgttgtttggtgtggttcatttgctggcacaattttactagtaactgtacagtcgtgtgtgtaatcttgttctttgttcgtcgtagagcattgttgcagtgttgttgttttgtgtaattgtatgcctgctagtaagttttccaaacaaaaccaaatatagtaaaggaaatatcttg

SEQ ID NO: 78110 - DNA, 407 bp, Triticum aestivum
  Clone ID: PAT_TA_78110
ctcgcacaccacagcacgacaccatcggcccctggcctttccttccgtgcacctactaccccccgcgccaccgcggaaagtaaacccccgagatccagcgccgtcggcacgaccaccaggcctgcgctgagcagggatggggcggagaggggagccctactacgtcgaggcggcgccgccggtggacgtgaacaagaacacggagtggttcatgtacccgggcgtctggaccacctacatcctcctgctcttcttcgcttggctcctcgtcctctccgtctccggatgctccccgggggctgcctggaccgtcgtcaacctcgcgcacttcgccatcacttaccacttcttccactggaagaaaggaaccccttttgctgctgatgaccaaggcatctacagcagat

SEQ ID NO: 78111 - DNA, 318 bp, Triticum aestivum
  Clone ID: PAT_TA_78111
ggacgcccaaaaaaatcgaagccgatgggagaaggcgccgctcccatggccgctggcctctgcccgcgcctccgcaccttattggcctcctctcgcccgctcctggccgcgcgctccggagcgctgcccctacccctgcgccgcgctggcccggccatgcccctcgtcgcacgcgcacgccgcggcttaggctcctccaccgccgcggacccgctcgccgaagacttcgccacggctactgacctccggttcgaatcgccactcgaggtagtcaaataccccgaccccatcctgcgcgcgcgcaacaagggcatcaac

SEQ ID NO: 78112 - DNA, 553 bp, Triticum aestivum
  Clone ID: PAT_TA_78112
catgcacgccgagcacgccggcattacatcgacgagatgaggacgctcagcatcttcggtgcccccaagttctcccgcgaagccatcctccccactgagaggttcggcgtcaagggtctgtacgacaagcccatgatcctcgccgtcaagaagttcgacaagaacgaggtcgtcggtttcctgctgaagcacggtctcaagaccatcttcgaggagcccgaactcatcaacctgagcaaggccatcctcagcggccccatgaagatgggtctcatgctgagcgccgcccgctacctcgacatccccgagatggcccttcccatgaaggagatcctcgtccccggtgaatccaccctcaccactgctttccgcatcagccaggagtaccccaccatcccctgggtgttcatgaccgagaaggacaacctacgcctgggcagcatcgacaagctggtcgagctcggcgagttcaacgtgttcaacgacaagctcgtcctggcccgcgacttcatgcacaacaccatggacatccccgtcggcgtgcccgcgcgcg

SEQ ID NO: 78113 - DNA, 283 bp, Triticum aestivum
  Clone ID: PAT_TA_78113
acgagaggctgagaaaagagagggatgaaaagagagcagagcgtgatcggcttcgtcgacgtgcagaggcacaggctgcttatgacaaggccaagaggaaggagcaatcgtcaagtcgctcatcaggaggtgcatctcccagaggtttccctggagggatgcccggtggaggtttccctggagggatgcccggtggaggtttccctggagggatgcccagtggaggtttccctggagggatgtccggtgggggtttccctggagggatgcctggtgggggttt

SEQ ID NO: 78114 - DNA, 431 bp, Triticum aestivum
  Clone ID: PAT_TA_78114
aagatcacaaggtttgcgtcttaacgcggtccgccagcaaggccacatcagtttttccggcttccacatttccaggaattacaatagccgagcagggagactgggataagtgcatccaaggctccactgctgttgttaacttggcaggcatgcccataagcacaaggtggtcacctgagattaagaaggaaatcaaggaaagccgaatcaacgttacatcaaaagtggtgaattacataaataatgccagtggtgatgctcggccctcagttttcgtgagcgcaacagccattggcttctatggtaccagtgagatcagtagcttcgatgagtcaagtccgtcaggcaatgactatctagcagaggtgtgtcgagagtgggaggccagggcatgccaagtaaaccaagaggatgttaggcttgtgcttctt

SEQ ID NO: 78115 - DNA, 262 bp, Triticum aestivum
  Clone ID: PAT_TA_78115
ctagggtttcgtgcgattcacctcctcggcgacgaccgagaccgcgagcgatttcggagggctcgatcgatggcggctgagggagagaagaagatgatcaccctgaagagctccgacggggaggagttcgaggtggaggaggcggtggcgatggagtcgcagacgatccgccacatgatcgaggacgactgcgccgacaacggcatcccgctccccaacgtcaactccaagatcctctccaaggtcatcgagtactgcaaca

SEQ ID NO: 78116 - DNA, 300 bp, Triticum aestivum
  Clone ID: PAT_TA_78116
gagcaagaggattgggaggagggagcgtgttgtgttttatcatctcctgtccgcgcaaggtttggcttgagcctcctttgttgttggtgtcgctgtggactggaagagaggggctttgtaactggtggagcagagattgtttccgttttgatcatggcgtgaactgtatatattttagcttgctccagctcatgtaacactttcttgctgcgtttgtgcttgggacacgaagacctgtgttgatggcttcattagtgtgacaatgatttggtattggatttttggttaaaaaaaaaaaaa

SEQ ID NO: 78117 - DNA, 276 bp, Triticum aestivum
  Clone ID: PAT_TA_78117
ccgcctcgtggcctgccacgcggtaccgtacgcgtacgtcgtgttcgcgtgccacctgacgcagcagacgcgggcgtactcggtgtcgatgctcggcagggacggcacggccgtggacgctgtcgcggtgtgccacgccgacacgtccggctggaaccccaagcacatcgccttccaggtgctcaaagtgaagcccggcacggtgccggtctgccacttcctgccgcaggaccacgtcatctggacccgcaacgggtgaggctgctggatggctgc

SEQ ID NO: 78118 - DNA, 207 bp, Triticum aestivum
  Clone ID: PAT_TA_78118
ggattgttgaggcgagtcagttcattagagcgagtgctcgatgctgtcgtgaataattctctgcaatactgtcacttattatctttttctgcttgtagttttgctcactgaaacttctttaatagtgagtatgttcggtattattatacaaaaataagagcagccggtgatccccattgcaaaattcaaaaaaaaaaaaaaaaaaaa

SEQ ID NO: 78119 - DNA, 416 bp, Triticum aestivum
  Clone ID: PAT_TA_78119
tgttgcccgctgctgtgaaggggcgcagcctgcagattcaggctcctcgccgtgttgcgttgcgcgttcgtgcggcggcggcggcggtggcagtggaggctgcggaggtggactacagctctaacatctcggtgtttccgatggaggcgtgcgacctcatcggcggcgaggcgtgcaacgtgcagatgtacccagaggccaagctctcatcatcggctgctgttgctgtttctcgtgcggcggcggaggaagtcgacagggactacctatcctacgacgagcccaccacggtgttccccgaggaggcgtgcgacgatctgggcggagagttctgcaaggccacctgatcccattcccatccatggagaattggagtcttctatcatccttcctcctctgctccactaccttaattc

SEQ ID NO: 78120 - DNA, 452 bp, Triticum aestivum
  Clone ID: PAT_TA_78120
ccacccgatcaatcaaatataagtttcttgacacctcagaaattctcatgtaggattagtgaattttcgaagctttgcacgtttagcacaaaatataaacagcaataagtcttatcaagtgcaaggaacagattagtgttcccattctgaaattttgtatatcctgaccttgtaattcactctgtcctaataaagtttgttaatatttatctaacaggctattcatatccactcattgattacagtgatacttgttcatgtagcttgcagacgtatggtcctgtggggtgactctttacggcatgcttgtgggagcatacccatttgaagaccccgatgaccccaagaatatacgcaagaccattcagcaaataatgcaggtgcaatacaagataccagattatgtccacatatctacggaatgccagcaacttcttgcccgtatctttgtt

SEQ ID NO: 78121 - DNA, 399 bp, Triticum aestivum
  Clone ID: PAT_TA_78121
cggcttcgtttcttccaagcctgcctcctcgcacctacggggctccaccaccatccatgtctgctgctcgttcaaaaacctcgtctgctgcaagatccagctcaaagcctttgtctggaggcctcctggggcatctttcgtctaagatggacgaagcatccatggcactcaaggacgtgccgcagagattgctggatgtgctggttgacgcaaccttctaaagaacaatagcatctccacttgtttctgaattcggggtgagtttgcagagcaatttcgcaccggtcgacgaaatcggtgaagccatagagatacaccagattgaaggagagatgctagataatttccccgagggggtgtccatcagaattggtgacagtttcagtcgtcttttctact

SEQ ID NO: 78122 - DNA, 286 bp, Triticum aestivum
  Clone ID: PAT_TA_78122
cagctgaagatcatctgtggagagcccaaccagaagtatgcttttttgtttgtagagccttttgttgtgcgggtagttgtttagtttcgtgatatgttttctgctgttgttgactcgctgagtctcagtacttgtgagctgtaattgtctgtaagagtactggcaaaatagcttttttggcgtttagcgacctctgtagttgtcacttgtctgtagttgaagactgtataggtagcaactaaacattcataggggtttgtgtcaaaaaaaaaaaaaaaaaaaaaaa

SEQ ID NO: 78123 - DNA, 470 bp, Triticum aestivum
  Clone ID: PAT_TA_78123
tctgacctccggaagcttgctgtttatctgatccctttcccgcggctccacttcttcatggttggattcgctcctctgacttccaggggatcccagcagtaccgtgccctcactgtaccagagctgacccagcagatgtgggatgcaaagaacatgatgtgtgctgctgacccccgccatgggcgctacctcacagcctcagccatgttccgcggaaagatgagcaccaaggaagttgatgagcagatgctgaatgtccagaacaagaactcgtcatactttgtggagtggatccctaacaatgtcaagtcgagtgtgtgtgacattccacccattggcctgaagatggcatccacattcatcggcaactcgacctcaatccaggagatgttccgccgtgtcagtgagcagttcaccgccatgttcaggaggaaggctttcttgcactggtacactggtgagggaatgga

SEQ ID NO: 78124 - DNA, 514 bp, Triticum aestivum
  Clone ID: PAT_TA_78124
agtcgaatgaaatgtttcttcctgttccgatggcatttatttacaacatggaggatggacttaccaatgatattccgacaacacttcacaggagcaaagctgattgctctgttccagaggagatggtaactgtcagtgtggatggttctgtacttgataggattgctaaaatcatgtcataccttcgacttggatcatccgggaaagtcttgaagaaaaagaaaaaggagagggacacaaaagggaagaacagtttagcaagtggtgactacgatgaggtagctagacctggccaaactaatgggtctgctctgaaacatcaatttgaaaaggatatgccaccgccgccaccccctcgaaataataatttaagcaaaaatgagaaaccgtctgttccagttgctagagcagatgaagatgacatttttgttggagatggggttgactattctgttcctaacaaggaaatgagccagagccctgtctctgaagatatggatgagtccccacataa

SEQ ID NO: 78125 - DNA, 327 bp, Triticum aestivum
  Clone ID: PAT_TA_78125
aggcgctgcttttcagcctaatcatgtctggactgagagaagaggaagaagcaacaggaactcgaattcaggtggtggaagaggagggatgcaggatcgcaggagacagaggacacattacaattgatagtgatgttgggacatgcttggcaatagcattgatgagataaacaaacttgttaatctgtcatcttcctttttttttcgttgtttgtcttaatccttttgtagtccgtggctataaacatgttgttcatctttttctcgccttttaacccagaaatgctttgcttggataatgttgctaaaaaaaaaaaaaaaaaaaaa

SEQ ID NO: 78126 - DNA, 373 bp, Triticum aestivum
  Clone ID: PAT_TA_78126
agagctacttgtaagaggaaggagctgatataatccaaactgagggtggaaaatgttctagcccgacaaagcctggagttcttggattgattgaaaaggcaacaccaacactcgctgcagcatactccatctctcgggctgtcagcattccagtgatgtgctcgtcagggttaagttcggtgactgcaccgatggcagtaactgcaggagctgctggagttggagtcggttctgctattaacaaactcaacgacgttgtggcgatgattgctgaggtgaggagcattgcacaagcaatggggcttgcgccaagaatcgtctctgaaaacttgagaacagttcgacactagtggccaggaatactgtcactagt

SEQ ID NO: 78127 - DNA, 424 bp, Triticum aestivum
  Clone ID: PAT_TA_78127
gtgggcgtggtggtccttttgaaatccaaaacctagcgttcagggtagtagtaagaggaggctacttgacggtgaacacgctggtggcggcggtgctcccattcctcggtgacttcatgagcctgacgggcgccctgagcaccttcccactgacgtttgtgctcgcaaatcacatgtacctgatggtgaaggggcctaagctgtctgccatccagaaattatggcactggctgaatgttgttgggttcactgcgttggctgttgcggcggcggtctcggcaataaggctcatcatgcgtgattccagcacctaccacttcttcgctgatgtttgagcttgaggccacgtacgatcagtgaaatattcaattctagcttggttcctttatggttttggaaagggagggcagatagcagggggggt

SEQ ID NO: 78128 - DNA, 589 bp, Triticum aestivum
  Clone ID: PAT_TA_78128
cacttggatggttattttttcccttttctggactctcggcacaatcttggaagcttcacttgcatgggttgtattaccagcattgaattggaggtggctgctagtattcaccgcccttccatgcttcctcttgcttcctttctttggactaacacctgagtctccgcgctacctttgtgcacaaaatagaatgtctgatgccactgctgtcctggagagaatggccaatgcaaaccaatcagctcttcctccaggaattctcacatacaatagacaaacaaaatttgatgacgacgctcttgcttctgagagtgaatgtcttcttcctgtcagagagaaggaatgcacagttgacaatgccaagagctccgaatctggctgtcttgcttcattgcgcatactattatcacgcaaactgctcagatcaactcttcttctttggtttgttttctatgcaaattcctttgcttattacgggttagtattgctgacatcacagttgagtgatgcaaataaaaactgtgcatctggtgtaaatgttggtctgcaccaaaaggttaccaatctttacaaagacactttcatcact

SEQ ID NO: 78129 - DNA, 486 bp, Triticum aestivum
  Clone ID: PAT_TA_78129
ccagatatcttggagaatttctccaaggagtacatgtatctggcatgcgttgcatatgtgaagaaggtaaagaaggggccctttgtggagcattcaccgatgttggatgatatcagtggagtggccaattggaagaaagttaacagtgggctgctcaagatgtacaaggctgaggtgcttgagaaagtgccgatcatgcagcatttcctctttggctcactaatcaaatgggaggactaataacatcttaggaaggctcaccaattatctgtgagaattcatgtatgatgtgaggactggttgtacagtggtgctactcagagttggctgaaaaaaagaatacatatagaaggtcattttccacctagggtgaatgagcgttctgtatgtttgcataccgtgccagcacacctatcttctggcgttttaaattctgggaacttgtcggttcctgctcagcttgtgcattacttgaggattgccttg

SEQ ID NO: 78130 - DNA, 431 bp, Triticum aestivum
  Clone ID: PAT_TA_78130
cctcaagttattgagcagtatgccatgtaagcctacaatcaattcctgttgtctgtgttgaagagctttgagtcctgaggatggtaaggattcaaagtaaccaggctggagttcatcattgatttgatgaatttacatctggtactcattaattacttgtaccagaagaaagtttggtttgagttcttgagtattggaatggatgatgtcatgtgatcatcatttttttttttgagatagcctgcatggatgctttttcaagaatgaattatggcaggtaattgagatgggtactacatgtgactttttggctgtaatcaaacaaacaaaagcaccaatctttagtcataaaagaggttcagcattgtatcatggttttggatggcaatagaaggacagtagctgaagctctaaataaccggagatgggtg

SEQ ID NO: 78131 - DNA, 362 bp, Triticum aestivum
  Clone ID: PAT_TA_78131
aaatttgcaactgagcacaagtgtgtttcagcggatgtgatccggaaagctttccaagcaactgaggagggctggctttctcttgtaagcaaggaatggtctatgaagcctcagattgcttcagtaggctcctgctgccttgttggtgtaatctgtgctgggactctctatgttgcaaacctgggcgactcacgtgcagttcttggaaggcttgttaaggcaactggagaggctgtggccatgcagttgtcatcggagcacaatgcgtgccatgaggaagttagacaagagctgcagtcatcacatcctgatgatccacatattgtggttcttaaacacaatgtttggcgagtgaagggtct

SEQ ID NO: 78132 - DNA, 166 bp, Triticum aestivum
  Clone ID: PAT_TA_78132
gacggacggcggcgcggcggcggggcggatcgtgatggagctggacgcgaacgaggtgcccaagacggccgagaacttccgcgcgctgtgcacgggcgagaagggcgtggggaagtccgggaagccgctccactacaagggctccaccatccaccgaggcatcccg

SEQ ID NO: 78133 - DNA, 497 bp, Triticum aestivum
  Clone ID: PAT_TA_78133
cttttcagcaaactttacttaagttttgttcaattttttagtgtacttaagttttattccaatttggttaccatcgttgaaaaccagttaatttttctgctcaaaatatattttctcttcaatttcctgctgtagttgtctttttgtgcgcttagtacaatgtgtttggggtgttgcatctgataagatctcatcagtagtggtttcgattttgatgttttatctttcctagaatctcggaagcacacttaggttggaaacacgccggtagcatttatttatctttatttgttgctatttgagttagtttgctgcttggatatcatgccataccagctctaacatccatgcatatgatttctccagggtcatattctgaataatagtgcaaggtactttgagttaatgttctgcaaattagtgcatctggaacgctaggatgtgtgggaacacaaaggagttggtgtgtgcctccattgcagcttaggatgtttacg

SEQ ID NO: 78134 - DNA, 549 bp, Triticum aestivum
  Clone ID: PAT_TA_78134
gaaaattggttaaacaatttcattgatgacagtttttgataatttaattaatttttaaaggttcaatttcagtttagtttatttcaaaatgttgattcccaagaacaatagattagcaatctatgaatatctattcaaggaaggagttttggtcgccaaaaaggacaccaatttacctcgacatccactcatcccaagtgtaacaaaccttcaagtaatagtgactatgaaatcacttacatctaaaggtttggttaaaacccaattcgcatggagacattactactactatttaacaaatgaaggaattgcttatcttcgaaatttcctctgtttacctgccgaaattgtcccagctactctaaaaaggaaacaaaccgaagccagaggaacagctggagctggagctggagcaggaactggagccggtgttggtgctggtgctggtactggacctggtcttggagctcctgagtctaaattcaaaggatatggacgaggaaaacctgttgaataactgtctaatataaatttcaatttaaatcatta

SEQ ID NO: 78135 - DNA, 472 bp, Triticum aestivum
  Clone ID: PAT_TA_78135
acggcgatggaatgggccatggcagagctgatcacccaccggaacgcaatgcacaaggtgcaggacgagatcagggcggtcgtcggcgtcacaggatgcgtcacggaggaccacattgacaggctgccttacctcaaggccgtgctcaaggagacgctccggctacacccaccaaacccactgctcgtgccgcacgtaccattagcagacaccgagatcctaggctacacggtcccgacgcacacccgggtattgatcaacgcgtggaccatcggccgcgacccggcgacatggggagagcacgctgagaagttcataccagagaggttccttaacaacaacgtggactacaaggggcaggactttgggctagtcccgttcggtgccggtaggagggggtgccctgggatggggttcgctgtgccgaccatagagatggcattggcaagcttattgtacaatttcagctggg

SEQ ID NO: 78136 - DNA, 257 bp, Triticum aestivum
  Clone ID: PAT_TA_78136
tgaagcaaattaacatttctcttgcaaatttcgatctagctagatcatttgcaaagcttgtttgttgatcgatcgatgatggggccgaacgtgtcgtcggagaagaaggcgttggcggcggcgaagaggagggcgtacgtgacgttcctggccggcgacggcgactactggaagggcgtcgtggggctcgccaaggggctccgccgcgtccgctcggcgtacccgctggtggtcgccgtgctcccggacgtttccgg

SEQ ID NO: 78137 - DNA, 270 bp, Triticum aestivum
  Clone ID: PAT_TA_78137
ccgccgtctggcgcacccagcttttcgtctgcaaggcgcagaagaatgatgaggctgcatctgacgctgccgtcgtcaccagccggcgcgccgcgctgtccctcctcgccggtgccgccgccatcgccgtcaaggtctcccccgccgccgccgcctacggagaagcagccaacgtgttcggcaaggcgaagaagaacacggacttcgtggcgtacagcggcgaggggttcaaactgatgatccccgccaagtggaaccccaccaaggagc

SEQ ID NO: 78138 - DNA, 566 bp, Triticum aestivum
  Clone ID: PAT_TA_78138
ttacatgtgctcgacggcttcacgttcttcttctccaacctcttctcgcgagtgcagacgctgacgctgagccagttcttggccaaggtggtggagaccgatgtcaggtatacactactgaaggcttcactcacggacgactacacccctgagaactcctacgccctgctactggccaaggagggagtatcgcctagcatcactggcaaagtatcaaggtcacagattgcagccctggtagctgatgtcttctccaatgtggcagtcgctgagaacaaagtcgttgaagtttcaactagctcatcagcaacaacgaagtccataacggaggctttcatagctatccctgaagacagtagaagaacggagtaccaagatgctgctgcgaaagcacaagtcaaagaggaaaccttggcctcaaaacaagctaatgaagctgaagcggctgccagtaaatatgaagctgacacgaagaaggcacccttagaagatgcagctgctactgctagcccagtaaatgatgaacgagcctctctagagaacctgttgagtatacccaaagtgat

SEQ ID NO: 78139 - DNA, 417 bp, Triticum aestivum
  Clone ID: PAT_TA_78139
catggtcgacgtgctgctgaggatgcagaatgacaaaggcgccatgggatccgtttctctcacccacggtatcatcgtggatatgttaatggatgtgttcgttgcagcaatcaaagcaataacatgtactcttcgatggaccatggccgaacttatggcaaatccaagggtcttggagaaggtgcaaaccgagatccgccgcgtcctcgcaggacaatatagagtgcgtgaggaagctctaagagacctaggctacctcaaagcagtcatcaaggagactttgcgattacatccaacaattccattagttcctaggttctgcacacaagaccgcaagattcaaggatacgatgtgccaaaagggacaatagttgttgcaaatgtatgggcaatctctagggacccaaactactggca

SEQ ID NO: 78140 - DNA, 495 bp, Triticum aestivum
  Clone ID: PAT_TA_78140
taacacatacagctagacgagaacttgctgggaccgggaatctgatgtaaatagattattcagggatttttcactttgagaaacaccccagaggcgctatggcagctttttgtgcagtgatcagctaagcacctattgttgtatcattagtttgttgcagcggagttgagtgtgcattcttcgccttactgtaagagcaatttatacagtggatggggttgccttcccctgccctttcggcaggttagtaaagtgtaccctggaggaaagttaacatttgatgtgttttctacagctataggaaatgtattttacttctatagtaagtacatcggcaaccttgtatttttttttctttcagcatcctagtcgttcaatacaaaacgtgttgcacatgtctagcctccatttcaagggcctacaaatatatatctaaatctacacaacgcatgcacatgcaccagagtatctgtatcgactttgaaaggtttggta

SEQ ID NO: 78141 - DNA, 209 bp, Triticum aestivum
  Clone ID: PAT_TA_78141
agctgctagccgccgccgccgccgccaccgccgcagccgccatgtcgggaggaatcgcgcgcggccgcctctccgaggagcgtaaggcttggcgcaagaaccacccccacggtttcgtggcgagggcggagacactagccgacgggacggcgaacctcatggtctggaactgtaccaaccccggcaagcaggggactgattgggaaaga

SEQ ID NO: 78142 - DNA, 541 bp, Triticum aestivum
  Clone ID: PAT_TA_78142
agagagagagagagagagagagagattgagagagagagagaggggagcttgtggtacaaacccgaccatcggcaccagtgaatgaattgcaacctgtgcaaaatgagtgcttgcctgagggatctgtaagcactgctggaactgcaactgagaacgagaaaagcattcagcaagcccagcaaagttcaaaagatattcaaagcaagtcccagggtgcttcgacaaggagctgcacaaaggttcataagcaaggggttgcgcttggcagatctgtggacctctcaaaattcactgactacgatgaactcaaagcagaattagacaagatgtttgaattcaatggcgaattagtatctgccaacagaagctggcagatcgtttatactgacaatgagggtgacatgatgcttgtgggggatgacccgtgggaagagttctgtagcatagtgcgcaagatctacatctatacgaaggaggaggtccagaagatgaactcaaaatcatctgcgccaaggaaggaggagcctctaacagtgggtga

SEQ ID NO: 78143 - DNA, 500 bp, Triticum aestivum
  Clone ID: PAT_TA_78143
ttacggcccttccatcgttgacgaatgtcttgaggccataattgtcagcaaggagacattgccaggaggacacgctgtcaacaggaagagagcagagagagggctcactcagttacagatcgaggtggtagagctggtaccagagaaatcgactggaaataagataagctccacagcattcagaaagatggaagcagagagggaactgcagcaacaagaaaccgcaataggcagtcacagcattcagaaaattgaaagcagcgagggaattgcagcaacagaataagcgaagagacatcaagcggcggcagtcacatggagcagaatgatgagctacggttttgcaacagtactcttgtttattcatgtgaaacttgaggtacaaaagccaaaaatgttctgttctacttaacatataaaaggcacgacgctctgctccatcatgtaatgctcaatacagaaaagttacagttcttttaaaaaaaaaaaaaaaaaaaaaa

SEQ ID NO: 78144 - DNA, 463 bp, Triticum aestivum
  Clone ID: PAT_TA_78144
gaggattcatagtctagtggacctgctcatgaaagtacttgctagaccagatcttccgttctatctttatacagtacctccaaagaagcgaataatggacacatcacaggacttctgtaccgctggttttgttcctggagctaatgttcatttttcttatgatctgcccgaaggttcattggtaaatgcagatgatctaaaagcaggaccctttctccgtgaagaaattcgaagtttggacggattgtcacttctgctgaaacctgctagtcaacctgatgattctagaatgaactcttctactcttcaatctggtgcatctcaatctgatcctgtaccaacaacaaataagaagcctggcagaccaaagtggttgaaaaggtgataccactccaggcgtcaagtgcgtgccgtcaacacagaatcactctgttaggcttctaaacactactcatgggtaaac

SEQ ID NO: 78145 - DNA, 549 bp, Triticum aestivum
  Clone ID: PAT_TA_78145
ttattgcccccttcattaataataataatttgtagttttttaattaataatggaacaggaacaggatgaacaatttatccaccattatctaataatattgctcataataatatttcagttgatttaacaattttttcacttcatttagcaggaatttcctcaatcttaggagcaattaattttatttgtacaattttaaatataatacctaataatataaaactaaatcaaattccactttttccttgatcaattttaatcacagctatactattaatcttatcactaccagttctagctggtgctattactatattacttactgatcgaaatttaaatacttcattttttgatcctgctggaggaggtgatccaattctttatcaacatttattttgattttttggtcacccagaagtttatattttaattttacctggatttggtttaatttcacatattattagccaagaaagtaataaaaatgaaacatttggaaatattagaataatttatgctatattaactattggattattaggatttatc

SEQ ID NO: 78146 - DNA, 536 bp, Triticum aestivum
  Clone ID: PAT_TA_78146
ttcgccacagtcgcggtgagtgctctcggtgaagcgcctctcagaattccgcctcgttcccgcgcccgcgccgcgcggatctgatcgtctcgatcgtccgatcgagtggtgttttttctctgcgattacgggttgctgcatgattagcttagattggacgctagcgttggcgagatttccgagatggggctctcatttgggaagctgttcagccgcctcttcgccaagaaggagatgaggattctcatggtcgggctcgatgccgccggtaagaccaccatcctctacaagctcaagctcggcgagatcgtcaccaccatccccaccatcggattcaatgttgaaactgttgagtacaagaacattagcttcaccgtttgggatgttggtggccaggacaagatcaggcccctgtggaggcactactttcagaacacacagggacttatttttgttgtagacagcaatgacagggaacgtgttgttgaggctagagatgagctccacaggatgctgaatgaggatgagctgcgtga

SEQ ID NO: 78147 - DNA, 437 bp, Triticum aestivum
  Clone ID: PAT_TA_78147
gcagaaaagttcggtccatctagcggttcttttgcacaaaggaattcaaaagcgcagaagaaaactttgaacatgcaaccaagacagccaacaaatgataatgacataaacagacatcctcaaacattgacaagaagagcttcttatccttgtgagaactatgaaactgaaagaaaaggattagggaaaagaactctgggggatcctcaagttacaatgggtacttcaatggtagtggatggctcatttgtatcatctgtgtcctctgataactcagttgaagaaagcagctttcgacaactgcaggatgctgttagtcagctggatgtgcaaaccaaattgtgcattagggatggtttataccgattggcacgaagtgcgcaacataggcaagtttttccaaatatgatgaacaacaatggagatagccaggatgt

SEQ ID NO: 78148 - DNA, 517 bp, Triticum aestivum
  Clone ID: PAT_TA_78148
acagtagagataaaaacatatccagtgttcactgaagtacctgaaaatacatcagaaagaaacttcactgttctaattcaccttaaggcaccccttgctcagcatctgcagccatccagcaatcttggagatggcaatggactaagtacaactcgtgcccctgttgatctcatcacagttcttgatgtcagtggaagtatggctggtaccaaacttgcattgttgaagagggctatgggatttgtcattcagaaccttggatcctctgatcggctttctgtcatcgccttctcatcatccgcacgtaggctcttcccacttcgtaggatgactgagtctggtcggcagcaaagcttgctggctgttaattcactgacttcaaatggtgggaccaatattgcagagggcctcaggaaaggctccaaggtgatcgaagaacgccaggccaagaatccagtctgcagcatcatccttctgtcagatggtcaagatacatatacagtctcaccaactgctg

SEQ ID NO: 78149 - DNA, 488 bp, Triticum aestivum
  Clone ID: PAT_TA_78149
cttgcaattctcagttcctttctggccaaatcaggaagatggaggcgatctgtcacaagaaacacacgagattgtcaagcctgtggcagttcattccaagaatccaattaatgttgatgaacttgtgggcatgtcaaagctaagcataggggagcctggtcaggagacagtttctacttctctgtcgctaaatctgctagggggtcaaaataggcagtcggctttccatgcaaatcctcaaacgagagctcaagcctgatcccccatcagcacagaaactgcatttagatggaatcctgggcaaaaaaagctttgcctctctctctctctctctctctctctctctctcttttctatatttaagattaaccgtgctctgtagcttgtatcatgtgctgtaagttatgctacgtatgaatgtacctgttgtttgtctggcacgcatgatatgacactcttatgttaacaaagtcaaaaaaaaaaaaaaa

SEQ ID NO: 78150 - DNA, 419 bp, Triticum aestivum
  Clone ID: PAT_TA_78150
aagttcctctttctagatcaatgccaagaggtgactcgattcgcaaccaggggccattgctcaataggccgtcaacagttcaaaaggcatcatctattaacacgaggcttcttcctcaaggcagtggcgcagcactaattggcaagagtgcacttttgggaactggtgttccaccatctcgtcctctcagctttacacctggaccagcaccagctcaaactacaccatcaccaaaaccattaattgcagcaccagctgttgcccctgctcctgataaaccagccagtgctcccaagggcaactctgctgagcttcagaagaaaacaatagctcttcttgaggagtatttcggcatacgtattttagatgaggcacaacaatgtatcgaggagttgcagagtcctggttactacccggaa

SEQ ID NO: 78151 - DNA, 280 bp, Triticum aestivum
  Clone ID: PAT_TA_78151
gaactgtcgcggtccagcattgttgcagggcaggccacctatgcatgtaggcatgtagctcatgtcaaactgttgttcaggtaaacacagctgtccctgtagccgtgtaaagttgtgttattggatccatctgggttccaacacaccaacagcgatgccaggcagcttggctctgtattcccccattgggacaccattttcagaactcggtgccgtgggtaaactcaacatcaacatgcctgttttcaccgattctcagcaaaaaaaaaaaaaaaaaaaa

SEQ ID NO: 78152 - DNA, 302 bp, Triticum aestivum
  Clone ID: PAT_TA_78152
tttttttttttattttttttttttatttaatccaaaatatagtcctttaaagcttgctctaagtgagcaatataaaaagcaaaatatggtctttaagtaaataagataaaattaaaaaccctttaataaacacagtccccaatatattgataaacccaatagggtatataaaataataattgattaaaatggaatgatttagttaattaaatataatatatatgtaataaagttaataaatgtatcaataaatgtatataaagtcatattctctcttcatttgagcctcgggccgaattcgg

SEQ ID NO: 78153 - DNA, 599 bp, Triticum aestivum
  Clone ID: PAT_TA_78153
ttcgcggagaggatatatatttggttctagttcccaataagatagctatacagaaagaacaggatgaattgaacaaaaagggtaccgtgaaagaagagagagaccaatcagacagtgatgaaccagaagaggacagtgatgaacctctgacacaactgctggaggaaagtatggagcctgaggcagaagtctcagcaaatgtttgatttgaactctaaaggccaaggtgccttgctcagattgaaacagtatcacgcaggcacagttgctgtagaattgcagttctcgtaaatacaaggctggtgctgttgtagaacaattattatctgttaaacttcatctgcacaggctatttgttaggcgccaaggcgtctgacaaataaggcttgatggtgtcctccaaaggtccaacatattagcattgaaggatgatacctggccaccagggaactagaaatccccacgccttgcacaaatggattgcgacaaagaggttggatctggaaccaataataaagtaattgatagcaaagacattttgatactatcgccaagcgcggtgggcttgcagttggcacttattttttgtttttgcctca

SEQ ID NO: 78154 - DNA, 754 bp, Triticum aestivum
  Clone ID: PAT_TA_78154
aaatcctgataccgatggacgccacaacaaggattcctcagagatctgctcagctgagcaggacagtggaacggacactgaagagtgtgagcttgtgttgaagggtaaggatgcatgcaaggagtacatcaagagcttcttggccgctatcccaatccgggagctgcaggctgacatcaagaaaggtctcatggcatcaactcccctgcaccaccgcctccagatcgagttccattacacggaatcttgccctgccgagatcagcgtgcctgctccactgtccccattcgaagccccttttgagttctgttggcctgagccaccatcacccccacctgccactgaattcgctgtaacctatcctcctgccatggaggtcgccataacccaggccgttgccgttatatagctgaccttggttgctgctgtgactagggcagtggctgcgtagtttataacatatagagagctgcgcttttcagagcgaattgtgaagtggaccagatcaaagatttggcttcgtttctagtttgctcgtttgctgtccaaagtccaactaagatgaactgactagtatagcttaactgtcttttggtctgcgtgtgtgtgtttgttttgttcacttcttccaggcttttggggagcttccattttgtaaagaaagaaaggatgtttgctcctgcacatctttacctgtgaagtgagtttgctggacttgtaatcctggctacattatcattatgttaattatgtc

SEQ ID NO: 78155 - DNA, 321 bp, Triticum aestivum
  Clone ID: PAT_TA_78155
ttcgtttggtactggagttcagctcatcatgggaatgaaccagattttacttattttgtctgtttattattagttgtgtgactggtctttggtgtcttggtacccgtgttaggcttcttacataccctgtgacacctggtttgttgtaacccttgttttttttttccctttttgttttagctctattattgttagcgaggcagccgatttcctatacttcgaacaacattaaggtagttttttttggcgtgttgcggtactgtggagagtaataaaagacaaaagactctaggtttaaaaaaaaaaaaaaaaaaaaaaaaa

SEQ ID NO: 78156 - DNA, 687 bp, Triticum aestivum
  Clone ID: PAT_TA_78156
gcacgaggcctcggcgtcggcggtggcggcatcgtccatggcatgtcgacgccgagaggagaccaccaccagagcagcagcgacatgagctccttggaggccgagatgaagtccgcatcgtccttcaacgggagaaggatgccatgaatccaccatgatcaagtcatcgatcgagcttacacaagccgtcaagctccgatcgatcggtagtagtaccaagtgagagtctgagacttgaagcaatgcaactgcaactctgggggattaacgcatgcgcgcatgaattggggaggagcaagctaaggttatagtatactcatcatatatagcctaatgtcgagttagcaactaagtttgatcgatcgcatgagctggtgtgcaagcatgcatgggataaaagctatactaagctagctcttcaagcatatcatgacctggaaaacttggggtttagtcaggaagagaggcgtcctctctgactaattaagtaattaaggctagtgcgagtggacgcgtgtgatgacccttgttgctctcggtggggttggtgttaatgccgttgctattgttcttgttgtttgttttcacctccttgtagttggatccttgttgggttaagtatagttccatagagccaataagaatgttcaatttgtagctagctcaatgggggaaagagagtggctt

SEQ ID NO: 78157 - DNA, 229 bp, Triticum aestivum
  Clone ID: PAT_TA_78157
ggggaactgtataaattcagtcagggccttgcaggttgcagagttttataggctgtaatcgagcaggtaggtaaggaggcaggcatgtcagaacttaggctgtcatcagtttatttgttccatttcgaactgtatcataaggagcagcttggtgactgttcactgtcatgaaggaaaatagaaatgccatttactacaagtaactagatgagctaaaaaaaaaaaaaaa

SEQ ID NO: 78158 - DNA, 592 bp, Triticum aestivum
  unsure (1)..(592): unsure at all n locations
  Clone ID: PAT_TA_78158
ggatccactaagctacctgtctgtgggggaatggatacagtacctgctgtctgcttgccaaatgttgaaaacaagtgatggactcctgacagtgtttatggcctctccttttcggagactgctggggcttcccgttctgcctcaaaaggaacgctgtataaactgctagctcttctatgtaggaccgcactggttcaaactgctatgtgtgtgagttcgtcgcccatgatgcttctatggtgcctgaggcgattcaagtttgttagctctagagctgacaagacatccttgtttattttccttagttcccagatgctttctgatcaagtgcagaactggaccggatctgaaggagtcgaacatgaactggttaaaaattggcatatgtggtctaagacgctcagatttttttagagaatctcaagtttaatgtaaaccctgttgcccatgtagatgcatcgttcctgaaatccctttgtgggtgccatgtctctctgctgctgtgtgcgtgatctgagggaacctggattcgtttattgtttgaatgttttactatttcattcgcaaataannaaaaaaaaaaaaaaaaaaa

SEQ ID NO: 78159 - DNA, 729 bp, Triticum aestivum
  Clone ID: PAT_TA_78159
gcacgaggccgccgcctctctctctctctccgaccgcatctcccccctcaggtttagtgttaaaaaatggcggccttcaacaagcttggcagccttctaaggcacagtgctctggcgagcggtgtcgctgctagctcgtctcctgctgtgttcaatgctgctcggctcatgtccaccaagctattcgttggtggtctttcatggggtgttgatgacatgaaactgagagaggcgtttagtggctttggagatgttactgaagcgcgagtgatcacggacagggacactgggaagtcaagaggatttggctttgttaactacaccagcagtgatgctgccaatgcagctatatctggaatggatggcaaggaaattgatgggcggcccgtacgtgtcaacattgctaacgacagacctgcagggaaccgcggtggcggtggctatggcggtggtggtttcggaggtggtggctatggtggtggcaaccaaagctatggtggtggctattaagctcattaacagtcaagatatttgaaataatgaactttaggacctggcatggggcttatgtgaagcctttcatattttgatatttgtgttatgttgaactgttggaactcctagattcatagactgtgccgcagagtattatacctattggttttggttgcttcgttaagtgcaaatgcaagtcgcatgtatttctgttgagtggatacataatttgca

SEQ ID NO: 78160 - DNA, 429 bp, Triticum aestivum
  Clone ID: PAT_TA_78160
ttacttgtaaggaataaaatatgctccgacaatagtgtatttaggcgccattgttttgcagttgctgctgcttttcagcagaactagcctgatgcttataagcatcagcaattccattgttttgcttatggctgattactggatcttctataaactgatgcattacctctgcttgcctgcctctgtgtgtgttgtgtgcttgtcagcactgactccagatgcgtgcagtcagcataaagctattgtgtagatactagatactggtgttggattgagagggttgcattttgaagttacattggttggcatgaagctattgtgcagatactgtatactgttttttctttaaaaagaaagttggatactggagtttctgtgactaattgaaaatcatagctctcttggattgaaaaaaaaaaaaaaaaaaaa

SEQ ID NO: 78161 - DNA, 603 bp, Triticum aestivum
  Clone ID: PAT_TA_78161
taaaataaagcttaaaggagtggaagaagaagaggtttcccctggttttgtaatttgtgatcctgtttcaccatgtaatgttggtaaaatttttgacgctcaagtggttattctagagcataaatcaattatatgtccaggatactcagcagttctccatattcacactgctgttgaagagatatccgttagagccattttatgtttggttgataagaaaacaggagaaaagtctaagactagaccaagatttgttaaacaggatcagattgctataatgaggcttgaatgtactggaggcatgatttgtatggaaccattcgcacaattccaacacatgggaagattcactttacgtgatgaaggaaaaacaatcgctattggtaaaatcctaagagttgtcgagtaactcaaataacgatcaacaagaaacgtcgtctgctgaaacattgcgttaacatcgggaatctaaaaaaaaatatacatttataatataaatattttttgcctctgatcattcattcatatgtcaacccagtttaacacaattaatcatgattaaaacatgttatgattaatttaaattaaaaaaaaaaaaaaaaa

SEQ ID NO: 78162 - DNA, 311 bp, Triticum aestivum
  Clone ID: PAT_TA_78162
cgaagagcagcaagaaggtcgccgacgacgtcggcggcgccggcaaggagggccgactggtctagctcggaggagccacttcggtccatggaatcttcgatctgcttataacataatactcctgtaatagtaggccagcaccaggacagcaagtgtgttccctctcccctgcaaatcaaccgttctcctcgatctcccgtgattgtgtgtacctgcgtatacgagagtacgtgctgtagcatatatactgtaataatgcaactgggttttttgtgtttaaaaaaagacaaatggaataaaaaaagaaaaaa

SEQ ID NO: 78163 - DNA, 758 bp, Triticum aestivum
  Clone ID: PAT_TA_78163
gctgcaaatcaaagcgaggcagcaactacactaatcttgaagatatccaactttgcaaatcttggattcatatcagcaatgaccctatcatagggaatcagcagccaggaaaaacttattgggagaggatcgcaaatgattttcacatgaacaggaactttgagtccgataggactcccaattcactcgagcatcgctttgggatcatattaaaggagtgtatgaaattccaaggctactacgaggaggtcgagcgttgtcatccaagcggcattccataccaagagcatctgctggaagcccacgcaaggtatgccagaaaagcgaatggcaaaaattgtcaattcgaacagtgttggctcacgttgaggcacactcagaagttcgaatcaacacttgaagccaacaagaagccggccaagtccagagagctcaacctttcggtaggaattgaacaagagaacgatgagtcaagcgcccaaggccaagagacctcttcaatcccttctgccaagaaagcccgacctccgggtagaaagcaatccaaagagaagctgaaaaagaatgaaggagatgacgactacaaggatatgatgcaaaatttattggtaatgaagaccgaggaacatatgatgaagaaagaaaggtgggagaaggatatgatgcttgagcagcgcaagcttaagatggaggaggagtggctgcagtgggagcaggagcaaaaaattatgttttgtgatgtcacaacaatggatgat

SEQ ID NO: 78164 - DNA, 406 bp, Triticum aestivum
  Clone ID: PAT_TA_78164
gcacgagggctcacaggtcacagccccttgctcattggatgaatggatggggggccggcggacggaaatcgcgagaggatgcgaagacattggcgtattgcatatggtggcaccaagcatgaggcaggaactgcattacttgcaagaaagtcacaagtaagataccaaagcttgtggttcattataaggtgttttagtgctgcctctttgttttttccaacctcttgttccacaaacagccctctagcttgtatgtagtcctgtgattcacctttatggcctttaagttgaccattatgggccttcttcctcctgtgtacccttctgtacagctcagaatttgtaatttttctgctcataaatcagagttgttttatgaggaatgaaagcaaaaaaaaaaaaaaaa

SEQ ID NO: 78165 - DNA, 736 bp, Triticum aestivum
  Clone ID: PAT_TA_78165
gagggtttgacaaagagaaaagaatacagggaatgcagtgaaccaagagttttacccactcctcctgtatccagtttagtcgttgcagaaaaatctccccctttttttttctttatctgaagatttgctcctggttcttcaactactaccaagaatcgagctcctgttgcttcctctagcctctgtctagtctgaagcctgaacccttgcatgctccagtttctgcactgtgtgagcagaattatttctgaagtctgaacagcagccaagcaaaaggtgaatttggctgatgattctgcccctgtgttctgatttattcaagacactagcaactgaatcatcaggtgttggtcgcgaatatcccactgatggattcatcgagttctttcgtgctcgtggtgctgattctccaagctgtcgtgatcggttgctcctcactggacgagctacccgttcagcttagcaaccggaggctacttcatgacagaaatcacgctgctctactctacaaagatcatttcccaacagttggaaacatgacgtttccaacatctcatcaactgcaaaatgatccaaattacaagcctctagatagttcatcccaccctgccgaggcttctgcaaagaaaggatcaagcaaaggattcaagaagtggctgtatatggttgtgattccagtggctggtttgattatgcttgctggcatggcatggatgttcttgccatgccgcaagaa

SEQ ID NO: 78166 - DNA, 350 bp, Triticum aestivum
  Clone ID: PAT_TA_78166
gtatcagcagaagtgcagggcagtgtatctgcgtttggtgcaacccttggagataagtcgaagagggtaatggaagagtgcaaggacggcctggaaaagttttcacacagattcaagacatcagactagagggaggctgtgtcgcctctgtaccaagaacaatagtaaattcccttggaataaatttttggggtggtgggtgttacagagtttactgaagtcatgctggaacgaacagtagttcccgtggaataagtccgtgctgtgtacagacaggattgatgaatcctcatacaggcaggatgagctgccgcttcttgttaaaaaaaaaaaaaaaaaaaaaaaaaaaa

SEQ ID NO: 78167 - DNA, 642 bp, Triticum aestivum
  Clone ID: PAT_TA_78167
tgccaaaaaggctgcagaagaacttctaatactgaaaacaacaatgcctcaagctcaaacagcgattctgttatggctgaagcagaacctgcctcaaatgctgctgctggcgacaagaaagaacagccaaaggatgatgacgatctactacagcaggcacttgcaatgtcaatggagggtggtgcttcaggatctgcagctgtgactgactctgctatggcagaagctggtgcagttgaccctgacttggcattggctcttcaaatgtctgtccaggatgcaaacatgtccagtgacactgatatgagtaaggtgtttgaagacagaacgtttgtgtcatctatccttaattcgcttcctggtgttgatcccaatgatccatctgttaaagatttgctggcatcattgcacagccagggagagcaagagaagaaggaagacaagtccgacaaaacagaagatgagaagaactgatgtagccatgttcatgcttccatgcgcacaaagaaattgaagatcggtctccgttggctgcgtttactctcttggattcgtggaatatacttatcctcatgtaacaatgctttgattataacttaatgcggagggaatttgtattatgaccgcaacaatcttctctcc

SEQ ID NO: 78168 - DNA, 659 bp, Triticum aestivum
  Clone ID: PAT_TA_78168
ttgccaaattgaaacattataagtagtatggattactcaaatgttctcttgacccttggagataatgcaagtcaaaggacctggcacttgttatttttctctccaatatgctgcaataaaatgcttccacactttacttctactccctattagcacttaggattgtttggcactaaaggttcgctaaactatgcaattctgctgcctgctgatttattctgtccattcaggatggcatgtgggtagttccatcagagtacacaagtgcagaacctgatcctctacgcaattttgctgaaaacattgtggaggaatttaacagcaaaaatgctgaagacgtccataggatatacaacatatatgtcgaatcagatttacaggtggcagatgtgaagatcatatgggttgacaggttaggtttcgactttcatgttcattctggggaaggtgtctttgctgttcggatccctttttcacgggaggtcactgatgagaagggggtaaaatcatcattcaacatgatgtctcatcatgcctgggaggtggaaaagagctatgccagtccagagtttgagaaagtacagttcttgaagaaggtcagatagcagtgcgaattctatttctgtgggccattattttttgttattcagaggagtata

SEQ ID NO: 78169 - DNA, 300 bp, Triticum aestivum
  Clone ID: PAT_TA_78169
tctccgcctcttcctcctccgcctccggtgatccggtctcgctatctctcttccgcatctcgggacgcgatggcggcgctgctgggccggaggttcgggatggcggcggcggcgctcatcgccctcgcggcgctcggatccgccgcctcggggacggcgtccaagtcgtccttcgtgaaatccaccgtcaaagcccacgacgtcgtcatcttctccaagtcatactgcccgtactgtagaagagccaaagctgtgttcaaggaacttgaactgaagaaggagccgtatgttgtggagctt

SEQ ID NO: 78170 - DNA, 461 bp, Triticum aestivum
  Clone ID: PAT_TA_78170
cctacaatctctttgtctctcagttaggcaatggtactctgatacctcattcttcatcgtcaaaccaacttgcaaaggattccccgatgatagaagagattatgaacatatcaagaggtcagcgtcaggttatacatcagctcgacaatctgaccaacctgcttcatgagcatttggtcttaacacgccaagcaaataacgccagcaggaaccgggtgctggatatcgacacggtcatgtgtccacttatctgcctgactgttgccagtattgggtacttcatgtttaaaggtctcaacaggggctgaccaaagtgagtcggccctaacatgtgctctgagtctcaccatctagttttggcggaactggaggaagcaaccgtcacaactcaactgatctgcaatacccctatagtccagagttcatgcatactgatgctgtctttcctgcaagctaaagga

SEQ ID NO: 78171 - DNA, 415 bp, Triticum aestivum
  Clone ID: PAT_TA_78171
tgtccgcgcacgggcgccgctagtgcagtgcatcaccaacctcgtgtccatggacatcgccgccaacgtgctgctcgcctcgggcgcctcgccggccatggtccactcgctccgcgaggtgcccgacttcaccccgcgctgcgccgccgtgtacatcaacgtaggtacgctatccgaggactggctcccttccatgcgcgccgccgcctgcgccggccgcccgtgggtgctcgaccccgtcgccgccgccgcctccgggttccggatggaagcctgcctcgagctcctctcgctctgcccagcagtcgtcagggggaacgcctctgagattctcgcgctcgcctcccgctcagccgccgcctcctcttccaatttcaagggtgtggacaggtcacatggctctggggatgctatt

SEQ ID NO: 78172 - DNA, 786 bp, Triticum aestivum
  Clone ID: PAT_TA_78172
cttcactgcatccacatgttcaccattttctccatggttaataatttctgatgctacgttgttttgtgagagttcattaaatattgctgcttgcactgggtctggttaactatcattgtatctttgaataaaatacatactctttgatctgattgtcaacacccagaaaatatggtgttaaaataaggtattgtggtagcacatccagttcctcttgctccacattctattttatcgtaataggattgctccacactccaaagtgcactagttcagggatcaagaagatgcatacctaaaggcatacaaatttgaatgatagtctaacaacctgcttttactggtctgcatctggatgcaatacaaaactactgctttctgaacctgatagattttagtttcttaataagcttcctgctactcaaacactagcagaatgggtcatctagttgagaaaatgtatatgaaaggtggaaaaaaatagaagtcacattctagggataagaaagaaaatatcatatgcttcttcattttcttgtgtctattttcttctttttcttgtttgtttttggtgctttgatacaggtgtagtcagtttgttgtggttataaattctccagagaagtctggtgaaatgctcctcctctaaccctcatggaagcaaggtccatgctatttctgcatgtgcatgaacacatttctagatataatggagagcatgctttggtactttggctagtcttccaaactgttagtctttactttaccaagtcaagtctgtttagc

SEQ ID NO: 78173 - DNA, 343 bp, Triticum aestivum
  Clone ID: PAT_TA_78173
ggcctgcggctgctgtccgcgcgcacggcggcagcagtctggcccgtcctggcgcgtggcagtggtggcgcggctcgcttgcggcctgcgcgcggtgaccggtgcgcgacagtgcggccggcccaggcccgagcgggcagcggcgtggtccgcccgacggcatgtgacgctcggtggccggttgtcgagcccgcagttcggcgttcccacagccacggcgtgcaggatgacggggctagaggcatccgcgcgtccgcgttccgatccgcacgtcttcaggacgtcggtgtcttggcccgcatgcacatcttcaggatggcagcgagatactagtgtttgttta

SEQ ID NO: 78174 - DNA, 201 bp, Triticum aestivum
  Clone ID: PAT_TA_78174
gcatccctgcagcacagtatagcatagcaaacatctcatatgagctaaacgtctttggaactcggggtcctaggcggatgcgctgtttaatgcactccatccctgcctcatctcttgaggctggtgggactgttcctagccagccggatagcctccttgcccattcccttaatgaatcctcctttaggagtgtctcctttt

SEQ ID NO: 78175 - DNA, 792 bp, Triticum aestivum
  Clone ID: PAT_TA_78175
gcacgagggcatcgtctcaggattatggagttagagtttgtttttttaagtgacattatgatttccttcctatagcaatactttggccatacctagaaaaaaaagaaattaggcaaatacatgctaaatattagtacccttcatttattatgttatatagcttttacctttcaaaaatatgtcagtgccatatgatcaaaccttctgttagaaaccttggactttaacagggaaacttactaaatcagaaaatcacgatgtcctaccacatagagatagatattagttacctcatagtttcataaactattccaaagctaaacctttgaccccatcacccttgcagcccacaaagctactttttcatattgatagattgcaggaaacaagacattttagatctctatgttcatcaaaatgaggtagttgacattctggtgttttggacccattctggtgttttggacccatatattttcttccacaaaatagtggtgtgatggatgactgccacactgtgtctatgtgtctgcatctatgagatagaggacaaactagaggcaacgttagaattgcatgtacatgccactctaagctagcataccgagcaaactcttaggtggttaaaaagacaggtctattccttgctatacttcctacatggagatataaagacaaattagatgagtaacaaacaaaactaattttatactgaagttcttttaaataaacctacctctatttattacccactaacaatatacaaactttgataatatatgtataactgat

SEQ ID NO: 78176 - DNA, 350 bp, Triticum aestivum
  Clone ID: PAT_TA_78176
tcatcccctacctcatcaggcgcgccgaggagaacaggggactcctctccgcgtcgtccttcgacaggcacctgctccggaaggagttggtgaggagggtcaagaccgcagtggtgggaatgggacgtgagtgagtgaagtgaacttgccgagcctgtgatggatgaggccgtgaagctgggacaagggcgagttgaaggctagtagaagctgtaaatacacccttcaacagtcttcagacattgatgatgatgtatccggggcttttcttgaataattcgaatgaatcgaataatgttcttggtatttttaggctaaaaaaaaaaaaaaaaaaaaaaaaaaaaaaaaaa

SEQ ID NO: 78177 - DNA, 751 bp, Triticum aestivum
  Clone ID: PAT_TA_78177
tgagctgattgatgctaagacaaaataaccaaggagacacttgaggtggatgcagcacttatagctactggaagggcacccttcaccaaaggacttggcttggaaaatatcaatgtcgttacacaacgaggttttgttcctgttgatgagcggatgcaagttatggatgcaactggcaatgtggttcctaatttatattgcattggagatgccaatggtaagctcatgcttgctcatgcagccagcgcacaaggaatctcagttgtggagcaaatcagtgggagggacaacatcttaaatcacctaagcatcccagctgcctgtttcactcaccctgagatcagtatggttggcttgacagagccacaggctagggagaaggctgacaaggaaggatttgaaataagtgttgtaaagaccagttttaaggctaacacaaaggctctggcggagaatgaaggagatggacttgctaagatgatttatcgccctgacactggagaaattctcggagttcatattttgggcttgcatgctgctgatctcatccatgaggcatcaaatgccattgcccttggaacccatgtgcaagacatcaagtttgctgttcatgcacacccaacgttgtctgaagttctggatgaactcttcaaggctgccaaggttaacacaggtgttttgcattctataaatgagccagttgcagtgtagagaggaaacatagtcaaaacaatccatctgccgcagcccc

SEQ ID NO: 78178 - DNA, 673 bp, Triticum aestivum
  Clone ID: PAT_TA_78178
gccgcattatatatgctgcacgtggaatcttcaatcgcttcattcctgatgttcatatagacaaggatcatagatctggttctgctggtgggaggtcaccaggttatggtgtaacattagttgctgagaccactacgggatgcctgctctctgtagatgtcactgtgagttgtcctattgttgatgaaataaatgaagaatctgagaagcctgagctgacttctccagaggatcttggtgttcaagctgcatcaatgctactagaataggtggctcaaggaggtgttgttgactctacacatcatggccttctatttatcctgtgtgctttatgcccacctgatgtatcaaaggttccagtgggacagctgactccatatggtatagagacacttcgaaacatcagagattttcttgacgtcaagttcatcatcaagcctgatcccaattcgaacacagttacattaaaatgtgttggtgcgggagtgaagaatcttgctcggaagatttcataagcaacaggaccatattaatctgataaaggattcatgatacatcaagagactactatgagaccctgtttgtaactgcagacagcagtggagtttcccttagctgctcctgctgaaattctgttcgaggtcacgcatattatagactgaaaacctaaatt

SEQ ID NO: 78179 - DNA, 477 bp, Triticum aestivum
  Clone ID: PAT_TA_78179
taatcagcaagaagcccctatcttccgaggagtctggttcagggtctggtaacctcagagaggggcaatccattcaagtgtcagccacaaattctagtgctcttacgtcacggtgctgctcttcttagagcttctcacctggatcatctaaagaacaatttgtcgaaaaggtcctctttcgagacatacttcgtcgaaatatttactctgtgtgaacaataagtgtagattttaaaaatgtcagacttgagacgctgactatatttgacctgcatagtcatgttccgttgagaggtgctgtgggagaaaagttgtattgctctcaagcagagaaggctttgtatcacccccagcaaagctccttgctcttaactagtagcagggtagtctttgtatgatttgcagttataatttttattggggttaactaaggccctgtttagtttcccaaaaaaaaaaaaaaaaaaaaaaaaaaaa

SEQ ID NO: 78180 - DNA, 669 bp, Triticum aestivum
  Clone ID: PAT_TA_78180
cgaggcatttctttttttttcctgtatctcttgtagatttacttctacctgatagcttttggaggtgcttaatacatgattgtttagattcaggattcactgcttcattgtctatttaataaggtgaaaaatatagtcgtgtgagattttaggcaatcttgttatacataatattttctgaaatttaagtcaattggtgactagctgcatcagcaactaacaagaaacaacctgacaatttaagtcaattcgtaacaaaggtaactcagagctgttttttcatgttggttgatagcttttatgactccagacttcgtcatgttctttcttttactaaggcaaattgtcatgtctctgtttagaagactcagtagtgctaggttgacaatctaatctttatgaatcatgatcattttgcaaaacaaaaaggcttggatagcaatatagcaccattgttgcatctatttctgcagtggctattgtttttcttggcatagtatttttaacaaatttgtttatcatcattatatatgactgattttgcaaattatcatatatccgtgtcatgctgaataggcttgatgggagcacttcatcttctgaacagcagaatcttgtggagatgtttaatgaccgtgaaaacacatgagagaaatgcacgttgacatt

SEQ ID NO: 78181 - DNA, 757 bp, Triticum aestivum
  Clone ID: PAT_TA_78181
cttattgtaatacggttttcaatatgaattatacactgcatatcccaaaacgtcctggatgttcaaccttaagtcaggctccaccaagaaacccagaacatcctccagatgcactaaacggaaccatgttttttctggacggaaaaaccatgtttcaacaagcacatactccttgctgggaatgtgaaacatagaaccatcggatatgaaaacccaaaaggaagtcaagactcattctgtggtttgaactctttggctttcagatacttcactactagccttgatagccccaacaaaactggacatcttgttcagggcactcaggtaagctcgcacactggaaacaacaatatccagtgcggcaccactcccactgaatgcccggctgaaggagtgaccagtcaaagcatgtttagagtcgctaacatctccagtgacaaccactctagtagttgcaattgcatcaatgccttctgtgaccgatgtcatgctatattctcgaagaacagttgggatctgtattatatcatcaacagccttgtaagctgcatcaactggacctgttccaactgcacatgcaatcttctcctctccatccggacctatcagtttgacagttgctgtagacagaccaagtgttccacaagttgcctgtacatcagcaagggaccaaaaaaccttgggctgaaatatctcatcagacaacagcgcctcaatgcctcgtgccgaattcggcacgaggcctcagcgagcgcgt

SEQ ID NO: 78182 - DNA, 457 bp, Triticum aestivum
  Clone ID: PAT_TA_78182
ggactacttcttctgctacacttcgccgccgtctgctgggtactcgccgcgcgacgcgtcgccggagtacacgccttcgattcccctcatcagccttccccggcgtgctgcttctccagactacaccccgagctccccttcggtggtgtcagacgccgtttcacgcacgtctccaccgagccaccgccggttccacccgtaccagaggagccggaccagctgctgccagagtcaccttcctcctcccagcatggatactaaacgcattcagtagtttgtaagaagaggacaatcttggttgaggcagatcaatgcctgaattctatgtatgcataattaatcgaatattttgcctttggcgaatgttttgtttagaataagtagaatgcttgtaataggggatattctgtatgaaaagcatcagtgggggagaaaaaaaaaaaaaaaaaaaaaaaaa

SEQ ID NO: 78183 - DNA, 361 bp, Triticum aestivum
  unsure (1)..(361): unsure at all n locations
  Clone ID: PAT_TA_78183
ctccgggactaggtatgtagtgtaatcaagagctgataatttgatcgatcctgctttcagtctatcatatcagagtttcagtctatcgtatcgtattcatatcagaggaccctgtttcgtttgatcgaccgaccaccctcttcctgtttgtcacggtcagtttcagttgtaacgtttgtgtgtgtgtgtgtgtgtgtgtgtgtgtgtgtgtgtgtgtgtgatcggcagtctcagatgtttgtagcttgttgaacccaaatgggtatttatttctgtatatgcacgtggcagactacaaggtgcaattttctcccttgtaagtaataatanacaacgtgaaaccaaaaaaaaaaaaaaaaaa

SEQ ID NO: 78184 - DNA, 734 bp, Triticum aestivum
  Clone ID: PAT_TA_78184
gatgtcgcctactgcatccatgcgcttgcccagcgactcaccaaaactaggaactagattggtgtgctcactgcggaagtctgtaaataagcagtctgatcctaatagctttcaggaagaggcgaattccaataacgagcaagagtggcaatccgattctcaggttgctggaaaattggcactatcttgtgatagctgtgataatcgtctaccatccaaggtttcaaaaaaaggaagcaaggggtgcagctggtgctcggtagactataggcactacaaaaagttattgcagttgaaataatactatggcatatgcaaggaaatttagcaccacacaaatggtggaaactaggatactatatcaatgtaaggcttgcaaggaaaggatgatgagtttgaatgagtgggagaagcatactgacttaaggacaaggaattggaagataagtattaaacaaaagagcatgggggagccactcattaatttgataagccctttgatcttcgtgaagctttttttcaatcaaacaccaagaccatatgacacatgataacttaaacttacctgtagctggatgatattccttgtgggacatcaaagtcttctaaccaaggcattaagaaagaaaaacggctacaattgcaaggtgccaaatagcttttcaccaggaatgctatggtgcacgagctgtacaagatcttacaacatggctttgtcgagcatgtgaattccg

SEQ ID NO: 78185 - DNA, 580 bp, Triticum aestivum
  Clone ID: PAT_TA_78185
cgagggagaaaggttgatccgcagcagcgcaccatgcaaaggcatgatgtttggccaccaattcaaaccgaagaaaaagacgcggaaaggactgcaccccccggctggctgcatcatcgcaggataacgacctcctgatgcatgtcctaacgcaggatcaatctcgatcggcagcttctaaagcatgattagcccaaccaaaaaaaaacgcatggtcattggtcagcacgaaactcgctgcagaagacaatgcccaaatctgccaaatcagcactgcttttctccaatgacggcacgtcagtcaggcttctactacgaatgacagtttcagtagatggcttgcggttggcttgttgttgcaatccatgctgacttttgcccctcggcataagaagggccactgagctttcggacgctcttcctcttcctattcctcctggagaaaaagtcgcgcttaaatgcgcgttaacgtttcgaagaaacaatcgttcaggataattcattaattcttgtatgtaactgcgtaggcacggtgaaaaattccctgggattgagtttaaaaaaaaaaaaaaaaaaaaaa

SEQ ID NO: 78186 - DNA, 712 bp, Triticum aestivum
  Clone ID: PAT_TA_78186
cgttatcgatgcaggcatcaaatgcagtggctgttccatatcaagtcccagctcaagtttctggacctcctaccataactaatgcaccaaattttcacccggtatgcactgtgcagttgaggccacccacaaacggtggactaactgtccagacaatgggtaatgcctctcaggttgcttttggttacccagcagtccagctaccaacacttgaaacaagctcttcatgggcatttggtgctccacctcaggctgtgtcttcttttactgcaaaagaacaaacaggaaccaaacaagctgacgatggcaagaagcctcaggaggcaggtgcttcctcgtctgctcatgctgaagatgagaaaaaggctgatagaggactctctcttatgggttctgccataaggccaggcatcgctccaaatgtcaaattcggagggtctggatcatatccggatcttccctgggtttctaccaacggtgctggaccaaatggcagaaccatatcaggtgtgacatacaagtttggtagaaacgaggtaaagatagtatgtgcctgccatggcactcacatgtctccggaggagttcatgcggcatgcaagtgcagatgctcctgcccaagaaaatagtgcaactctaccggcattccctgtcggtaaccaagcaacgtctgcagaaaattaatttagcggttcacagagaatgcttgacta

SEQ ID NO: 78187 - DNA, 663 bp, Triticum aestivum
  Clone ID: PAT_TA_78187
agttaagcctgtaactgctggagtggcagcaactggggaagaagactaaaattcctgtctcacattccgcagcaggaaccccacgtggcattgttgacacagtcaatgccaatgccccaaataaaacactagtaaggagggcagccacccctgtacctgcttgttgccaagcgtcacccctgaagcatgccatgaacacaaaaggtaaccaaatgacaaccagcaatgccacggttttcagttgtggagtaccagccagcagccagactagcaaggttgcagaaggtgctagcaaagcaaatccaccatccagcagcagccaggctaagccgaatggtgtggcggtgaacggtgctaacaaggtggtgaatccaccgtccatcaaccaagctagcgctgcggtgaacaacactaacagggctgcgataccactgtccagcagccaggctagtccgactattgacggtgccaacagagtggctaatccaccacccagcaaccaggctagcacagctgtgaatggtgctgctaacaaggggaatccgccagcagcagccaggcaatagataggccctaaatacagtaaattttgtaataatccctttaggacttttgtgcatcggttgtcccttgaaatgtgaatagggcattaggcagaaaaaa

SEQ ID NO: 78188 - DNA, 744 bp, Triticum aestivum
  Clone ID: PAT_TA_78188
gcacgaggcacctaattcccaactctgcatgcgagaggagtctggtgtctgagcctctccgccaaaggaaaaaaaactgaggatgccttccaggccatgaatcggctgtacccttaagccagtgcccgcggcggctctctacgcacctcgactgcacatgtccacatccactcctgtagcgccgacctcatgctcggtccgttgctcttcctgctcaacaacaaggtactgtttgtgtctagaccattcttctttccctcttcattgaattttttttttgaaaaattcttcccctaggaaaatctcttttttccatgctgttcttggcgctcgagcccggcggagcgggcaacgcacggcgctaaggctgagtagcgtggttcggcattggatatagccggccgatgcagccagcgacaagtgcagtgcagtgtccggcggctttagtttatttctcttttgctgctctttttccttactcagatccagcgaaatggggcaagggtccctgaagtcttgtatgcgtttggtttcttcctcacacgtgctcctttgtttcttcctcagatccagtgaagtgagatacgctgcttggtttcttcctcagatccgacaaagtgggggggggccagggtcacccacatccgccaaggcgtcgctccaccaacgttttgttttagaatagagcaagaagaatccatgaatttattggtttgaaaaaaaaaaacaaaaaaaaaaaaaaaa

SEQ ID NO: 78189 - DNA, 245 bp, Triticum aestivum
  Clone ID: PAT_TA_78189
atggatcagaacagagtatcatcgttcttcatcaagcacaaagttgccgtggtagcagactagcaggtagcaactttagttgtgctacggccaagtgatgtgaaactctgggtgtatactaatactgccacgcacgtacctgcacataccgtgtggtggatgtaaataattgggttgttattagactttggtttaattaatacagataaggatggattataggtttaaaaaaaaaaaaaaaaaaa

SEQ ID NO: 78190 - DNA, 742 bp, Triticum aestivum
  Clone ID: PAT_TA_78190
ggcatcatccagacgctgttctgtgctgctcttttaaggagaaacctatgtttacatttgcaaacaaggcagggcttgacatgttagaaacatctcttattgcgctgcaagacctgacactagacaagattttcgacgagtcaggaaggaaagcaatattctcagatatctcaaaactaatggaacagggctacgcatacctgccatcaggtgtgtgcatgtcaggaatgggtcgccatgtttctttcgaccaagctgtggcgtggaaggtgctcggtgaggacagcaacgtgcactgcctggcattctgcttcgtcaactggtccttcgtgtgaccccgacctgtcggatgggatggcgagctggtggtcggtctgtgtgatgagcaggcccatttttgtatgatgatcctgataaggaaaatcatcagctgtggcaaaatgcttatgttgcaatcactagttgtaggtcttgattccagtgtatttatgaagaaactggagattatgcaaagtcttgtcccacttccgtttgactacccggccaaatgctgtttgtcaatctcgattggcaaggcaaccgaggtgatgctgggttgctggcagttttggttcgtcattccattcagatgttaattgctgatgttatggtgtggctttggaaggtctggatcaagccagatagcaacaaaaacatgctgttcccaaatagtgcaatggcaaacaatggagcaatagcgatg

SEQ ID NO: 78191 - DNA, 408 bp, Triticum aestivum
  Clone ID: PAT_TA_78191
accctgcgtgctgtcaagtcaaagattgcaaaccttgtggcaagcaacatgagcagggattggccacaggatttgtaccagaaggtggctcagtgcatatgaatagttggtgtttgggctgaagtgctagggaaatgggctgtctctatcggaagctccccgacaccatttgaacagatagttgaaggtttaaagttccacaaatgtttttttggttgcagaaccatgtcgtctgtcttgtttgtaggccctgtctggttggtgggtgtcaaaattcgagaaaattgccacttttcaatttgttactaaatccaaggctgctgcagcagcctcttgaatcttaattttcaagaattcatctactagtcgaaaaagaacaactgaaaagacaatgcaaaaaacagagct

SEQ ID NO: 78192 - DNA, 700 bp, Triticum aestivum
  unsure (1)..(700): unsure at all n locations
  Clone ID: PAT_TA_78192
cctccgtggaaagggcaagcgcaagcgccccgaatagccggcgccggaggcggaggcggaggaggcggagctcaacttgatcttgctccgcaagatggggatggggtgcacaaatatgctgtcgcagtcgcagctctcgaagataaagatgttggcgtcgcggcccgatatctgcaagaggaacagccacctgaagctctgttacaacctccgcaatcgcaatgtcttcgtccccaacaccaacaagccacagctaggccccctccacaccaacaagccacagctaggctccctccagtacaagaaagggaaggaacatgtgtatgatgtgtcagggcagaccccaacatgcgcaaaggttgctctcgaacactataacagatcatatgaggatgagtatgagatggttaaagcactggacagcgtttcttccttcttcaatggtgtgtgggtgcatgtaaatttccttgctaaactcaaaggggccacccaatgtcctgaccttgttcccaagttcttctttgctgaggaagtccagaggcaacaccaattcgtggttgtgggatttgcctgaataatgcgatctattatcctgctgctggagggcaccgaggcgacaggnaagagtgtgtgccaaatgcacacactatggagaagtttgtgatgcatacactatggagaagttcgtttcatgcatttg

SEQ ID NO: 78193 - DNA, 659 bp, Triticum aestivum
  Clone ID: PAT_TA_78193
tctcctccacaccccctctctcccttctagatccactcctccccgtgctcacggctcatctgcgagcagattgagcggggagccgggaggggcaggccgaggagcggcgagggggagctagattgagccatggcctcctccacttgcgctcttgccctggttcttgcgctgtcggtcggtgcaagcgtggcgcgtggctccgagccctggtggaacgagacgcaggtgtacaccaccaccgccaactccggtggcagcaacggcgtcttcgtcggcctcaccctcatccagtcggcggcggccaagggagcggtgtgcttggatggaagcttaccaggttaccacctgcacagagggtttggatcaggagcgaacagttggcttgtcaatctcgagggtggaggctggtgcaatgatgtcagcagctgtgtgttccgcaagggtagtcgtcgtggatcatcaaatcacatggagcggcaactccagtttacagggataatgagtaacagacctgatgagaatcctgatttctacaactggaatagagtgaaggtccggtactgtgacggtggatccttcactggtgatggctctgatgcggctgcaggcctttatttccgaggtcagcgtatttggcaggccgctatggatgacctaat

SEQ ID NO: 78194 - DNA, 666 bp, Triticum aestivum
  Clone ID: PAT_TA_78194
ggcacgaggccgaagttctacttcttgccagtggtaaggacaatcttctacctagtggagaagaagcggatcgactcttcaaggcactgaaaaactgcagagttcgatacttcaaggacaatggtcatacactactcttggaggatggtgtcaatctgttatctgtcataaaaggagcaaacatgtatcgccgtggaaggcaaagggattttgtaaccgattatctcccccctactttaagtgaattcaagcaaacatttgatgtggatcacaaactgtttcaccttgcactgagcccagtcatgatgtctaccctgaagaatggaaaagttgttcgcgggctttctggtgttcctgataaaggtcctgtcttgtttgtgggctatcatgcgctgatgggtattgagttgagtcctctgtatgaagagttccttagggagaagaagacagttgttcgtggcatggctcatccatttctgtttggaaacaaatttgactcatcgcgccaggagatatctcggatcgatactgtttctatgtatggtggattaccggtcaccccaatcaatatgtacaggttattcaagaggaatgactttgttctgctttatcctggcggagttcgggaagctctgcataggaagggtgaagaatacaagttgtttt

SEQ ID NO: 78195 - DNA, 707 bp, Triticum aestivum
  Clone ID: PAT_TA_78195
agcaaattcacttcctatatccaagtggggttgatcgcttccagcgacagtttgctcatcttgaggagaactacagaagaggagtagcgagtaccccgccgcgaataaaacccacatctttgccaagagagagagtctgttcatcaaaagatagtcataatcaggactctgacaacgaagagcagagagcaggatcctatgttgcccgaacaataataagccccccaagatcacaagaggagggccgcaagcttcagtccagctaccagtgcgccacaagcactgctgattcctgcgccaagagctatctgaagagcgccgctaatatcagtgcttccaggcatggcatcaaagggaaaactggccgaaaggagaaggaatctccgaggctgtgaacgaggcggcgctgcctcatgaactgttagacaaggtaagctagggcctagggcgctctcctatgacagaactcaggagcaatataatggcaccaatgcaactgcaacttttgtaatgtcggtacaagtacaactatgtaggtcatccttggtcgcccaagcaccctgcttggagaaattagactggtgtactgttaagttttgagatccaactgctaagattctggcagatctgttaaccgcactctccttggtttcccaaaatttcctgatcggtaagaactataataaatctctgctgtggtgctaaaa

SEQ ID NO: 78196 - DNA, 557 bp, Triticum aestivum
  Clone ID: PAT_TA_78196
tgaattgctcaaggagccactgcctgatttcgtgctcggctctgatgtcatatacaatgaggaagcagtgggcgatctccaggccactctcaaccagctctcaggaaaacacaccacgatacttctagctggagagcttcgcaacgatgctgtgctggagtgcttcttggaggcagcaatggaggacttcctaattgcttgcattgagcaggaccaatggcaccctgaatttcgcagcaaccgtgtagccttgtttatcttgatcaagaaaccagagaaacctagcacagactagctagtcctctgctcctatccttggtgtagaacaaggataggaggcatctgtgtttatcctttccaattccaatgatgttgttgtgatagccaaggttttagcattggcttaagccatggaagttcgatagctcattgcatggtttgcttgtaacctagtctgaaagtttgtacaagagtgaaaagaaaggattgataaccgagatctgaaactgcaaatgccctttttgatgaaaaaaaaaaaaaaaaaaaaaaaaaaaaaa

SEQ ID NO: 78197 - DNA, 574 bp, Triticum aestivum
  Clone ID: PAT_TA_78197
acaattagtgagccaagaaagaaagaaattagaaacgccatggctcgtgccaagaactcctcttctggcaatggcgaggtggatgtccagaaggtggagaagatcgccccggtctacaacctcgtcaccaagccctccgtctacggcgccaaccggagggcgacgacggtgaaggcgaggccggcgaccactgccgtcgccgccggcttcgccgggagcagcaacagtaggcagccggcgccggcgccggcgagctggccgcatggatcagtggtcaccaaggagttcatcagcaagtacatcgaggacaagaagaggcagtttaatcaaggagacgaatgagcagtaaactcagattaatattatcagttgatcgatcagtgcaatattatcatgtaatatttagtataaatacagctacatatctacataagaagatgctctacttattagttattatgtgttaattagaaatgcatatatgtaagtattccatgagagtagaactcatgaatatgtatatctagcttccagatggagttgtttataaagtaaaaaaaaaaaaaaaaaaaaa

SEQ ID NO: 78198 - DNA, 622 bp, Triticum aestivum
  unsure (1)..(622): unsure at all n locations
  Clone ID: PAT_TA_78198
gaggcgacaccgtgctgcgcggcggaggcatccaaccgctgccggaccaggtcgacgccgccgccgccggtggccgcgacgtgttcgcctccacggcgaggcgcgccatgggcgggtgctccacgttctcgacggcgaagcggtcgacgacgacgacgacgaccaagaaccccggtactccgcatgacgccgccgccgcggcgccccagccggaaccgtcgtgcgacctcggcctgtggctcagccccggctccccgccggcgcccggggaccggcgatccggcggcaggcgggccgacacgccgtcgatgaactccgagggatccgtcacgacgtgcggcgtcgtcggcggcggcgagagggagcccgagctgctgaatctttttgtctaggctagctagctaattaacctgctcaattctcatatgctttctttgctgcatcccggcgaactctttggtagcctctcgccggcgaggtatcccttagccattttttggccgtgtaaaagtcgacggtgcgcgtgcactgcttctacttgactctttacagnaccttatgttttttttctccccctactttgttagcatcaaaacgtcgaataaaagcgaacagattaaaa

SEQ ID NO: 78199 - DNA, 531 bp, Triticum aestivum
  Clone ID: PAT_TA_78199
gctaatgcaatttctgaaagtcgcatgttcttgcacaatttccactccaaaggagagaccgacaatgtttgaggtctatcagctcctcagagccattggagaaaagtaccatttctcggcggaggatgacttgatgatgctgccacctctaagcacagatggagaaacccttgacgagctcattgttgcccagtaactgcaaacccaatgttccacagaaggcaaccaagtggaggttgtttcttctgcgcgtcattaccatgcttagatgagtgaggtggctttacatgatgtactattaagtagtatcagtatactgcatccgctgtataatttttgtagcttgttgttatctaccattgggaggtgctagcagcagcaatgataatctttcactcaaccgatatggggatggggtattaactactcctaatagtagtttgctcctcatgtgatgggaatatgccatattggcatttattcagtcatttttcatgttgtcatttgtaaaaaaaaaaaaaaaaaaaaaaa

SEQ ID NO: 78200 - DNA, 593 bp, Triticum aestivum
  Clone ID: PAT_TA_78200
cgaggctgcattcttggttttaaacgacaaatttacttgcgaacagcttttggtctgtgcacaaccagaagaacacatcaacatgcaaatcttcgtgaaaacccttacagggaagaccatcacccttgaggtcgagtcttctgacactatcgaaaatgtcaaagccaaaatccaagataaagaaggtatccctcccgatcaacaacgtttgatcttcgctggcaaacaacttgaagatggacgtacattgtcagattataacatccaaaaagaatctacattgcatttggtattacgtctccgtggtggtgttattgagcccactcttcgtttgttggcccagaaatacaactgtgacaaaatgatatgccgtaaatgttatgctcgtctccacccaagagcaactaactgccgcaagaagaagtgtggacacacaaacaacttgcgcccaaagaagaagttgaagtaaacatattttggtcatactccgaggaaaattaacaactttttcttggttttacattttatcattcaattgttaaataacaaatttataaaacaaataaaccataaataaaaaaaaaaaaaaaaaa

SEQ ID NO: 78201 - DNA, 674 bp, Triticum aestivum
  Clone ID: PAT_TA_78201
ggcacgagggtaggcagtcggtgccatgggaggggggaagtaggagggttttttttcttcttctttcttctctctcgttttctcgcagaatcatctgtgtgcagattccatgcttttcgttagggttagcctattgtgctgagcttgttttttcttccatggcttcttgttcttattcgtttggttatgttgagctgttcttgtcgttgctggaaagtgttgtggacgttgagctcctttcggtccaaaaaggggtgttgctgtgggtcgattgagctgctgggtcatggatcccgttagcctactccatgttcatcattcagctcgagatctgaaagaaactactccaatttatactaatagtatgtgtgtagataggaaaatgatggagtactcgttgttgggataggcttatggcttgcatgccccaggagctgcatcaaccctacatggaccctctttggattgaagggagctctgcatctttggtcaccctcgagcagctttactgttctggatttccatcgttctcctcttgagtcttcttgacttagcgctttttttttctttttttaaaagaaaaaataactttttttttcaggattgtgctccatgcgtatgagcatggtggtgatgatgtatgttgccagatagcagtagtattaatattgttg

SEQ ID NO: 78202 - DNA, 470 bp, Triticum aestivum
  Clone ID: PAT_TA_78202
ggcacgaggcgcattgctggtgctgacgaacgggcggttccggagcgtgcggcaccgggtgatggtgagcagcgggcggccgcgggtgtcggtcatcttcttcggcgggccgccgccgcgggagcgcctggcgccgctgccggggctggtggacagggagggcggccgccgacggtacagggagttcacgtggagggagtacaagacctcggcgtaccggaccaagctcgccgacaacaggctctgctacttcgagacgacgaccgccgccgccgccgcgaacagctagccgcgctgagttttgaatgtgtcgtcggctaccttttgatgtgtgtgtagtgtagaacgaaatgtttgcgtgtcgtatagttttctgtcaatgcaaattaaaggcggctggtaaggtattggtcagttcgtcgcttttaaaaaaaaaaaaaaaaaaaaaaaaaaaaaaaaaaaaaaaaaaa

SEQ ID NO: 78203 - DNA, 497 bp, Triticum aestivum
  Clone ID: PAT_TA_78203
gagggcaagacctcaatttggctggatggaacgcagcgagctacctcagactaatcaacctccaaagtacaaattgtaccagtatgtcttgtgggttgctgcactcctcttgctggtagttggatttgtgattatcttggtcatgctcttcaagggtaagaacgggaacgatagctgccactggtgccattacctgaactgcgtaccaacatccagatggaagtgcgatacatagcttgctatattctgcaaagtatatgcttcttgagggagcagattttttttattttttatttttattttttttatgttggtgtgtttgtggaaatgtacgacgaaatgtgtcctcctccacctgaccatcctgcacttgtgccctaattctccctggttctttgaagtacaaatgtttcagaattgtagctcgagcttgtaactgttgatttcagcgcaattgctatatttgattctctcacaaaaaaaaaaaaaaaaaaaaa

SEQ ID NO: 78204 - DNA, 322 bp, Triticum aestivum
  Clone ID: PAT_TA_78204
tcgaggtggaaggcctcaccgccgagctctaggcgatccaccgccgcgcaccggccggccggccggggtacatgcatatatacatgtcagggtgtgcgcatgcataacaatagcctaccaaggaaggcatgagcgcaactatgctagtactgtagatagaacgtcgtcatcaagtacgtacaccataaatgcgtcctgctcgtctcgtcgatatggcggtatatatacgtgtgttgtgttttcttactatggccttgtttagttccaaaatttttacaaaatataaatagtaccactttcgtttaaaaaaaaaaaaaaaaaa

SEQ ID NO: 78205 - DNA, 750 bp, Triticum aestivum
  Clone ID: PAT_TA_78205
ggccgacagcctcaccaagaggaagccgtgctccgcgcccaagtggaaggagatgacggggagcggcatattcgctgccgggagcaatggcgacgctggggaggcagctgccgccgccgcgaagcccgcccgaaccgcctcgcgccaggcgatcagtactgtaagccacatctcgtttgctgaggatggaactgatcctcccaaaaagcccacttcagtagctgaggtggcaaagcagcgtgagcttagtggtactcttcaaagcgaggcagatagtaagatgaagaagcagatatcaaatgcaaaatccaaggagctcagcggccacgacatctttgctgatactccggattccaggtctaacagggcaaggaactcatcaaatggcagcacagcatcacacacacctgtgaaaaatacaaacgcaagcaccttctcgtttggagaggccaacactgacagcgcgccaaagacagcaaagaagataactggcaagaaggtcaacgacctcaccggcaatgacatcttcaagggagatgcgccaccagcttctgcagagaagcatctgagcaccgcaaagctgaaggagattactggaagcaacatttttgcagatggtgggaaggagccaatccgtgagcgtgtaggtggaaaccgcaaacctcctggcggcgagagcagcattgcgctgatttagcatatcctgggaatggtgatggaccctgtcttagtccgggactccgtgtcgac

SEQ ID NO: 78206 - DNA, 309 bp, Triticum aestivum
  Clone ID: PAT_TA_78206
gcttggtgtttgcctactacaaggacggagccaccgacccaaccttcctttacttctctcatgggctgaaggaggtcaagtgctgagcggttccttctgctcgacactgatgttttatctatgcagtccgcggtatttttggtctagtctatggttgtcagttgactcgttatggtccaatgttggtgtcggaaacaactatcgtttgcttgttatggatgttgagatgagtccttttaaaaaaacctccggattattggattcatgagctccttaaatgtttggaacgatattaaaaaaaaaaaaaaa

SEQ ID NO: 78207 - DNA, 667 bp, Triticum aestivum
  Clone ID: PAT_TA_78207
ttgatgtaggattttgtattggttcttgggtcaagaaaggagattcctaatcctgccggcttcggcgcgctctgcgatacctccggatcaatagaggcatcaatgaaacactgagccacatcgggaggttcaggaaacctgcaaggaggattgatgcagtgaatgagcacctaagcaaaggagtggatgtgtgtccgaaccgccaaatgtacctgcaaaacagaccaactacgcttgtggaagcgaagatcatttctggctttccaaataaaccacagatatgtggtgatttgcactaaaatatccaccggaatttggggtgtaattatctacgccaagcagtgttgaaccccatcctgttcctgtggcaaagcagaagagagcaaaggagttttggcagagaaccaaactgctctggcaaactcatagtggaagaaaaggtgaacatcattttcaggaaatccacaaagagcacaatctttttcaatatcagtgagggcatttgcatgctcaccagtagcaatggctctcctaataagtctccaaataaaagttttaatcacaggagagatatttttgcatttccacaccctcttaagaatgttcatgttctcctgggtaatgcttctgggaccttgatggagaagttgtaccctggacaaattgt

SEQ ID NO: 78208 - DNA, 690 bp, Triticum aestivum
  Clone ID: PAT_TA_78208
gaggcccttttttctgtcagaattcatgaacacacaccaaagcctccactgccttcccttcccttgtggcctaaactactctccagcttcgtccagagtccagcagacacggccaacagttaaaccagttgctattagtacgcgccaccacgctcgcacgcacacgcacacgcacagctagctcgcacccctacacactcaacagcaacagctaagcttctccaaccagacagcaacatggctgaggaggcggccaagaaggtggaggtggaggtcaccaaggacaaggagcccgaggcggcgcccgcggaggccgtgccggaggcggcggccaaggaggacgtcgccgaggagaaggccgtcatccccgcgaccgagccgccggccgccgaggagaagccgccggccgacgattccaaggccctcgccatcgtcgagaaagttgcagatgaacctgctccagagaagcctgctgctgagaagcaagggggttccaatgacagagatcttgctcttgcaagggtggaaacagagaagaggaactctttgatcaaagcatgggaagagaatgagaagacaaaagctgagaacaaggctgctaagaaagtatccgctattctttcatgggagaacacaaagaaagcaaacatagaagctcaactgaagaagattgaggaacaactggaaaag

SEQ ID NO: 78209 - DNA, 771 bp, Triticum aestivum
  Clone ID: PAT_TA_78209
gacgagggaaagatatgcgtatctgtcaatatcgctgatgcattggactatttgcaccacgactgtggaaggcctactgttcatcgtgatttgaagcctagcaacatccttctggacgacgatatgaatgctcttataggagattttggcattgcacgtctttgtattgaatctgggcagaagaccggtttagttagttccatcggtggtactataggatacatcgctccagagtatgcgggaggaggccatgcatcaacatccggcgatgtttatagttttggggtaatactgctggagatgttgacaggaaaaagaccaacagaccctatgttcggagacggactcgacattgtcaaatttgtggagacgagtcttccacatcaaatacttaatgtcattgacgcgtgtcttattgatgaaagcgaggaatttgcaagagcaaaaccggaatcagaaaatatgatccaccaatgcttggtctccctgctacaattaggactcttctgtacgcacccagtaccaagtgagcgaatgaatatgaaacaaatagctaccaaattgcatgatatcaaggcatcatataggattgaaagcaagtaatcttcactcgagtggcttacacattcatatatactatgtaatatgttaatattggtaatacatgtatgatttaatgatattattatatagtctcatgatgtaactattatatatatctatcaggctatgaatatttttatcaatctatcgatcaaaaaaaaaaaaaaa

SEQ ID NO: 78210 - DNA, 361 bp, Triticum aestivum
  Clone ID: PAT_TA_78210
tccgcgaccaagagacgtaaaggctactagtagtactagtacgtactgtatgtccgtgcaccgtttccgccattgctggatctgatgaagttgaagacccgcccgagatctgttggtcggcgcacctgtgttgccctgccatcgagggaagggcaaggaggtggtcgacgccagccagatcagatccgtggagccatgggtgggtgtagaaacttgggaaaaagagagattcctgctgctttgttgctgctggtggtggtgagtcgagtgtgaaaattggatgagagatgagtgtggtgtttttgtcccgaggtgaaggacacagactgttttcttgttaaaaaaaaaaaaaaaaaaaaaa

SEQ ID NO: 78211 - DNA, 754 bp, Triticum aestivum
  Clone ID: PAT_TA_78211
ggcgcctcttttcgccgccgtccgccgcgcgcacgccgccgccgccatggggaggagacctgcgaggtgctatcgccagatcaagaacaagccgtaccccaagtcaaggtactgccgtggtgtccctgaccccaagatcaggatctacgatgtcgggatgaagaagaagggtgtggatgagttctcccactgtgtgcatctcgtctcttgggagaaggagaatgtcaccagtgaggctcttgaggctgcgcgtatcgcgtgcaacaagtacatgaccaagtctgcaggaaaggatgccttccacctcagggttcgggttcacccgttccatgtgctccgtatcaacaagatgctttcgtgtgccggggcagataggctccagactggaatgaggggtgcttttgggaagccacagggaacctgtgctagggtggatattggccaggtcctcctttctgtgcggtgcaagcccaacaatgctgtccatgccagcgaagccctccgtcgtgccaagttcaagttccctggtcgccaaaagatcattgagagtagaaagtggggtttcaccaagttcagccgcgatgaatacgtcaggcttaagagcgagggtagaatcatgcctgatggtgtcaatgctaagctacttggttgccatggtcgcctctctgctcgtgcccccgggaaggccttcctctcagccgcttagatatatctatccttatcatctgtgggaaacgaatatcggacctttttg

SEQ ID NO: 78212 - DNA, 509 bp, Triticum aestivum
  Clone ID: PAT_TA_78212
ccttgccagggcagctctgcctaagcctcccacagtcgtctcaggaaggaagcagcagcggtgtagtaccgcgcagcagaaaggaacagcggaacggttagccagctgacaacacttggaacagtgtctggtggcagcgattgccctgtaaataccaagaatcccctccctctactgattcagaagtcagaactaatgttgtagttgctctgcgttgaatcaccactctgtagcgcttgttctagaaacttgagaacatgtgtggctggctatacttgtgatgcaggctgatcgatcttgtaaggtggaactaaccggccttttgctatatgtacatttttcatgaggttgtaagttgtgagatggacagccagaacaccttagcattacattacagatagtgtgctccttagttggaatagaaaagcaatttgatggctatcatgccttgatctgttatcttcctgctaccctgcacatgtaatcttcgagtaaaatcatgccatgtt

SEQ ID NO: 78213 - DNA, 672 bp, Triticum aestivum
  Clone ID: PAT_TA_78213
tggggtcgagctcacagacgatcgcatcaaaggcaccgtcgaggacatgataggcggcggaactgaaacaaccatccagacgctggaatggaccatggcagagctcatcgccaacccacgggtcacggccaaactcaagaacgagatcacgcgagtcgtcaccgctgatcagccgaccatctcggagtcggatctgaacagaatggaatacctgaaagcagttttcaaagaggtgctccggctccacgcgccgttgccgctcctcgtgccgcacgaatcgacggcacccgcggtcgtgcagggctacgagatccccgccaagaccgggctctacatcaacgtgtgggcgatcgggagggacccggcggcgtgggacgcgccggaggagttccgaccggagcggttcgtgggcagcagctccccggtggactttagagggaacgactaccagttcatcccgttcggtgccggtaggaggatctgccccggtatcaacttcgcgcttccggtcttagagctcgcagtcgccagcctcatgcgccattttgactgggagctccccgctggcatgcaattgacggacctcgacatgagcgagacgccggggctgatgacgccgcggcgggttccccttgtcgtggtccccaggacggtgcctcagccagcactgcc

SEQ ID NO: 78214 - DNA, 440 bp, Triticum aestivum
  unsure (1)..(440): unsure at all n locations
  Clone ID: PAT_TA_78214
ggcacgaggggtgattgttactttgtgggtccttttgattggaacagcaatctatctgcaaacatgaacaactcctgcaactctgaaacatgccactcgcatctttgccaggcactgatccatggttcaaacccagagatgttgctaatatggccgtgcctcagactcctctaagacatgataggccctggtggattgcatttgttattttaggcgtgctatccaagaatgcatcgtatactcttccggactggcatgggccatttgtcatttgaagattttcttttgctgcaatgtaaatactaactattgtaactagcaatgcaagcagatgtcatctagttcaattgattagcagttcacctgtgtgctcgtatacacgataatattgcatctggagttgattttttattanaaaaaaaaaaaaaaaaaaaaaaaaa

SEQ ID NO: 78215 - DNA, 293 bp, Triticum aestivum
  Clone ID: PAT_TA_78215
gctgtgctagtttccttgcttgttaaatgttgttgatgttgggtaacgaatctagtagttgtttgtgacagtgcataccgttgtagatccagtgttctgtacatgttactcctttgatgctgaggaagtaaggagtgctctagacctcttagagtttaggaccatcgaccatgcaatgcagccggtgtgtaacttcattgccttttggcggggttttcattctgtcccttgtatgggtttcacaatatcatgtctgttttctggtaaaaaaaaaaaaaaaaaaaaaaaaaaaa

SEQ ID NO: 78216 - DNA, 361 bp, Triticum aestivum
  Clone ID: PAT_TA_78216
gcacccgcagaagctaatggcgactgtgccagttaacccaaaacctttcttgaacaatctgactgggaagactgtaattgtcaaacttaagtggggtatggagtacaaagggtatcttacttctgttgactcatacatgaaccttcagcttgctaacacagaggagtacattgatggacaattctctggaaacctgggtgagattctgatcagatgcaacaatgtcctttatctccgaggtgttccagaagatacagagatagaggatgcagagtgaggagccgggagtgggggaccatgccttaagattggttctgataaccatgtattagctgtcatcttaagattggttgatgatatt

SEQ ID NO: 78217 - DNA, 585 bp, Triticum aestivum
  Clone ID: PAT_TA_78217
tgtttcacttctttctcatcggaagaaatcattgaatctttgaaaagaatatttgatcagaatgttcgactaattgtcagatctactgctaatgtggaggatttggctggaatgtctgctgctggactctatgaatcaattcctaatgtcagtctctctgaccctagttccttttgcgctgcgggtggacaagtttgggcatcattatacacaacgagagcaatccttatccgtcaagcggctggtgtacctcagagagatgcaaagatggcggttcttgtgcaagaaatgctgcagccagacctctcctttgtgcttcatacagttagcccagttgaccatgatcccaagttagtagaggctgaggttgcccctggtcttggagaaaccctcgcttctggaacccgtggcactccatggagactctcatgtcacaagtttgatggcaaagtcacaactctagcttttgcgaatttcagtgaggagatggtggtgctcaactctggccctactgatggtgaagtgactcataggaccgtacactacagcaagaagccgttatctgttgatgcaacctttaggggg

SEQ ID NO: 78218 - DNA, 262 bp, Triticum aestivum
  Clone ID: PAT_TA_78218
ggcgggcggcggctactcctgaattggccggcctctacggcgcggcggctggcgcgcaccagagtcatattgttgaggtgaaattatcgtgtgtgcgctcgggataaattaaataaataaagaagaaagtttatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtatgtat

SEQ ID NO: 78219 - DNA, 441 bp, Triticum aestivum
  Clone ID: PAT_TA_78219
tgctttctttagatccctttctcttctgtccttgcaaattggagatacttgaacggcgatctccatatagtgagcaagatgtataatcctcccagtgcgcaggacatgtcctactacggtcatgttcagaagcgccatgaggagaagggctgcctatatgcatggatgcaggaaaaaaaagggggacaacgaaaaaaatttgattcacgagcctagaggtgtaaagaagcaggacaccatttatgcctttgttatttgttactcactctgtccataaaagaatgtgaattcttgcttctcgagaagtcaaaaaatctaaactttgactaaagttatattaaaaatagtagcactccttacacaataagtattataagattaattgtagaatatatttttataataaacttggccaaatttcataaaaaaaaaaaaaaaaaa

SEQ ID NO: 78220 - DNA, 599 bp, Triticum aestivum
  Clone ID: PAT_TA_78220
ttgctgccttcatgtcaaaggacaaagctgccgagcgcacccttggtgatatcatcctccagaagatcatggagaaggacgccgaggttgcaactgaaggacgacctcgtgtaaaattggacaacagcattattgagctttataaagaggttgggaagttcttaagccggtacacgagtgggaaaattccgaaagccttcaagcgcataccatcgctggagtgctgggcagatgttgtgcagctaacggagccagagaattggtctcctaatgccgtgtatcaagcaactcgcctcttctcttcgaacatgaacacaaagaacgctgagcggttctatgaagccattttgctacctcgtgttcgtaatgacataaggaagaacaagaggctgcattttgcactctaccagtcgctgaaaaaggccctttataagcctgcggcatttaacaagggaattttgctgccactctgtcgggaaaggaattgcaccctccgtgaagcagtgattattgggagtattatccagaaagtctccattccatttctccatgcaagtgtagctctagtaaaactagcagagatggagtactgtggcact

SEQ ID NO: 78221 - DNA, 667 bp, Triticum aestivum
  Clone ID: PAT_TA_78221
ggcttccatcaatgagaggcctatcatcttttcactgtcaaacccaacctcacattctgaatgtactgctgaacaagcatatacctggactcagggtcgtgcagtatttgccagtggcagtccatttgcccccgtggagtatgatgggaagacttttgtacctgggcagtcgaacaatgcctacatcttccctggactcggcctcggtcttgttatttctggagccgtccgtgtccacgaggacatgcttcttgccgcctcggctgcactagctgatcaggccacagaggagaactttgtcacgggatcgatcttcccacccttcaccaacatcagaaagatctctgcgtacattgctgcagccgttgctgcaaaagcttatgaactcggtttggcgacccgtctgcctccccccaaagacctggtggcatatgcagagagctgcatgtactctcctgtctaccgtaactaccagtagtgctgctggaatcaattttggagttataaaatatatcaacgcagatgatactgcaatgttgtagttatcgctgtttaatatagtccctgctgctaaccacccttgttgctggtgctgctggtcgacactgtacctttctatgcatatatgatatgttgtaacgttatgaaagcaaacaatcttttgtcc

SEQ ID NO: 78222 - DNA, 400 bp, Triticum aestivum
  Clone ID: PAT_TA_78222
gcacgaggtacacggtgtaggcaggatggctccacaacattcatgagatcttgggctcttcagggatccatggacggccggaactggacaagcctccgtgtccatgacgacgaccctaccatttgccacccgggccagttcgcctcttggcccatcgttggcccggcggcccttctgcccttccgattcttcagggtcgccctgacaggcccggccgccggatgtgcttggaacctctgcatttgcttcctagagctctacggctacttccgttagatgtcctgtccacaagctttcttttcctaaagaagagtaaatgaacagctttgttagtaactagagcagttctaagatggtccaagttctgttgaaaaaaaaaaaaaaaaaaaaaaaaaaaaaa

SEQ ID NO: 78223 - DNA, 341 bp, Triticum aestivum
  Clone ID: PAT_TA_78223
gcacgagggtcctatgttgccaacttcggctatgacccaagcaagatcaaggacacccctcaagactgcgagtacatgtcctcagaccagattgccttgatgatgtcgatgcccgggatgaacgaagccctgacgaatcagttcccagatctcaagttaaaggcaccagttgcacttaacccattcacaagtgtgtttgataccctgaagaagctgcttgaactgtacttcaagtaaaacaagtgtaacattgttcagtaaccaattgtccacttctccacttggagctgcaatggaatgaagttcagtttgttcaaaaaaaaaaaaaaaaaaaaaaaaaa

SEQ ID NO: 78224 - DNA, 717 bp, Triticum aestivum
  Clone ID: PAT_TA_78224
ggcacgagggtttgttgttgctgctagtggaacaatttcctcagctcataggatgcacacgattgatcgagctgaagcaaatcaccggcaaggctggggttgatgcgcggatcgttggcatgatgatggaggcttaccagccgctttgatccatcaaggatcgctctttgctattcagaaaggctacaggctcattgcagttatgccagctaaatatttgcttgacaagctgatcttgctgagattcatgggtgctgagttgtacttaaccggtatgattagttgaagaaagttacggtatcaccttaattgcttttttcagtcaaatttccttggttaaggaattttatgggtggccttcttcctttggtgtactgtatgtgcagatccggcccttggctttgcgggcatgtttgacaaagttgaacagctccgagaacaactgccaaatgtacttgttctgaatcaagttactaaaaatttgcaaaattttttcagattccccgtcacatcgaatgtttagacgtatgcatggagtattaaatatagatgaaaataaaaactaattacacagtttggtcggaattgatcagacgaatcttttgagcctagttagtccataattggacaatatttgtcaaatacaaacgaaaatgctactattcctattttgcaaaattttttggaagtaaacaaggcctaagagagcaaattctg

SEQ ID NO: 78225 - DNA, 400 bp, Triticum aestivum
  Clone ID: PAT_TA_78225
ggcacgagggtttgattgtctgatgaagacctatggcttccttactcctgagttctgcactgagactaagtatatgaagaccccgttcctggagttcaccgaccttttggctaagccgacaaagggtcttttgatcaaggctcctactgaaacggtggaagcttaaatatcttagttaaattgttcaagtgtcgagaaaaggagtttaattgctgtagtaagatattggtgtcttgtttttttgtttttgtgcagcctaagatattgagcccagccagcttctgatgaaatcagtcctccgcttgtgttagggtggtcttcaatatgatatgaatgctacaacgcttgcactcacacaaattttttttgaaaaaaaaaaaaaaaaaaaaaaaaaaaaaaa

SEQ ID NO: 78226 - DNA, 673 bp, Triticum aestivum
  Clone ID: PAT_TA_78226
accagagagggagtggtctggtgcatcagagaggagacgggacagagagaaagatatgcctcctgaacaggagtggtcagagaggaggcaccggaatgagcatgacatgggccgagagagggatcgtgactatggcagagacagagaaagagaccgtgacagagagagagaccgtgacagagagagggaccgagacagggagaggcatagggatgatagagatcgttatggtgattatcacaagcacagagatcgtgattcagagcgtaatgaaaactgggacagggggaggtcatctgggttacggagcaggtcgagggaggctgaccattctaaacgtaggcggatgacacctcaatagtgtagctggatgagctacatctagtctagaggcaatgatgatctagggaagcgtcttttttgcatccaggcattgtccagtaacaaacaactgcttactacttgtagctgtgatggttttcaatgctccggtgatctgttgtaacagtaatctgagatgtaagttgtgcttgatctgatctcttgtttgttttgaaactgtagctcttgaattgtaatataatagtgttgtgtcatattgacattttctcttgtggtaggttaggacaaaagcttacacaacattgccatgtaaatttttttgtactgatat

SEQ ID NO: 78227 - DNA, 726 bp, Triticum aestivum
  Clone ID: PAT_TA_78227
ggcacgaggcaatttcttcgctgttctgcttggcaacaaaactgctctgaaaggtgggagcggcaaggttgtggacagtggccccaatgatcatatctttgttttctacagtgaccatggaggtcctggtgtccttggaatgcctacgtatccgtatctctacggtgatgacctcgtagatgtcctgaagaagaagcatgctgctgggacctacaaaagcctggtcttttaccttgaagcatgcgaatctgggagcatctttgagggcctcctgccggatgacatcaatgtgtatgccaccaccgcgtcaaatgcagaggagagcagttgggggacgtactgccctggagaattcccaagccctccaccggagtatgacacatgcttgggagacctgtatagtgtttcttggatggaagacagtgatttccacaatctgcgaactgaatctctcaagcagcagtacaagttggtcaaggataggacagcagttcaggatacattcagctatggctcccatgtgatgcaatatggctcattggagttgaatgttcagaaattgttttcgtacattggcacaaaccctgctaacgatggcaacacatttgtagaagataactcattgccatcattttcaaaagctgttaatcagcgtgatgctgatcttgtctacttctggcagaagtaccggaaattggctgatgactcatctaagaaaaatgaagc

SEQ ID NO: 78228 - DNA, 777 bp, Triticum aestivum
  Clone ID: PAT_TA_78228
ctgcttcggcaaacattcagcacctaagcctacagactgaagatctagttgcaagtaaatctaccgaagataatccagcggttataatccctgatcatctacaacttgcaaatgcagactgtgggcatctgagctttggtagttttggatctggtgccttctctgggttgcttccatcaaaggtccacaaaaatggagtggaggaagtgcctgttccagatgaatctccatcagttgatcaagaagatgtcaggaatcaagacaacaatgttgctctaaattcttcaacaaatggggacgttgaagccagaattggcactaacatggagaatactgatgaaccttcagtttcacagcctgatattctgacgcagggtgctgtagatgtgtcaagtctacaatacaatctgccatcagtttcagatcatgtatattcaaacacaacacaaccaagtacgatggagagctcacagggagacatacaagtgcaacatcttcctcagttttcaagtttactgcaagcaaatactctacacaacaacttgctgggatcaaatcttcccaaccttcgggactttgacttttcaccattgctatcaacacaattagctacaaaatataacccaccagtaccgactaccagcttaccagcaatctccatgcaggagacattgaagccagggggattctcgaatgcacaatctacacaaaatcttcccagcgtgagcattccatctgggcctcctctcccacaacaattatctgtacatccgtacc

SEQ ID NO: 78229 - DNA, 712 bp, Triticum aestivum
  Clone ID: PAT_TA_78229
ggacgaggctgaatttatggttaaaaaaatgggtcagggcattgatcaccagaagctttgcaattgtgcctactataattgttgctttgttcttcgacacatctgattctgcactggatgttttaaatgagtggctcaatgtgctccaatcaattcagatcccttttgccctcattccactcattaccttagtttccaaggagcaagttatgggagtcttcaaaataggccctaacacccaagctgtaacctggaccgtcgccactctgctgaaattcgaggccccctatctggctcacttctctgcgtggcggtcctcatctatgcttcgtttgtaatgtatctcatactgcggggcaccgagctgtccgagaagattgtcaaagcagtccacagcagtttttcatgacaacagtcaccagttttggtcttttattacatcttgacaacaagtttctcagacacaagagacgtatagagagatatatactacctgcctctgtccggtgactgcggactgaatactacacagcacaccggtgtacactgtacagtgactacttgaaagggccatcagttgctgcaagcctgcagcagcagctgctgcccgttgcatctgtttattaacatagagatgagtgaattgctgatgttgttgaacttgaacattcagagaagacccagttctctttgcaaaaaaaaaaaaaaaaaa

SEQ ID NO: 78230 - DNA, 421 bp, Triticum aestivum
  Clone ID: PAT_TA_78230
acctccacagcgtacatccgaaacaccaaaacacatgggcgagcagaaaaacaccatggaaacctcaactccaaagctccattacaaaatgggttggaaattggaattctactagtactccgcttctagcttttagaaataccagaagattacaaaaacaaaagaggatctctactgctttttcctagaagaatacgtacatctgacaaagacgacacccgggcccaaacggcagcgagaaacctcattcaattcatcagctggtgcggcggaaagagagagaaaaacagccgtgaaacgccttgctcctcctgcgcgccttttcgctacgcccggtctacggtgggccggctgcgggggagccgtggcccggtcccggcttaggggagtgctggtacgacatgtcggccgttgggagaaa

SEQ ID NO: 78231 - DNA, 373 bp, Triticum aestivum
  Clone ID: PAT_TA_78231
ccagattcttcctctttctgcaagttcagtgataagttcaagaatcttactttcgtctatgcggacattgacgagtgccctgaaacaacgcaaaacatacgctacaccccaaccttccatttctacagagacggggaaagggttgatgagatgcttggcacaggagaagagagactacatgatcggctatggttgcattcttgattgataggcttccacttccgttgtttcatgaaccatttatgctgaatgtttgtcccgaaatttctacgtatgtaccagcacagttctaatgtcctttcggagaactttgtctacatttattagtcatggataatttattactgtctgaaaaaaaaaaaaaaaaaaaaaa

SEQ ID NO: 78232 - DNA, 190 bp, Triticum aestivum
  Clone ID: PAT_TA_78232
ggagctcggcctgaagctgcgccagaatgtgatgaaattattatagtgagctaaatcttgcatgcttcagattaatggtactgtatgatgtatggcttctttgagtatgttctttagctttgaatggtcgcacagatacattggttgatttagggcttgtttgaatgagtttcagattcttaaaaaccag

SEQ ID NO: 78233 - DNA, 483 bp, Triticum aestivum
  Clone ID: PAT_TA_78233
atctctctctctctctcgcatcgcgcgcagccttcctcatccccgtcctgatccactccacctccctaatccacagcgcgcgccagaggaaatccggcgccggtcgaggcggccgcgccgcgccgccgtcacgcccagcccactcgattcggtcgcgtgtgcgctaggaagttcgtcatacgcctcgcggttttcacttcgtgtgtttttcttttaaatttttacctgtgcttcgtttaaagcctctcttgatcttaggtatagctttgctcgatctgattataggtatgtgggatgtttctggtctcccgtgattgcgcgtggattgtgattatgactaatttgcttgatctgaatatctgattgtggtggtggtgtgtgtgtgtctgatttgcctgatctgttgtggattattattgtatgatttaccgtggttttatgttgtttatatataagcgtttgccaaaaaaaaaaaaaaaaaaa

SEQ ID NO: 78234 - DNA, 630 bp, Triticum aestivum
  Clone ID: PAT_TA_78234
gcacgaggggcagcatttgtgtcggcgtcggtgctccctctctctcgcacgattcggcgtcgctccctgctccttgcctccggcatgccccttccctccatcaccgatggcagctatatcccaccaacggtgccaccaaccagcggggacagtagcccccggtggcgtgcggcttcccctcgcggatctgatggtcacgctgccttcctgaccggcggtgtacggtgtcgtcccatcactggtcatttgcttgttgattagcaaggagatccagaatccaggattgaggcttctagatctttcaccatgacagaccaccatgttctcgtcgaagtcttcagcatgttctctgaataaacaactaaaaatctagcatacatctcattttctcgttactctgtctcctctacatctagatcttgaattttttttatttttctcgttactctgtctcctccccatcctcggatacttccttttctagattgaggtattacttgagactttctggaatttttttgtactactaaatacttttttagatagtagcggcaattcatacattgttctacatttttataaagtagtattatatgttgttcgacaaaaaaaaaaaaaaaaaaaaaaaaa

SEQ ID NO: 78235 - DNA, 754 bp, Triticum aestivum
  Clone ID: PAT_TA_78235
tgcattttcagcaagtatacataaaggatactgatgagagagcttgtgcctacattgctggccctgcacctaatcgctgggggtttgcaactgaagggaatgatctattcaatgtcatccggagttctagtggagatgctcaagtttctgaatcagcaaacacagatcttacggagaggaaacataatgacgttcgcagccattctctgttctttggcatcactttgagtttgttggctgaaattattaattctaggctattcacaacagttcgagattccatgggattaacctacgatgtttcttttgaactaaacctttttgacaaattggaccttggttggtatgtgattgcagtaacatcaaccccgagcaaggttcataaagctgttgatgcatgcaaaggtgttctcagaggattacatagtaacaaaattgttgaaagggagctggaccgggcaaagaggacgttattgatgaaacatgaggctgagacaaagacaaatgcctattggcttggtttactagcccatctgcagtcttcatctgtgcctagaaaggaaatatcctgcatcaaggaattgacgatgttgtatgaaagtgccacgattgaggacttgtatcttgcatatgagcacctaaaagttgatgaatcttctttgtttgcttgcattgggattgctggtgctgaatctggcgaagagacgactgatgatgagctcgatatgggcctgcatggcatgggtcctattgg

SEQ ID NO: 78236 - DNA, 556 bp, Triticum aestivum
  Clone ID: PAT_TA_78236
ggctactaccagagaaaccaaataatatcatacctaactgttcgtctggaagttactcttcatggcaagtgcctgaatttttttcccctttcctgttactgtgtgtcagaacaattatgtagctgtagatatattgattatggaaggatgaagttgccaaattgacctgaggcgatttccttctccagccaggaaaaattctgaacatcaaggagtttctgtttgcaagtttcactatttaaaagcagtcgtgtcactagtgaggaggtaaggactgggccgaggcagtattatcagtttcttggatatggattgttgtgctagtttcgatagaggtgtcaaacatcaattaggatgaagaggtgagcaacattcaaggaggtgctgatgcttgctgacaaccttagaaaaggcgttcctgtagctgactacttggtttgtcggtcagacaattctagacgtgaattttgatctgttggccagatgccaaataggtatttcgtatctcttgatttatgggattaacatttactcaaaaaaaaaaaaaaaaaaaaaa

SEQ ID NO: 78237 - DNA, 785 bp, Triticum aestivum
  Clone ID: PAT_TA_78237
acgagggggcagcgtgtgttctgccaccgaggaggaaggcctgtgtgctcgcttcgtgctctcgcgagcctcccgataggaaccgcggcttggaggtggagaggaggcgccttctcatgtccgggctcgtgtcttctttcgcaatcgtgctcccgatttcagaagcatatgctgtcatggagactgatgaagacgtgaagatgaacacacaagttgatgagatcaatgcatactcttttctttacccggtcgaactgccaggaaagaaattttccttcaaatgggtagagtccagaaaaccagagcgatattcctctgcagcgccactatcacctgatgcacggcaacgtatcgtatcggagcgagttgacatgatacataatgttgtcatctcagtctcgattgggccaccgaattcacgttttttgccttcaaaagacaagagctcgtgggatccgaaagatgttgctgattgcattttgtctgatagatctaccctgaaggtgacgactggccagcgcatgacagagagttctgtccttgatgcacacgctacagaggttgacggagaaccatattggtattatgagtatcttgttcggaaatcaccaacaaaatctgcaccagaaccaaatttgtttcgacacaatgtagcctgcactgctgagcgtgatgggttcctgtactcactgaatgcttccacccttagcaaacagtgggaatctatggggccctttctacaacagactgtggcatcctttcgccttctcccccctacagaaaac

SEQ ID NO: 78238 - DNA, 659 bp, Triticum aestivum
  Clone ID: PAT_TA_78238
agttgtgacacatgagaattcacagttgagaagactctgcaggatgccattgcgccagcagatacaaataccacactagggtaggccccaacggtggagaagactatagaggatacctcggtcgaggcaccagatgcacaagcaggtgcaagtgagtaaaccagcttaacaaaccttgcgttcctgtcagtttctgttgatatcgacatagtctggtcaactgattctcttgtctagatgatgcagtctgtatagaaaaacggaaatcactttagcatcataaggttattaggtattagtaaccagggcatctacatctctatcccttttttcctatataaacttcatctagttgtattggacgcgcacgtgatggtttgtcataaacacaatttcctcctacgtcagttcagtgctcaggcgatcagtgactgagtgaaggccttaaatatatcagatagagggaaagcatgttcattcctacgtttaacggttaggcttgggagtctttgggctacgtactggggtcagatgattcttgtaccatttgtcatttgtaacgtgttctggaatcctttataatatcacgtagaatattttagacagttctttttgctcactgatcttcgaagtttgataactatttattagcaaaaaaa

SEQ ID NO: 78239 - DNA, 303 bp, Triticum aestivum
  Clone ID: PAT_TA_78239
gcacgaggctctctctttctctctctctctctctctctctctggggcgtcctcgaagctgtgtcgcgtcgagtacgtctactgagccggacaggcggatgactcttctgctgcaccattgccgtgcttaggccgcaataatcaaatgtttagagcttaccaagttttacagctctaatagcttaattttgcgtgtttgcttttttttttctttttgtaagaattcttatggtgtgaattaatgagtgttttcttctaattttgtgattatttctgaaaaaaaaaaaaaaaaaaaaaaaaaaaa

SEQ ID NO: 78240 - DNA, 212 bp, Triticum aestivum
  Clone ID: PAT_TA_78240
cgatggctggagccaagtgccctggtgcaaggtcaggcacagtttgctggaatgtagaatctggaccatgcgagtgtcaattatagaggcacaataggataccctatcaattgtacagcgtggaactatagagcttgctatcatgtaattcctctgttccaaattacaaggtattttgtattttttctagaaaaaaaaaaaagaaaaaaaaa

SEQ ID NO: 78241 - DNA, 484 bp, Triticum aestivum
  Clone ID: PAT_TA_78241
atccggaggctggcgaggaggggcggcgtgaagcgcatctcggggctcatctacgaggagacccgcggcgtgctcaagatcttcctcgagaacgtcatccgcgacgccgtcacctacacggagcacgcccgccggaagaccgtcaccgccatggacgtcgtatacgcgctcaagcgccagggccgcaccctctacggattcggcggctgagaggtgcccccgccgctggtggccgtggcaaaagtcttggggtcgcggtcaagaaatcgagggaggcgagagtattctggcccatgtgcttagtttcgtagtcttatcggtagtgcttattgttacaggttgttgggttcgatcactctagagccactgtaccgcatttccccgtgttctgaacttccgatatatgaaatgtggattcacttgatatctcctcgggcaacaggttaagtcgtctttaattttaaaaaaaaaaaaaaaaaaaaaa

SEQ ID NO: 78242 - DNA, 484 bp, Triticum aestivum
  Clone ID: PAT_TA_78242
aaacccagatttgtggaaatggttgactagtcaggagcagccaccagaggatctgaattctaatcctgtgtttgctgccatcaaatcaaaggttacagataacctgacaaagcatgcttctcccgagacccgatcaacaccaggtcaaccatgggttagaggatgggacgacataaagaaaggcaaagatggacccaagtatggaaatcagtgataagctgcttgaaatggggatgacagctttacatcctaaataatagctgtccgtttcccccatctgcttgttttgtgcttgtgtagaataaagtgaaatgtgatcagcatgtgtgaagtttgttaaaatatattggtgaatcagaatcagcttgtaactatggatggcacttttgatgtgtccctagcagttccaggtatcgtctactactggaaagatgttatgcattgcagcctgttaatgatggcaaaaaaaaaaaaaaaaaaaaaa

SEQ ID NO: 78243 - DNA, 580 bp, Triticum aestivum
  Clone ID: PAT_TA_78243
gcacgagggtgatgcttcaggcgacagcccggacgaggtgaaggctaggctcaagtactgggcgcaggcggtggcgtgcactgtcaggctctgcagctgatcgatcaatggcgccaccatcaattttgccaagaaacttgctacaggacgaggatgaaagaaacacagggcatctgctcaacttgcagcaatcgtggcaccgccggaccaacctgcaacaagagcatcccatgctgcatccaaaccaagatgcttggactctgcatcgcatcggagcgtcacgatgatcattcattcattcatccatcagacagaagcacagagacagagttgtgaattcagatcttgctcgaaattttttgctgagatatgtgcaggaaaggagggatagagaaagggagagggggccaggtcaccaacagccattgtctgatgttgtactctactgacacgaatccttgattctcgccttaatttttgctcatgtaaaacaacaccacacctgtgtaaaatatactcatgaatcctgattggatcagaaataatcgcataattccactccaaaaaaaaaaaaaaaaaa

SEQ ID NO: 78244 - DNA, 660 bp, Triticum aestivum
  Clone ID: PAT_TA_78244
taggcagacaggaatcttgcttagatgtcaagctatataactaaccttgtttcctaggccctaaataattggcttatgtcccttgtgttggaggcatcaggatggtgtgttttaacattttgttaatatatagagagcaaatgcaattgtaaaataacatagctaggctctcgcgttatgtcgaagactttggtagttgcatctttatatgaagcatcttggatcaagtcaaacttcagactttttatccttcagacttgaacagtttccaagttttgattcttgtgtgttgttgcacactgtcggtcagtaaaaagagattggttcgcttccgtgatagttatatttgtctcttgcttttgttgctgttgcattgtgtttgaatccagacagtagcaaacagaaaattggtccatgctgatgactaaagacttttctttccctgtgtgaacggaatagatgggtcacaggggtagtgtgtcactcaagtcaactgctctcttatgaccaaataatttcttgtaacaactttggccccatgtgtgcctgtattttagtggctcattgattgtgcattattgttcaagttatcaaacatatgtcttgttttggggcacttgcaaggtccatgactgtatctggcattagtagtgaatctca

SEQ ID NO: 78245 - DNA, 244 bp, Triticum aestivum
  Clone ID: PAT_TA_78245
ctcacctcccggcgtctgttccccgcgcgcaccgcggtctccgctcatatcacctacccctctgcccacatcccattcccagatcccaccgatcgaaacgcgaccccgaaccgacgcaatggcgaccctcaccgtcccctcctccgtcccggccgtcgccgaggacgccgagcagctccacaaggccttcgaaggttggggcaccaacgagaagctgatcatctccatcctgggccaccgcaac

SEQ ID NO: 78246 - DNA, 739 bp, Triticum aestivum
  Clone ID: PAT_TA_78246
taccgaacacgttgactttattgaagctgtaaaaaattccaatgaatataaaaagctttttgggaaagtagtcaaacaatgcaattgtgaaaaactagtcgaatttgcagaattatcaaactgcaattttgttgaagatttgtccactcattccgatgaagatgaatcatggattagaaattcattactacaaatgcgtcaagttgttgagaaaatagcaacatgtgcttttattggttttggtgattcgaatgaattaatattagaaagtagagcaggtttgctcactttatttataaaatgttactttacagtgattaaaaaagtaattctagacactattcccaagacaattatgtatgaaatggtaaaccaaataaaagaaaactttcaaaaagatttaatttccaaaatatacaaatcaaaacattttaatatggcagaactattacttgaatctaaagatattgtagatgaacgagtaaaaacacaaaacctttttgaagcatccgagaaagctctaaaactaatgaaagaaattgaactaatttgtcttgattctgagttatgaatcatttgaccaaaaaatatttttttttttctacaattctatgtaagactgcatctataatgttttcatgaattacttattaactaaatttaaaatacacaaatccagttgatcaatttcttatttgttttttgtttaaggttacatttttttaaaatgtttttgggg

SEQ ID NO: 78247 - DNA, 771 bp, Triticum aestivum
  Clone ID: PAT_TA_78247
gcacgagggccagattttttcttcatcactgcttctctccgttttgatggtgcccttaatgttgacttgactgaattccagacgaatttggtcccatacccccgtatccatttcccgttggtcacctatgccccagtcatttctgctgaaaaggcttaccatgaacaattgtccgtatcagaaattaccaatgcctgttttgaaccagccaaccaaatggtgaaatgtgacccacgtcatggcaaatatatggcatgttgcatgttgtaccgtggtgatgtcgtacccaaggatgtcaatgctgccattgcttccatcaaaactaagaggaccattcagtttgttgactggtgtccaactgggttcaaagttggtatcaattaccaacccccaactgtggtccctggtggtgatttggctaaagtacaacgtgctgtttgcatgttgtccaacactactgctatcgctgaagcttgggctaggttggaccacaagttcgacttgatgtatgccaaacgtgctttcgtccattggtatgttggagaaggtatggaagaaggagaattctctgaagcccgtgaagatttggctgctctagagaaggattacgaagaggtcggtatggactctgtcgaaggagaaggtgaaggtggtgaagaatactaaacactgaagttcccagacaacaaccccatgcttgatttttacactccaaaaatttaattaacctcagtattttttttttatatggacatttttagacattttatt

SEQ ID NO: 78248 - DNA, 176 bp, Triticum aestivum
  Clone ID: PAT_TA_78248
gagagaactagtctcgagttttttttcagagcacctaccacctgaagatttgtgggatagccaaggtgtcgttttcgtatactcccttgggaaagaatgtagatagcaagcagttcttggacaagcacaagattttactttaaaaaaaaaaaaaaaaaaaaaaaaaaaaaaaaaaa

SEQ ID NO: 78249 - DNA, 768 bp, Triticum aestivum
  Clone ID: PAT_TA_78249
gcacgaggggtgcttctacactagtaacactgcatttcaagataaggggtttgatgctacaggatgggaacttgcccttgttaccgcaccgagcaacacaacttcatcttcttctgttggtcaattgggtggtggattcgacaagctcattttggacagcctttatgatgacggggcctacaggcagaggcaacagcaacagctgtatggttcagcagcacctaatccattcatgacaaatgatcctttcgccatgtcaaaccaagttgctcccccaccatcagttcaaatggctgccatgtctcagcagcatccgcagatcccaacgatgatgcaaccaaatccctttggaccacctatgcagccacagatgagcatgggtcctgcaacaaacaatccctttctggattctggcttcggggcattcccagtagcgaacaatggccatcaacaacacaacccatttggcagtgcccaacttctgtaggctacatagttaaacaagagcaaatttgtgccccagcaaatgcgatttttgtgtgattatatcatgcattgtgcttggccattcttgtatgcaacgcatgtattatgtattggcttcaccacacggggagctatggcgtgacccaacccttgttgtaaagaaattagtgacctgtgtaacatcagatatatgtcaataaacagtaggcaatgttattataattaaaaacaaaagagcggtggtatgtaggaattttcaatattgtataaaaaaaaaaaaaa

SEQ ID NO: 78250 - DNA, 426 bp, Triticum aestivum
  Clone ID: PAT_TA_78250
tgtacttgatggaaacgggtgccaggaatgaaatttttgcattgcagccagcacctatccaagtttcgtacatggggttccctggaacaacgggtgctgcatacatagactacttggtcacagatgagtttgtttctccatctagatattcacatatatattcagaaaagcttgtccatttgcctcattgctattttgtcaatgactacaagcaggtttgacttcatgcttcttcatgtcttcttttccttttttttttcattaatgatatttgatataaatttgaaaacatattctgtaccagaaaaatcgagactgtctcactcctggatgtccacacaaaagatctgattatggattacctgaggataaatttatttttgcttgcttcaatcagctttacaaaatgcatcctgacatatttga

SEQ ID NO: 78251 - DNA, 507 bp, Triticum aestivum
  Clone ID: PAT_TA_78251
ggaagaaaatccgcaaagctgagaagaaagaaaagaagttcagagatctgtttgttacctggaatccgatatcgctagagaatgaaggttcagatcttggtgatcaagattggctgttgagcagtacaaggaactctgatgctagcatggctcaatgcaaatcaactggtggtgtagggccgatccatccaatggtgcagcagcagccttctttgcaacccagggccacttttctgccggaccttcatatgtaccagctgccatatgtcgtaccattttaaacatctgtcgaggtagatgagaattagatgagatgttgggagagagctgtgtggatgtgggagataatggttccctgccgcagttttccagctttgttccaatcgtgtttgtttgaggccaatagagttctggcaaaacttgtaatgttcgttaattatttcgcacgtttatgtaagcagttgaactgcaaaagcttaactgttactgttgtatgacacgcaggat

SEQ ID NO: 78252 - DNA, 565 bp, Triticum aestivum
  Clone ID: PAT_TA_78252
ataactgtacaaaggtagcataataattagttttttaattaaaaactagaatgaaagattaaatgaaatataaactttataaataaaataaaaattaaaattaaattttaagttaaaattcttaaatataattaaaagacgagaagaccctttagaattttatattaatttaaattaaaattaaaatattatttatataaatttaaactaatatttaattggggtaattttttaatttaataaactttaaaataataaaacattaatttatgaatttataaacctaaaatttagaattttaaaataaattaccttagggataacagcgtaattttttttgaaagttcacatttataaaaaagattgcgacctcgatgttgaattaagattaatttaaaagcaaaaatttaataatttaagtctgttcgacttttaaaatcttacatgatttgagttaagatcggtgtaagccagatcggattctatctttaaataaatttaacataattgtacgaaaggaatttatgatatacataatttatatatatatatatataaaaaatta

SEQ ID NO: 78253 - DNA, 178 bp, Triticum aestivum
  Clone ID: PAT_TA_78253
agactaatttgaagattagcctgttgcggaatctgaatttgacttttcagatagtgctttgagccacgactttttaaaagcaaataacttactggcttatgattttatcttctctggactggaattatgtacccagcaagtactagctactttgtggcgcaaaaaaaaaaaaaaaaaa

SEQ ID NO: 78254 - DNA, 635 bp, Triticum aestivum
  Clone ID: PAT_TA_78254
ttggctcatcttgtgatcgctacgtaatggggcaaggagtgggatcatatgatggtgacagtcttgagcagacgattgcccgttcaaggtgtcacaagggtcgtctgttgtactatttcccacgacagtttagcaagcagatagacgttgagtctgtttcatcatggtgtggatggcacactgatcatggatctctaacaggtctcacatgtggcttgtttacgaagaattctgtggaggtaccatgtccagatagtgcagctggactatacattcggactcgtgataaccaagttgttaaggttgtgtttgatgaggatcagctggcttaccaaattggggaaactactgaaatactgtcaagagggtatctgtgtgcaacgccacactgtgtgcaggcacccaacagtgaaaatgcttcaaatgttgaccgctctacttttgccttgttcatgcaaccagattggaatgagaagcttaagtttccgagcgaaatcccctatcaccaagagttgattccaccaaacggaacgctgactttcggggaatactctgaaaggctagtaaacaagtattaccagacaacaacgtagagcatacctcaagaaaagctaccgttgtacatacattggtgt

SEQ ID NO: 78255 - DNA, 236 bp, Triticum aestivum
  Clone ID: PAT_TA_78255
tggtgccctgctgtccgtgataatctcaacctcatcagagctcttcggactaaagcatctggggaaagatattcaacttcatcatattggcaaatccagtaggcgcatacctgtttaacacccttgcgggatatgtctacgatctcgaagtggcaaagcagcatgccacaacatcagggtcggatattgcatgccatggccctaattgcttcagactcacattctgtgtcctctct

SEQ ID NO: 78256 - DNA, 430 bp, Triticum aestivum
  unsure (1)..(430): unsure at all n locations
  Clone ID: PAT_TA_78256
atgctgtccaagaccgccaagagcgccgggatcaaggccgaggtcgccatcaccatccccaaacgctgcaacctcgtcgaccgccccatcggctacaagtgcggagattacactctgccatgagctttgagagcttacttgagcaccagtgcatgatccgtcggagttagcacgacgtctgtgggaagtgacggtgactgtgtcagtgtgtgtgtgtgtgttgccagtaaacgagacttgtgattaccatacatgtggaactccagtatgatacgggtgtctcagtctcactagatacgtgtgtacttgtactctcttgtagtcagagtcaggatgttccagagatgctgtcctgcatcctccaaataaaacttgttgtcttggacnacaaacaaaaaaaaaaaaaaaaaagaaaaatgaaaaaaaaaaa

SEQ ID NO: 78257 - DNA, 529 bp, Triticum aestivum
  Clone ID: PAT_TA_78257
catggaggataggataagaaagaagcgccacaagatcgtgcaaaccaagaccggctcgcccaaccccatgaaggtcgtcttcaacaaatttgacttctccaattcatatatatggttcgagttctacaatgctctgttgccaaaagatgttaccttaatttctgattctctgcgatcgtggcatatagttggccgtcttggtggctgcaattctatgaatatgcagttatcgcagttgcctttagattgtaaaaggccaacttatgatgctcttgaaggagctaacgtcactccgacgtccttttacaacattggtgatcttgagattcaagataatctagcacgagtatgacattggcattcatgagccattgcttttggacatcctgcttaatgccttaacaacgataagttcagatcatgttggtattaagcaagtacagtttggagggttagagtttttgaactggagtgaggacttgaaaacagaagaagttggatatagtgtgtgcaaaatctaaaatagcac

SEQ ID NO: 78258 - DNA, 251 bp, Triticum aestivum
  Clone ID: PAT_TA_78258
ctactatcctaacgagtgaagctgcagctgtcatcctgaaaagtcatggtcgagtcttaattctctgcattgagggagacatcatgctaatttaagaaaaaaaattcaaagcaactactatcctaacgagaagctgcagttgtcatccgcaaaaccaccagttcctatataatttctagaggcaaagacaatccccttagagaggtgctccataaagtatctgtagttatgctgaacagttaaatatgatt

SEQ ID NO: 78259 - DNA, 590 bp, Triticum aestivum
  Clone ID: PAT_TA_78259
cgtattctctcttcccccacaaggcgcgatgccccctagatcggatcacgccggcggcagcgccgccgccgcggcggccacgcatgccgacttcgactccatcgatcccctcttccacgtcctccgcgtgctccccttctccttcctccggccgccgcgcacccgcctgaggctgccgtcgaacctggcgctcccgtcgcccatgaccgtcttctccctcatcctactcacctacttcgccgtcgtctccggcctcgtctacgacgtcatcgtcgagccccccggcatcggcagcgcccaggaccccggcaccggcgccgtccgccccgtcgtcttcctcccgggccgcgtcaacggtcagtacatcatcgaggggctctcctccgggttcatgttcctccttggcggcgtcggcatcatcctcctcgacctcgccgtcgaccgcaccaggccccgcagcctccgcgtctcgtttggaagcgccggcgcggtcgccgtcgtcatcgcctacgccatggccatgctctttctccgcatcaagatccccggctacctttggtgaggctgataaaatcttgcctgttaattaa

SEQ ID NO: 78260 - DNA, 596 bp, Triticum aestivum
  Clone ID: PAT_TA_78260
aagtggcgtggaccaacttgttgaaatcatcaaggtccttggtactccaacaagggaagagattaaatgcatgaacccgaattacacagagtttaagttcccacaaatcaaagcacacccatggcacaaggtattccacaaaaggatgccgccagaagctgttgatctggtctctcggctactccagtactccccaaatctgagatgcactgctgtggaggcacttgttcacccattctttgatgagcttcgagatcctaatacccgccttccaaatggccgctttttgccaccccttttcaatttcaaggctcacgaattgaaaggagtcccagcggacattgttgcgaaattgattccagaacatgcaaagaagcaatgctcctatgtcggattgtgaaatggctgtgccttgagactgaacctatggttgcaattgtgcatttcccctgggatgttggatgatctgaggcatgcgagcccgtcgttgaagatgcaaggttatctacttgtacgacaatgtgacctgtgtagctgagtagtctatgtcgcagtgacatgtaacggcacccccttcctactaactgacgcttact

SEQ ID NO: 78261 - DNA, 626 bp, Triticum aestivum
  Clone ID: PAT_TA_78261
aggggaaaacttactttatctaatgtattaaaatcaataacagctgcattggttgaaagctctggtgatagtagagctgcattatttgtgcgtgattttattataacacagatagctgataaagacttgcatcagttttgggaacctgaagaacctatcaaactattatcagaaatcttagcaagagatgatattcagtctcctgtacctagacttattggatgctctggaaaaaatactatattggcttgctttagagtgggaatatatactccacacaataaacaaatgattggactaggttttggagaaactgtagatattgcacatgaaatggcggcaagagatagtttgcgacaattatttggcactccagataatattttacttccatttaatcttgaattaaatcagttgtgtgcaagtactgttaagaatttatttgtgaatgaatggtcacaaaaaaatttaccaactcgtccaatacattatgaacttcgtaaggccaaagaaataagtagtaattaaatgttttaacatcaagttagtttataattaaatttgtaatttaagtttcataataaaaatacataaaatttcaaaaattaaaaaaaaaaaaaaaaaaa

SEQ ID NO: 78262 - DNA, 445 bp, Triticum aestivum
  Clone ID: PAT_TA_78262
gtctcgtggcttcctggcggcggctgggcgagcggcgccctcgttgggctcttcaccggcgacgagcatccatctggcggagaatattgcactcacataactgatattaggatgagtctctgtacaatagctcgacgactatgtctttcgaaaccatcctctggcagatgtctttcagtagtttggggtcatctatacagcaccgaggttgcttcacagaaagttgtggatctagctgaccgcatcgctgctctccctcctgaggagatcaaacagattgctccagcccttctcttcagactgaaccgagaaccgccacaggtgatatctggccagggtttcagttttggtgctcagggtggatctggggctgctgctgggaaggctgacgagaagaaagctgagaagacagtcttcgatgtcaagttggagaagttcgatgctg

SEQ ID NO: 78263 - DNA, 627 bp, Triticum aestivum
  Clone ID: PAT_TA_78263
aagcggatgaagctgcgcctcacgccggagataaggttcatcgaggatgagtctatggagcgtggaagcaggatccttgctatacttgacaaactaaaggaggaaagggagcaacaagaaggaaaagatggagaggaagatgtagaaggttcatatatatcagaagaagaagatggtgactgggatgcagatgacccagatgaggaggatatcatttatgtaaaatagcctatcgtcttctgggaacttggtcatcattcatccagagcacagcagttctcttcggagtttaatccagtgaagttcagaactcactgcttacctgcttgtcgaagcactccaaagtatatcagcacttgaagaggtttacagagacgtctcttttgtcaattgaagcaggtcatatcacatccctgatgctaatgagggattcgaaagctagtcttttttctgtccactggatcatgatatctgaccgttgacgcaagacagttttggctgatgcgcattcctctgttatatgttaactagcaaatgtttaatttgtacctgcctagttatcttgctgtgtttcagtcataattttcttttatggtttgggtacagtttctctctctttctctgacc

SEQ ID NO: 78264 - DNA, 415 bp, Triticum aestivum
  Clone ID: PAT_TA_78264
gaggggcgcagagaagagctgttgctgccgcagaggaagctgcattctgcaaagcctgcgcacggttcggttttggcctgtacctgtaccacgaggatgatactcatcacgaagaccacttccattgaggctcagtctgcatcagagttgatcataagttgcaacgtgcgcaggatatgcccctggagaacttcatgcccagaatcaatttttgctctttgcgtagtatcatattcacaagcgacaacgcatgcttccacctgaatgtgattgtagatacaaagaagcctgtaacttgtttttgttgctctcgctggtggctcggtgccatcctgcaagaacctatgaacctatccagataggaaatcagtatggaaattctattgttgcctacttaaaaaaaaaaaaaaaaaaa

SEQ ID NO: 78265 - DNA, 214 bp, Triticum aestivum
  Clone ID: PAT_TA_78265
atctgttgcctgacctacaccttcctgtactgcacgtacccacgagacagggagcgagctcgaaaggagcttctcatggcatcggatgatcaactcggtggagaagccagtgacgacaacgagtcaagtgcggctcatactacacgggtagacgaagaatcttctgtcagctccttaaatcagaggctaatatcttgagaaggctagcagatgg

SEQ ID NO: 78266 - DNA, 293 bp, Triticum aestivum
  Clone ID: PAT_TA_78266
ttgaaatagacgaatgggggcccaatagagttctccatcatggcgaagcattttgaccggcaagggaaaccaccatatgcctaccatgcacaatatctggcgcacctcctctcccatgggcagctcgacggaagcggttaaatgcaggatgtgttgttcatagcatgcatcaatgcgattagaatgccactagatcttgtacaaaaatgttgccttgctagaacactgaggccagactgtatcagactagagattgcagaactggcatcagaaacaggttctgaattttcggc

SEQ ID NO: 78267 - DNA, 481 bp, Triticum aestivum
  Clone ID: PAT_TA_78267
cctgaagaatctgaactaggggcttctgctccctcatattcacaagaaaatgggatcagtcattccacgatgccactatctgcaacgtctgtgatctccaagctaactgaggagaaaatgtctgctattcagcagaaccagaagttacgacaagagctggaacttctacggaaagagagcagcaaaaccagcggcggtggtttctccatcaccttcttgtttgtcgttggccttctgggcatcatcgtcggctacatcctcaagagaacatagtggaatggtggtgtctccagcaaggctatactcccatgagaggatacccacacgtggtatgcctccccatgtgtttgtgctcctaatcggagcgccctgttctaacgtgtaacaacagcagcactcctagaagccttcggtttgtgtacattatggtggttcataccttttctgttcagaattcttctcagagttggtagacttgttt

SEQ ID NO: 78268 - DNA, 189 bp, Triticum aestivum
  Clone ID: PAT_TA_78268
gcatccgtcagcagcgccaccgagcccctcttctcgcgttgttgctggtcaatcagtgagctgcagcaatggccgcgggtgctgcgccgaccaatttgcagaaggagcagatgtttggattggcggagaaagagatggagtatagggcttgaccttttcaatcggcttacacataccatgttttgacag

SEQ ID NO: 78269 - DNA, 334 bp, Triticum aestivum
  Clone ID: PAT_TA_78269
cgcgccctggacgcggcggggatattcgagctcggcgacgccgcgtcagccgccgcgtactggaacgccgggagctgctggacggacgtcgtccaggaccccagcatgtacctaccctagctcgtttggtttagttacctatcgcgatcgctagattaagccgtggttaaatgcttcttaacgacgaccacgagctactacactacgtctccctaatactagctactcccatgtccacgctctctgctgcctgccctgcctctctctgtaacttttttttttcccttactcttgtttatttattggtaatttggcttcaaaaaaaaaaaaaaaa

SEQ ID NO: 78270 - DNA, 428 bp, Triticum aestivum
  Clone ID: PAT_TA_78270
ataaacgtaccattgaaaaattcgaaaaggaagcccaagaaatgggaaaaggttccttcaagtatgcatgggtacttgacaaattgaaggctgaacgtgaacgtggtatcaccatcgatattgccttatggaaattcgaaacatcaaaatactacgtcaccatcattgatgctccaggacacagagatttcatcaaaaacatgatcactggtacatcacaagctgattgtgctgttcttattgttgctgctggtactggtgaatttgaagctggtatctctaaaaatggacaaacacgtgaacatgcacttcttgcatttacacttggtgttaaacaacttattgttggtgttaacaaaatggactcaactgaaccaccatactcagaaaatcgtttcgaagaaatcaaaaaagaagtatcatcatac

SEQ ID NO: 78271 - DNA, 671 bp, Triticum aestivum
  Clone ID: PAT_TA_78271
gaaattcagtggctcaaatccagataatacaccagtagaagtgataccagcagatgcttcagcttcaaacagctcggattctggaaattcctctctcgaaggatttcagtggttaaatacatggaatcacatgaagcagttgaccaacatctccgatggccttcctcacgcaaatgaggctatagacaatgcaagaactgcatgggaaaacctgacgatatcagttcacaattcaacctctaaacagactgagaaagagaggcagtgtccatattctatccgcagaatgaatgcctccaagccagacactggagattttaccatcgatataccttgtgggctgattgtaggttcttcagtaactattataggcactccaggtagcctctccggtaacttcaggattgatcttgttgggacagaattgccagggggatctgggaaacccatcgtactgcactatgatgttcgtctaacaagtgatgaacttactggaggtccagtcatagtgcagaatgccttcactgcaagtaatggctggggttatgaggatagatgtccctgcagtaactgtaataatgcaactcaaggtacttccaaattgcgtctttattgtttcttcttttgccccgttacactaggcatctaacatatatcacagtggatgattt

SEQ ID NO: 78272 - DNA, 447 bp, Triticum aestivum
  Clone ID: PAT_TA_78272
cgttccccctcccgcctcgccgcgccgccgccgccaccgccggagaagatgggtcgcgtgatccgcgcgcagcgtaagggtgcggggtccgtcttcaagtcccacacccaccaccgcaagggccccgcccggttccgctccctcgacttcggcgagcgcaacgggtacctcaagggcgtcgtcaccgacgtcatccacgacccgggccgcggcgcgccgctcgccaaggtcaccttccgccaccccttcaggtacaagcaccagaaggagctcttcgtcgccgccgagggcatgtacacgggccagttcgtctactgcggccgccgcgccacgctctccatcggcaacgtcctgccgctccgcgggatccccgagggtgccgtcgtctgcaacgtcgagcaccacgtcggtgaccgtggtgtcttcgccagggcctctggggactac

SEQ ID NO: 78273 - DNA, 331 bp, Triticum aestivum
  Clone ID: PAT_TA_78273
ccgcgccgacctccaggtcaacaacaagatgctcgagatgtacgccaagtgcgccgccatgaaccacgcccgcaggacgttcgaccatatgcctgaccggaacatggactcctggcacatcatgatcgatggctacacgatgaacgggctcggggacgtcacgctgcagctgttcgaggagatgaagaccaagtatggaattgcaccgaccgcccacactttcacgctagggctcaatgcctgtgccaactcggaggccattgaggaggcattcctggactttgatgccatggccagggatcatggcattgaggctggtgtggagcactat

SEQ ID NO: 78274 - DNA, 690 bp, Triticum aestivum
  Clone ID: PAT_TA_78274
gcctccatggatacatcagccttgacgactgggagctcctcctgcctgatcacaagagctccttcctcgtggacgtggagtgcagcaatggcagccatggcgttgtcgtcggcggtaaggaccagctcttgctcggagccgagctggtcgtgatcgacatggaccacttcggctccacgtcatctcaccctcctccctatgactactgcatcctagatgaggaagccaatgagaagctaccatcagaagatgcctatggtcatgatccgatcgccattgatgtctacgaagcagaagagcaagaggagacgacgatcaagtccgtcaaagaggccgatcaggacgacgacgtgctggttgaagctgctgtacctgatggcgtcagtcagcgtgctcgggaggaggaagaggaagaaggcgtcagcaagactggcttcagcgtggggagcctgagagtgaacggtgtcggcgcgctctgctcgttcggggtcgcagccgccacgttctgcatcttgcttcttggtggtggtggtggcaagcagcagcagcaactgcacaagaggcagggtcacaagatccagctccagcagatgtatgctggcgatgagaggattcagcaggttgtgcagcaggcatccaggctgaaccagaccatgtcgtcggtgatgggaggcgcatcatctgcacggg

SEQ ID NO: 78275 - DNA, 661 bp, Triticum aestivum
  Clone ID: PAT_TA_78275
gaggtctctctctccccgcacaagcagcagaacagtggaaccagttcttgtgcgcgcggccttcttcctcctctcctcccctgctcagataagctctcggagctcctgcgggaaacctccaacgctcgtcgctctattttaccgtcgaaaaatacgccgcctcctgtaggctgtagcaggtccaaagaagttctgagagtttccccattccgggaggaagaatgggcaggccaagaggaggaaaggctaaacggccgccgtcgtcccaagctaccaagagcgaagacgctgatgccggcagcggcggcgaagaagaggaggccgtgatgacgccagcctacaagaggagggggcggccgcagaagcactaccacaaggctgatgacaccgacggggaggaggaggaggacgacgctgctgccaaggccgagcccatgctggaggacgcgaaacaaccggtcgtgccggtggtcatggcctcgccggagaacgacggaggagggaagaagaggagacggcggcggcagccgaagcgcggctacgactcgtccgcggccgaggagaaggacgaggcggccgtcaagcggagcggcggattccggcatcatgggagccgccggaagagcaccccgcggcgagctgccgaggcaggagtggagtg

SEQ ID NO: 78276 - DNA, 216 bp, Triticum aestivum
  Clone ID: PAT_TA_78276
tgcctccgccggccgagatggtcatgtagcgtcggggatagtaatttgtcgcaaaaggggttaccaaatgtgctgtaaataggaagcacatttggtttgtttccgtgtagctgcgcctccatttttttcccccctgtgcactagtcgatttgcaacttcgcagtgcaagaattttaaccaaaaaaaaaaaaaaaaaaaaaaaaaaaaaaaaaaaaa

SEQ ID NO: 78277 - DNA, 386 bp, Triticum aestivum
  Clone ID: PAT_TA_78277
gaccccgccgcggcgttccggtacaggaacttcaacgcgcgcctcccgccctcgccggccgccgccgccgcggtggggacacagcggccgcgggccacggccatcgccatcgcctagagttaagatcgcgctccgtgatggcacttttttttttcctactgatggagcgagcgacactcagttcttctattcagcgagttactactagtgaattatcctgatataaatatagtgttactcttgtaatcctagcagcattccaatgtgtttagtacaaattggaagtggcggtaatgaaccctagaaattgggagggagctttgattccacaaagaaatatatctccgcttgttctgcctaaaaacaaaaaaagaaaaaaaaaaaaa

SEQ ID NO: 78278 - DNA, 468 bp, Triticum aestivum
  Clone ID: PAT_TA_78278
actgctgttgagctctagcttctctgtgggcgcatctgcaattgtgttgataaagatggcctgctgctttctgtttggaaagaaagctaaacaagctgttgaaggcgatgaagatctacacagcgtcaaagtattttcttacaacgacttgagaaaggctacacaagatttcagtggcgcaaacaagattggcgagggtggttttggttctgtcttcaggggagtgcttaaagatgggacagtagtagcagtgaaagttctatctgctacttccaggcaaggcatccgcgagtttctgactgaacttacagcaatatctgatatcaagcatgaaaatctcgtcactcttattggttgctgcgctgaaggctctcacagaatcctagtttacaattaccttgagaacaacagccttgcacagacattgctaggatccagatacaggaacattcgggtcaattggcgggc

SEQ ID NO: 78279 - DNA, 334 bp, Triticum aestivum
  Clone ID: PAT_TA_78279
agcagcaaacagatccaaatttccaggacatccctacgcagtcttggtaccctccctctgtggtaggttcatcttcacgcccatccacccctacctcttctagtggtagtccacatcaacgagcttcagataatccacagtcttcatcccgtgggcaaccatctcctgctgaggctgcagggataattgcccgtttgaaggataagagtattgaggagttacagaggatattgaaagacaaagaggcatataatgcattctttaactcacttgatcaagtgaaaacccagaacaatgtgcgagatgagcttagaaaggagacattgcaacttgc

SEQ ID NO: 78280 - DNA, 684 bp, Triticum aestivum
  Clone ID: PAT_TA_78280
tccatcagatttgtcaattgcttggtggaatctggggcagatccaaacattcccgacgaagtgaagcacttcttgccttcaagaaggcaattacaacttctgaagggatatttctcaactggtgtgaacaagatgtggatccttgcaattggaagggtgttagatgtgacagtcacaccaagagagatcgaaccacttgtatgtgaatattacataagcaagtgccctgtaattgtaccctaccatagagggggaaagaggatacatgtaggagtgcaggaattaactatttcactgaagatattgctgcacggtctcaagctgttgctcgccagttcaagtcactgaaggtaaggtttgctctttggcgatggtaatatgagacatgggccttggtacataaatgctttgttacctgtgaatgatctagaaacatagctgttcacgtagctctttcttaatgagttgggacctttaatctcccttttgtgtttaggttaaagcagtagttgctttgctatcactgagcagaaatgacacagccggtatgcatatagtagattttttttctgtcttctacgcattgcaagtcacaaaaagcaatgttctgagtacgttttttggttgttcagaggatgttgacagcaataatgagaaagagaagtcatatggttacatgatgat

SEQ ID NO: 78281 - DNA, 548 bp, Triticum aestivum
  Clone ID: PAT_TA_78281
gcccgctgcccccatccaccacgccgtcgcctcagccagcagcccagcagcgcgacaaagcctccggcagctgctccctctgacgcctcaagcagcagacatctagcaagagtaacctggactaccaactctcgcacctccatctggaataactcttctgtcactctcgaagagcaagatatgcaacaaatgtcaataaccacttaagcaagggcttcaaggtgaactttaacatgggtgatgatgaactgccagcagatgaagcaaattagactaactggcttccaggttacttttgtctatgctggagggtgtgtgttgcccttgttcacgctggtggaggatgtgttcctgcaagatggatcgaggagcatgagattctgtagcctgaatctgttttctttgtagtatgtttttaaagaagtttcatttatatttagtggtctgtctgagaatatttttgacaaacataaactcatttacatgagaaattgagccttatatgtaaagtttgcatgagaccagcatgtattttcttttgcttgaaa

SEQ ID NO: 78282 - DNA, 570 bp, Triticum aestivum
  Clone ID: PAT_TA_78282
cgctatgccgcgcacaagttcgagtactccatctccctctcgcggaagaaatataatgtgggccagatcaacagtacggagctaactgatgcgatatggaaaaactacatccatggcaagctcacctacacgcattggaccaaagggggagaagccatggctcccatcgtatctccaactggaggaaccctccttgtcagaaagctcgcaaatttgagccccacacaagtgtttgttggggacgttgtcttgttaaaagacccagagaaatctgatgatttaattattcgacgactggctgccctggaaggctatgagatggtctctaatgatgagaaggatgagccgtttgtacttgagaaagaccaatgctgggtcctggcagacaacctagcccttaagccaaaggaagctagagatagccgcttgtttggacctgtcccaatgactgacatccttggcagagtgatatactctttaagaacggctgttgatcacggtccagtcgagaacagcggcatggccatgaaacaggatggcccagtactcacagtggagcttgatgtggaa

SEQ ID NO: 78283 - DNA, 767 bp, Triticum aestivum
  Clone ID: PAT_TA_78283
gacgagggcattatgttgaagactggaaaaaggtgtctgaacatgttggtagtcggtcagaaaaagactgtattgcaagatttatacggttacctttcggagaacagttcatgggacccagggaggatagaatgggatttgagaacaatgatgacaatactgatgagcctggagcagatgtctcaaaacgactacatctcactccactagcagatgcaagcaatccgattatggctcaggttgcatttttatcagctattgtgggtcccgatgttgcctcagctgcagcgcaagcagctatttctgcacaatcccgtgttgacctaaatgacagcgagattgaaacttcaataaatagcaccaaggaagaagaatcatctcacacaaatgggctctcagtcaacgatttactgaaagaggcggctgctaatgcacgggcacaacttgagaaggaacgaaacagcatagagcaatctttatcaaacatagtagatgtccagatgatggaaatccaagataaaatatgccggtttgaacagaaggagatgctgatggagaaagagcgacagcagctgaattgtctaagggatatacttttcacagatcaattggcagttatgcaacatcaacaaaggactccagctgtagtcacagagtgcaaaggtgatgagaagccaaagcccctggcaaacatgagttgattcgagtatatcctcggcatagcatgattctgatgtattatttcagcggcgttcatcctcatctgc

SEQ ID NO: 78284 - DNA, 321 bp, Triticum aestivum
  Clone ID: PAT_TA_78284
gaaaatcaccaccaggagggagaggactatgatgcccaggattctaatccatttccctcgtcagaagttgaatgcttgtcagaagttgcttcagtaaaaagtgaaaatgtgcacacattgcagctacctgagcttatagttgttccggaagaggcatggtcagtgtttggtaatataaaattcatacaagaacaagaaggagaacaccaactaagcaatggactttctgtttgcaatgacatatacacttctgatttgtcagcacaaaagaccagccagaaggctgaaatttttgcagattataaggaaaaggaatttcca

SEQ ID NO: 78285 - DNA, 630 bp, Triticum aestivum
  Clone ID: PAT_TA_78285
actctggagatgcttcgatggacatcaaaggccaggatgctgatgttaatattgacacaaatgcaattaccatagaagatgagcatgtggtggcaaagtcagaggcagtaattgaatcatttgacgatgaccagaaaacagaagattcaaaggaagatgctcagcttactactgcaactgatgttgacgatgacatggaggagggagagttgccagaggaacctgaagaaaagagtgatgttgatatgtcagagattgagggtgaaactacagctgagcgtgctgcagtggaaccagaccaaagtcctataacacaatctggtgtagctgatgcctcaccaagcagaaatgcagatgcatctcctgcacgtgaaccttcccctaatccagtccaagctggtgcaacttctcgaccccagaatactagcactacaacagaggcacgtgaaccttcaactaatccagcccaagcaggagcttctgaacagtggaacaccagaacaatcaactttgaaagggccaggcaaaataggcaagccaggtttcaacgtccacagcaacctgctgctggtgcacaacaacctgtcgctgctcggggtcgtgggcaatctgttacactcaggaaagatg

SEQ ID NO: 78286 - DNA, 634 bp, Triticum aestivum
  Clone ID: PAT_TA_78286
acccgactggcgcggcctagcttgtccaagatgtgctacaaccgaagaatggagaaaaacactatgttcttgctctcccttctgagagtagtggcagctaggtccatacttgctgcctacaccatacccttcttcatcatcccaaggaccgtgcatccactgcttggctggcctctctacttgctcggttctttctctctttcttccatcgtgatcaacgttttcctcctccacccgatgaccgtactcacaacatggtttggattcatcggcgcactattggtgatggccttcccttggtatctaaatggtgttgttagggcattggcagtgtttgcgtatgctttctgctgtgcgcccttgatctgggcatctttggtcaagacaatgagctccttgcatgtcctgattgagagggatgcgttcaggctcggagaacctaaccagaacgccgagttcacaaagctatactgagtttgaacagctaatctccattcacgttggcaaattctgatggccaattcaattgtacaagtaaaatctgcagcctgggagcaagagttgttgtaccttctggaaccatctggaaacctctagaacccatgattgttgtcttaaacatgtaggtgacata

SEQ ID NO: 78287 - DNA, 600 bp, Triticum aestivum
  Clone ID: PAT_TA_78287
taatggttggaaagttctttcaataaagttgaatcaactttggtcttggctagggtctattctaactttctctaagtaaacaaactaattggaagatatgtaccaggctgaagtgtctggtttgactctctaaattcagaataagtcttggtaccccagctcaaaaattttctgggattcgttgaaagcctagcaaaatggctggttcaattgtcaaaatttgcaattttgagccaattttaagtatttccagcattgttacttatgcaatttattgggaaaaagaaactcaactttaattaacgggttcattattttttgatggctggttggttttggcaaatatgaagccatttttttaaggaggtcacatgcaatctatatgttttttaggccatgttggtccaacattctctatggtttggaaaatagttaccattctcgcatgtaactgttatttcaagtgtcccagcccatttggcctctaaattagcattcggtctttgttgctgataaacattcttttcattgtagtgttaaggagcaagggaggtggatgctataaaagaggatggaacttggaaacaaggtccaaaaatg

SEQ ID NO: 78288 - DNA, 415 bp, Triticum aestivum
  Clone ID: PAT_TA_78288
gtattttaattttttttgattaatatttcaaatttaaattattttagggataagcttgaaatttttatataataatttatttattttaataatttataggaatagaaatttttatttaagtttgtaaaaatttattatttatttatttttaatttattataaattatttattattaatattaaattttattaattaatatttaattaatagtaataatgattaaattactataatttaaatttataaattatgaattcggcaaaaattattttcatctgtttaacaaaaacattgtattaactttaatttaatatacgatctgctcaatgatttattaaataactgcagtattttgactgtgcacaggtaccataataattacacttttaattgaggacttgaatgaaagatttg

SEQ ID NO: 78289 - DNA, 687 bp, Triticum aestivum
  Clone ID: PAT_TA_78289
ccttgttggggttgattctcattggcctttgtgatccatgagtcagcaaatccgcatatagctgtcttgggccgtttacctggcactactgtgtacaggaatacattacagtaccctgaggcttatacatataatgggatagtagtggttcgaattgatgcacccatctactttgccaacattagctacatcaaagacaggttgcgtgagtatgagctcaatcttccaagttcaaataagggacttgatgttggaagggtgtattttgttatcctcgagatgtcccctgttacatatattgattcgagtgctgttcaagctcttaaagatttgcaccaagaatacaaagcacgccatattcagattgccatagctaacccaaaccagcaagtgcaccttttgttgtctagatcgggcatcattgacttgataggtgctgggtggtgctttgtgcgagtgcatgatgctgtgcatgtatgcctacagcatgtgcagaattcatcttcaaatgcgttgaagctggctgttcaggcatcaggtgagttgtccgattctgtttcaactcctaaaccagagaagcagcatccaaagtactatggcttcttcaagaacctatggaaggcacgggactacccgcacgctgatggtgaggtgcagccgctgctccggcaaaaccttgtgtaatac

SEQ ID NO: 78290 - DNA, 658 bp, Triticum aestivum
  Clone ID: PAT_TA_78290
cagttcaaaaaaaaaataaataaaaaatggcagttaagatgatcatttttgccgcctgcgtggccaccgcacttgcccaatacgccgccccggcatatccagctcaaaacgcttacgctcaagctgaacacgcgtatgccccaactccgtacaacttcgaatacagcgtaaacgacccacacacatacgacgtgcacagccaatccgagtacagcgacggcaacggttacgtcaagggaacttacagccttttggaagccgacggttccacccgcgtcgtcgaatacaccgccgatgaccacagcggtttcaacgctgaagttaagaaaattgaaggacataaccatggttacagtgcacctgccccagcctacaagccagcttactcggcacccgcatactcagcacccgcacactctgcacctgcttactcagctcctgcttactcagctccggcctacaagccagcatactaatttttttagtaatattaccttttttcatcatttttcatattttctttgtgcctttctcaactataaagttcacactgaatcatagtcgttcactttaaacattatcacgttcatatttaaaatatttagcataactactgtattaattttggaaatatatacatacatttactgtacctata

SEQ ID NO: 78291 - DNA, 576 bp, Triticum aestivum
  Clone ID: PAT_TA_78291
catcacccattacaatgccaagaaaagaagccagagaggacagccgcgaatccaatccgaatcccctccaaaaacccaccaaactgcctcccccatctgcaagaacaagagcagcaggagagcatcctagtagggaaaaaaataggagaaaaaaaagaagcccagagagaccagctgaccaagcaaaaaggtagcatctttgtgtcaccaagacaccgccgatcacagaccaaatcccccctcctctggtccatcccgagcgtagagcagcggagatttcttcgatctgtgcttgcgttttttttccgtgtaaagattttgtttttcctttgactgttactagcgttgggttgttgagaagtttcgagaagagtgctgtgtgagtgttgaagagctcaagatggatccggccttgcttgacgacgtcatacgccggcttctggaggtgaagaatctcaagcccggtaagaacgcgcagctgtcggagtcggagattaagcagctctgcgctgccgccaaggagatcttcctttcgcagcccaacctgctggagctcgaggcccccatcaaaatctg

SEQ ID NO: 78292 - DNA, 612 bp, Triticum aestivum
  Clone ID: PAT_TA_78292
ggccaagaaggccacacccaccaatggcgctcctcctctccccgaccgtctccttcctcgtctcccccgctgctccacgctcccgagctctctccactgccgccaatgtctcctacccagcctcaaggctgcaatgcaagaacctgtcctccctacagagccctctgaatgtgactgctacttgtgcttctttcgccgagaagaggccggttcttgtccatgccacggcagacggttctgaggctggtgcggagcagccagaagagccgaaaccggtgaccaagatcgaggacatgccgctcgagtcgaagcagaagatgatcatggagcagagggcgcggatgaagcttgccaagaaactgaggcagcggcgcaagcggcttctccgcaagaggaagcttaggaagaagggcaggtggcctccgtccaagatgaagaagctcaagaatgtatgaacagcatcaatgttgaccggcactctgccttggctctttgtgttgtggatgcccagtgtaccaatttttctgttcacaatctgagacacgatacctacaaaatgtaattctgtttttcacgtaattgaatcttcttacagtctagcctaaaaaaaaa

SEQ ID NO: 78293 - DNA, 600 bp, Triticum aestivum
  Clone ID: PAT_TA_78293
aatgcgcgagtggcgccccccgtgcagcagactgctacatggggttaggaatacaaaaactaattactccctaaattattagcaactagtaggggtttcacggtccttcgtccagcactaatccaccatgagcaaccatctctgatcacagtatgcccctccatcatcgacaaacggcaccagtcttcaaagtcctggtgccacgttctgatgataagatgcattgatccaaggagctgctgctgcttcctctgcatttgcatatctaagggacctccatctctgctgctccaagctcagctgcaatggctgcgagtgccctggaaagcgccttgtcgtccaaacaggttgctgctgtgatggccttgatcgcctgctctgggaggtcgtttccgtgactctggacataggctttgattgccgcatctggtgccgccgacttgccatcgatgaaggatagcatgtacttctgtaacaactaaggtattctgttccagcttatgttccttgccatccacaaatgtagagatacatatgtcaagagaaatatcacaccatcaatgtcagactgaattctttcctgaaaaaaaaaaaaaaaaa

SEQ ID NO: 78294 - DNA, 495 bp, Triticum aestivum
  Clone ID: PAT_TA_78294
tcctccgtcccgtcctccccggccaccacgcccgactcgccgttcgccacagctaccacgcccaagacggacggctggaggaggttccgccggaaaaccaaggtctccgatgggccggagcccgccgtcggacctaggagccccaccgtgtacgactgggtggtgatcagttcgttggaccgctgagctagaacaaatccaatccaatccagcgccaataagcaaccgatagcagagggcatgcggtgcagaggaatctagatagcggtttctttctcgggtctatgaggcagcgtcgtgtgttctgtatacagtatgtttgtgttcttctgtattaggatggtgatgatgatgatcagttcgtggggggttagaagtgggcgccgatgtatcctagtttggcctagccgacaggcgtgttcttcattagttcttggatctggggaagaactctccacatggcatgctcgcacggctgcctgctttgatttctac

SEQ ID NO: 78295 - DNA, 341 bp, Triticum aestivum
  Clone ID: PAT_TA_78295
ctcatattgtggaatggtactgcaccaatgggtcgaataaggtcatttggttgtattacttaatatacaaaaaaaaaggtatagcagatgaaatacagaatgacaattgtaatgcagcattgttgaatgtgagcgtgagcggtgcttttcatctatgacctgctaagtaaggtcctcttagtagcaggtgaactgagataattttttgcttatatacagcataaatgtacgagaagaatagcattttttttgccaatatatgacataattgtacgagaaaaataacattttttgcttatatatacagcataaatgtacgagaaaaaaaaaaaaaaaaaaaa

SEQ ID NO: 78296 - DNA, 695 bp, Triticum aestivum
  Clone ID: PAT_TA_78296
aagatcatgcaatcaatcggattcttggggccagcattttttctaactcaactaagccatgtcgactcgcctgccatggcagttttatgcatggcttgtagccagggaactgatgcattctcgcagtctggtctgtactcaaaccatcaagatataggccctcgatatgcaggtgtattgcttggtctttccaacacggctggggtcttagctggtgtatttggcacagcagcaacaggatacatcttgcagcatggttcttgggataacgtattcgagttatcagtggtgctttacctggtagggactttggtatggaatgtattctcaactggcgagaagattcttgattgaagagtgtacatagtgtgcttacagttcagaagtgaaattcatttcggagcaacaacttaacccctggacacaatacacttcaagataacaaatgtgtcatcgtccagctcagctcttggatgaggcaacatgattctaatgtcaatacatgcaatgccaagcacgagaagtatcaagtcttcacatcccagcacgagaccaggtgaagcatagatgagttgagcgatgcaccccttccggacatgcactgtatattgtgttagcataggtatcatgtacagcatagtagaaagtttcatcatacacagtagtcttttctgacttgtacaattttttcctct

SEQ ID NO: 78297 - DNA, 160 bp, Triticum aestivum
  Clone ID: PAT_TA_78297
ctcctacagtctccttggtcaaacaaatacgatcctcctttggaagatggaacagttccctctgaagagatgaggaatcttgaagttgaggcaaatgatgttttctctgtctaccgtgaccagtattacgaaggtggcatctcttctgtgtatatttggg

SEQ ID NO: 78298 - DNA, 419 bp, Triticum aestivum
  Clone ID: PAT_TA_78298
ctgggctcggtacaatgaagctcagagagttctgactacccgttatttaaacctcttcttgtggaggatctaccaaccaccaaagcagaaggaagttccttcaggggctccatcgatccttagaccccagagaggctggtggattgcctcaattgtctttctaggacagcagcagcagatttatttcatgtctttgttgtataataccaatcttgcctagagtcatcctccacataattactaccattccaagcatccaaacaaggttccattatcaggaagaatgacggtgtactgaaaaaatatcatatcctgaacatagtccggatattctggtatcccaatcgggatttttgttcccagcatttgcagaagataactttggttaggtgcattgatccttcaacttcgacagcttt

SEQ ID NO: 78299 - DNA, 634 bp, Triticum aestivum
  Clone ID: PAT_TA_78299
cttgggttatgttaggttctcagggaatctgttgtcaggacaaataccacccataatttctgcaatgggaaacttcaacttgctccttcttgatgataacttgctctctggtgtcctaccatcagagattagtcaaatgtcacttgttgcgcttaacgtctctaggaacataatttctggtgacattccatccgagattggccagatggtactccttgagacccttgacttgtcttttaacaacttctctaatgaacttccatcaagtctgagccagctctataaactgagtaagttcaatgtttcatacaatccgcttctctctggcaatgttccatctactggccaactctccacctttgacaagcaatcatttcttggaaaccctctcctgtctttccatttcactgaccatgggccccgtttggaatcaaacaatgatgagctctcaacagaatgtacagaaaaggatcctgctaaagaagagacaattgtgctcataatttcatttattgcttttttctttgccacaattgctataagagaacatgaccgcttcatgcatgtgtactataccatgaaatgcacatgtgcaagaaccaagatttatgcacaattgtaacccttgagcttt

SEQ ID NO: 78300 - DNA, 657 bp, Triticum aestivum
  Clone ID: PAT_TA_78300
aggaggctgccagcttcacctcccaggtgatcatcatgaaccaccctggccagatcggcaacggctacgccccagtgctggactgccacacctcccacattgccgtcaagtttgctgagctggtgaccaagattgacagacgatctggtaaggagctggagaaggagcccaagttcctcaagaacggtgatgctggtatggttaagatgatctcccaccaagcccatggttgtggagaccttctctgagtaccctcctcttggtcgttttgccgtgcgtgacatgaggcaaacggtggctgttggcgtcatcaagaacgtggagaagaaggacccaaccggtgccaaggtgaccaaggctgccgccaagaagaaatgatcctcgttcaagtggtggtttgcgtgtctgcatttaagatatctagcttttactaattcgttaagttttgtgcacggccatggcactcgttgcattgaccgttattatcatatgcccgctgtgtgcactgtgtcgtttaaaactctctattttctgttcggtttaaacttgttctgagcctgattattgcccttcggctgttgtggaatgcgagtatttacattgctaattcctatgtctttattttggcttgtggcatgcgcttgttctgctgctatt

SEQ ID NO: 78301 - DNA, 250 bp, Triticum aestivum
  Clone ID: PAT_TA_78301
gccagggtgcagtcgccggtggccgacgtccaggcgctcaaggagcaggggatcgagttcgctgccaaaatctaagctcttggacaggtgtaaaaagagagagagagaatggtgtcaattttagctgatttcttggcaattttactttgagcttttgcttcgttgtactgtactgtacttcagaatagatgatagtctcctccctaataatttggccttctgatgtgaccaccgggcgatgacaatccta

SEQ ID NO: 78302 - DNA, 451 bp, Triticum aestivum
  Clone ID: PAT_TA_78302
cggaagcaatgcgaggatcctgccccggcggaggcgcctcggcgtccttggccccaagcttcaacggcttccgagccatgatctgtcgcaggccggcaacagtaaattgtacgagccggatcggcatttccttcatccaaacagccaaaacggggccgttccgcgcaggcgacagggctacgggaggaatttgctatgctagccaggcggttgaattgctgcccactttgtgccctgaaatcgtggtccgagacgcacggctcgaggactgctgggaagtggctgacactcactgcagctcgttctttcctggttacaagttcccgttggaccttgttctccggattgatcgttacattgctctcctgtctggattttcagatccgcccgggtgcatgaagacttgccttgtggccggcaattctaattctgtaaataatactttcaccat

SEQ ID NO: 78303 - DNA, 606 bp, Triticum aestivum
  Clone ID: PAT_TA_78303
cctacagcaactacagccagttgcggtactctgaggcggtgaacgtgattgggttcgtgtactcggtgctccagttctttgtgctcgcagatctcatgaggaggaacaagcatttgaatccgcggcgcaaaggagattacttcgacttcttcatggatcaggtgctggcataccttctgatatcttcgtcgtcatcagcaactgcacgagtaggcgattggatcgacaactggggaagcgaccctttcccgaagatggcgaacagctccatcgccatttcattcatggcattcttggtttttgctatcagtgccctcatctctgcttacaatctcttccggcgagatatttagctgctcttagcagcaaccagcatgttacctttttcctatcttagactaagtttttcggtgcagccattcttgtgttgcacatgtatatgtaatcatgggccaaccattggagttcagtcttcagagaaaaaaaaggaacaacttctaggttatatccaatatatattggcttgttgcacgtttctgtgatgaacaacttctaggttataaaaagaacaacttaatgctgaaaaaaaaaaaaaaaaaaaaaaaa

SEQ ID NO: 78304 - DNA, 621 bp, Triticum aestivum
  Clone ID: PAT_TA_78304
atgcttgtgaaacaccaagcgagcaagttcacaacaagcttaaacctgcaggcagcaaatgcttgtgcaacaccaagtgagtgagtagatgcagtaccttactatacatttttccaattttgttctacacatgttgctgcaatatttacaaatttaatagtctggaagaacaagtggttagtacaaaatttatagcattgatttcttggtgaaattttacaagacatacatccatgccaccatgctgatcagttctacacctagagtgttcttcgccatgagctgggaaacaatataaaccattcttactgaaaactattttctttttacagtaacttggtgatagactgtagagagtggagctatgagtatagctaggcgctcagtatatgcaattttgtgaacttgtctgtctagtacattgactaaatacttcattctttttagtgaaatttggtgcctgtacactacagtgtaagaaaattatgatttttgccatgtgtagatatttgaggaattggatccagcatgtactgaaggaaaagttcgtaacaataaaaaattggattgctctacctaaggtgaagatgccacttttttctgcaattatttttcttattc

SEQ ID NO: 78305 - DNA, 283 bp, Triticum aestivum
  Clone ID: PAT_TA_78305
ctgtgtaccagcactgaggacagcctgcagacaaatccaataattggtcgcattgaccggaagtcagggcatggagctggcaggccaactcaaaaattgattgatgaagctgcagacagatatagctttatggcaaagatgttaggggcatcgtggactgaatagtttattttgtccagcttattgtggagatggtgagcaagattacgctatgcagtcaaagtaaagtggcagggaaagttacattgcttatgttttgctcttagcttggattatcaccaac

SEQ ID NO: 78306 - DNA, 631 bp, Triticum aestivum
  Clone ID: PAT_TA_78306
ctaaaaatgactgaagctaagtgctaataaatcattttattcaaattgcttagttgagaaaaactttacttacagaaatctctgaagctgggtatttgtgattttagtgatcctttcaaaccatcatatactttatcttaataactgaagtcaaaccgtgttgcagcttcttcgaaccggacaccaacagtaaggagctacaacatcgacaaatcattcttatgactccgaaggttatctctggttttaaattcaaattcacatatatcttatcccctaatttaattactttttaagaaacaaatggatttaaaaatatggcagcagacaaaagacattgctaaaagaaattttatatggacaatcacacatggttcagattaatcagcatggcctttttttgttacttcacattgatctatgcaatagtgatggatgcagcaggttcatttttttatgtttaccatgcttgtagacctcagatagtgttttgtttatgttctttctatattcttgtctttactagcttttgtcctttgtccatagctggtccttctgatcgttggcacccaggagcagcagtaaacttcatttgcttcatgcatgataccacacctgtgcttttgctgat

SEQ ID NO: 78307 - DNA, 324 bp, Triticum aestivum
  Clone ID: PAT_TA_78307
atttctcaccatcggaaacatacctgccatgtgcaggtaagcgatttctatggagatttgggtacaaaaggaaattgcaggtttcaagacattgctggaaccctacaacaaaaacaggaacataataacacgaactggaaaccactgaatctccaaacaggctccatggtagggtaggtagtactgacatcaagccatccttgttacaagcaccatccatggcttggctcaaccaaaaaagagaaagagaaaattacatataatatactatacgaccaacctccgggtaactgactgaacgaccactgatcctcctgccgaatt

SEQ ID NO: 78308 - DNA, 514 bp, Triticum aestivum
  Clone ID: PAT_TA_78308
ttgtccctgttgccgggtatcactggtttgatggagacgggatgattcatgccatgcgtattaaagatggaaaagctacctatgtatcaagatatgtgaagactgctcgcctcaaacaagaagagtattttggtggagctaagtttatgaagattggagacctgaagggattttttggattgtttatggtccaaatgcagcaactccggaaaaaattcaaagtcttggattttacctatggatttgggacagctaatactgcacttatatatcatcatggtaaactcatggccttgtcagaagcagataagccatatgttgttaaggtccttgaagatggagacttgcagactcttggcttgttggattatgacaacgggttgaaacattctttcaccgcccatccaaaggttgacccttttacagatgaaatgttcacatttggatattcacacgaacctccatactgtacataccgtgggattaccaaagaaggagctatgcttgatcctgt

SEQ ID NO: 78309 - DNA, 312 bp, Triticum aestivum
  Clone ID: PAT_TA_78309
ggggcaatttaatgatgtattcataagaaaatgattatgtacatatatgatgagccagaacagacttgaagctaagggtaatatactttagaacttcaaaaccttgtttaattcgatagcggatgatggcttaagacttttcagataatgatcagtgctctccctcaaacgtgattcctcagcgaaccttgggtagataaggaattctgttttagtgttaaactttctgtttgtaaaatctaaattatgagagaatggatttctcccttggggatcgagcacattacataagggtttagcatttaggacttc

SEQ ID NO: 78310 - DNA, 385 bp, Triticum aestivum
  Clone ID: PAT_TA_78310
ccgactgttctcgaagaagatccggtaccaggtccggaaggtgaacgcagactgccggcctcggatgaagggaaggtttgttaggagcccatctcttcttcaacaagtcctggaggaagagagctagacagagtgacagacagtgatacttgctagccttttttatgagcaccctttttggccttttagttcctcattagctaagagatgtgatgagtgaggttttattttttggctttgtttggagttttgctttggaggaagatagagaagcctttagaatgagttgtgatggaggatcacatagtttgtctcaggtttacaatgtgcggtaaaaaaaaggaaggaaataaagtgatgttagaataaaaaaaaaaaaaaaaaa

SEQ ID NO: 78311 - DNA, 357 bp, Triticum aestivum
  Clone ID: PAT_TA_78311
gctcgcggagagaagaagggattccagtggagcacgcgatttcccatctgctcgatcccctcctcctcctagggtttcctgctcctccgcccgcctcgccttgctgctgccgttgttggtgcgatggctctcacttcggctcaacggattgctctcactgtctctttctttggccttctctccttcttacttggtgtcatcgcagaaaacaagaagcctccttatggaactcctatcaaaggaaaggatgttgtcatctgcaagttcccaagtgacccaactattgcaatgggaagcctctccgtgatgtcacttgggttaaccaccatcgtagggcatgccgctatcttctatcca

SEQ ID NO: 78312 - DNA, 687 bp, Triticum aestivum
  Clone ID: PAT_TA_78312
aggtgggtatttctatatagtgcagcacctggaagcatgggatatctctaagaacacttcttcgtagaagtgagaatattcagggtccatgcctattgattgtcggagatatgcaaggggctgtgtttggtggcttattgaacagtcctctgcggccaacagagaaaaggaaatatcagggaacaaaccagacgtttgtgttcacaacgatacatggtgaacctagacttttcagaccaacgggtgcaaacagattctattatttgtgcttgaatgatgctttagcatttggaggtggtggaagcttcgcattgtgtgttgatgaagatctcagtggatcatgtgagacatttggaaactcatgcttggcacatagtccagagtttgaactaaagaatgtggagctatggggattcacgcattcatggaaccgttcgacataactgatgctagctgtcctcatttatgacctggcaacagatggaaaggggcatgagaaggctagttggaattgctaaagggtattcacttaatcacttgggaaatgtttagtctcattctattgtttggcttgtggagggaattaagtatgggagctgtatagggaattcatgtcctttgtttggggagtgagatttggagtggaaaatcgtgtcatgactaatgagtcatgatacatacatgttc

SEQ ID NO: 78313 - DNA, 574 bp, Triticum aestivum
  Clone ID: PAT_TA_78313
cccccttgcaattatcagaaatatgtttcgggtatgatcctagtagatatgcaggcagagatgaggatgtcagtgacatggaagccgattttgctactatagaaatggaagagaagagaagcgcgaggattgctaggcaggaggatgaggaggaacttcgcttgattgaggaagaagagagacgcgagcaggagaggaagaggcgaaagatggcacgaggccgatagtccaatactcaacatatttggatgttacaacttcacaggcctgattgcccgaggacaaggccatggtcgatcagacagctcttctcttgcattcctggttacccttgagcgttgcagacaacatcaaaccttagcacgttgattatctggaggcaaatcaaggaaaacagcaggtgagcaacgctgggcacacaacagaagcagaatgttagtcgtagtggtttagttctcgaagctgacatggaccgtatttaagctctcgtcagattgtttggataacacaaggctcccaacggtgcagcgcctcggcggattgtttcttctaaattctaattataggactgatt

SEQ ID NO: 78314 - DNA, 170 bp, Triticum aestivum
  Clone ID: PAT_TA_78314
tgagggatcgtgtggttacagggctactgcaagcatccctggatggcttacttcatgtgatactggatggaggttctacacgtgtcttctctccaaacgatgcaccttttttggaggaagatcttgaaaccctgaaggaattttttatttctggaggatatggactgcct

SEQ ID NO: 78315 - DNA, 287 bp, Triticum aestivum
  Clone ID: PAT_TA_78315
ctgcaagttctgctcgagcaagtagaggaagagaagcagcggctgactccagtgagggatcagggtgttaccttaactaggaaaacggaggatcaggcgaatgccagctagaacaccttgattctgtaattagctagctctcctgcactgttagatagcttgaattaagaactagcggtggatgtggatcgtacgtcatacgaatgaccagctaatgtcttccatgtttgtgcatcattctgaaataaaaatagttggtaattctgcttaaaaaaaaaaaaaaaaaa

SEQ ID NO: 78316 - DNA, 411 bp, Triticum aestivum
  Clone ID: PAT_TA_78316
tagcgccctcgatttagtgatcatcttgaagcaatcaaatttatctgcaaagacttttggtcggagctgttcaagaaacagattgacaatctgaaaacaaatcatagggtgatgcagaaataactcctacctgtttttccttcttgttaaagactgacatctcttgactactgtacatgcagggtacctttgtccttcaagataaccgttttcggtggcttactcgtgtttctctagatccatatacagagaacacagactcaactgaaaatgattctgcagcattgggtgatactgcagcccaaacaacaaccatgcttctgtatttcccatgcgggttgataagaggtgccttgaccaacttaggaattccgagatctgtctctgctgacatgtcaaaccttccaacat

SEQ ID NO: 78317 - DNA, 285 bp, Triticum aestivum
  Clone ID: PAT_TA_78317
tgtctctctagggtttcgatgccatgcttctctccttccctttcccctcgtgtgcagtgtgctaggtggcagtagttgcaaacttgtgcctgctttgtaaattgtgcttgatcataatgggcagcttggatttgaagtaatatacgtgtcgagtgttatttattgtccgtggctgattcacatcttgcgcttttcttttctctttgcgattgcgatttggggatctagggtttgaggagatgatgctgcgaggtgggcagctgggtggcttggcctctcggatgg

SEQ ID NO: 78318 - DNA, 414 bp, Triticum aestivum
  Clone ID: PAT_TA_78318
ttccagcccattcgtttaattagggacgagcagaggtcactctctgttggaagccagtcagatcctaatgacacagattcttccctatcattgccgtttccacagatatcagaaaggcatgctacaatcacatgcaagaataaggctttctatctgactgatcatgggagtgaacatggtacctggattaccgacaatgaaggtagacgttaccgtgtgccaccaaacttcccagttcgtttccatccctccgatgtcattgagtttggttctgataagaaggctatgttccgggtgaaggtgctgaacacgctcccatatgaatccgcaagaagtgggaagcagcaggggcagcaacaacagcaagtccttcaggcggcatgaatggaaacaccggagaccactcctatcatc

SEQ ID NO: 78319 - DNA, 550 bp, Triticum aestivum
  Clone ID: PAT_TA_78319
tggacctgatgactgctctgcagcttgtgatgaagaagtcaagcgctcatgatgggctcgtgaaggggctccgtgaggcggccaaggccattgagaagcatgccgctcagctttgcgtgcttgctgaggactgtgaccagcctgattatgtcaagttggtcaaggcactctgcgctgagcacagtgttcacctcgttaccgtgcctagtgctaaaactcttggcgagtgggcagggctttgcaagattgattctgagggcaaggcgaggaaggtcgtaggctgctcctgcgtcgttgtcaaggacttcggtgaagagtcagagggcctcaacatagtccaggactatgtcaagtcccactagatatagcgttcctgatatccagaacttgtgcttgacattgtgtactttcctttatattttgcttggttctgtggcttgctaggagataagaaaatttttgtggtgtgagccaaggggatatgagcaatttggacctctgaactttatgtttactgtgctggatcagctggttatttatctgaaatcat

SEQ ID NO: 78320 - DNA, 409 bp, Triticum aestivum
  Clone ID: PAT_TA_78320
taagtgactctagatcagtgttggtttcgagcgatagcactgaggtccagctggctgtggatggggtggacatccgtcctgttggcgatgctgagtggggtggcttccagcagtcagaagctctgatcgctgatgttcgcgaggtctccccagaggcagatggtggcagcttggatattcccgtggtcaaccccccaccagtcagtgatcatattcagggaggcgcaacccatccctgaaggcctgatgaggttgctgctggcctgccgctaccttccgagattcatgtgattgttgagaaaccgatatagggatgtctaaatctggagagaattgccgctgagggtgtattgcatcaatgcggattgtatgtcctttgtatttaagtatacgactgaataaacagata

SEQ ID NO: 78321 - DNA, 369 bp, Triticum aestivum
  Clone ID: PAT_TA_78321
tgattctgtgtttttattttgtattatcaaatcttaatttacagcataagtaatcatggtcaactttcgtgaagaagatgataaatctccagtgaactccatcaatgataattcaaccatcgttttgattaatgagatgtctaatttgttgcaagttgatcttgacttggaattgatgacaatttgtcagaggatggtggagagaggaatcaatcctaaattgttggaccaatcaattaaggaaattaaaaaacaaggctgattgaaaacaaaagcttattgggaccaaaaaatgccagtaacagctgaatctttcaagagacaatgataaggaatcaatgagattatctaatctcttatctaaatatc

SEQ ID NO: 78322 - DNA, 353 bp, Triticum aestivum
  Clone ID: PAT_TA_78322
atcatagttgcaccatatgggtctgacaactgcagggtctattggggcaatgacagctgccactttagatgatagtgttttacgagttcaggccattgcagatgcggcacttggggttaatcctgatattattgttctctgtcatggaggccccatatctggaccccaagaggctgagttcatcttgaagaatactaaaagggttcatggattttatggtgcatcgagcatggaaagattaccagtacagcaagctataaccaacaccgtgagagagtacaaaagaatttccttaaaatgataatcattgttcacaggatgtgatttgctgcctgctgttctttccatacact

SEQ ID NO: 78323 - DNA, 361 bp, Triticum aestivum
  Clone ID: PAT_TA_78323
atcattcccttacaagtggatcaataaaaagtggaaagaaggatttcatgtaacatctatggccactgccggaaatcgctggggtgtagtcatgtcaaggaactcaggattttctactcaggttgtagagttggatttcctgtaccctaacgaaggcatccatcggcgatgggagagtggttacaggataacttccacagcggccaccaatgaccaagctgctttcatcttgagcatgccaaagcggaagccgatggatgagacacaataaactctccgacacctctgccttccctaacgcacatgacaaggagaaatgggccaagaatctctatataacttcaatctgctatggacaaac

SEQ ID NO: 78324 - DNA, 670 bp, Triticum aestivum
  Clone ID: PAT_TA_78324
agtaaaattttggatacatttaatgagccaaatatatttgcaaagctcagctatatctatggacggtaccctcctggtcactgctcaaggccatttgggaactgtacttctggaaattcttcaactgagccatacatagtgggtcacaacatggtattgtctcatgcaaatgtggtcagcatttacaaggaaaaatatcaggggaaacaaggtggttatattggaattacagttctctcaagatggtacgaaccattccgaaatatcccaacagatatcttagcagttgatcggggtctatcttttggcgctccatggtttctggaccccataattcttggtgattacccctctccgatgcgcaagatgttgggtccaaacctacctgaattcacatcaaaacaaaagaagatactacaagcatccaagttggatttcattggtttaaatcattattcaacatcctatttgaaggactgtatctcctcatcaccatgtgaattggatccatttgatggggatgcccaaattagtacttcaatagacagagatggaatacttattggtgaaaggacagggtcgccatacttgaatgtcgttccatatgggatggagaaagtggtcatgtatttcaaaaggagatataataacaccccaatgtatatcactg

SEQ ID NO: 78325 - DNA, 313 bp, Triticum aestivum
  Clone ID: PAT_TA_78325
ctggagatatcttttgcttatcacatcaccagagccatcacatatgcagacaaggcggagacacatcgacctcatctactcggatctgatgaaaagttgcaagtacgaagctgcatttacgaagaacgtgatcgagatggggcgtgttagcctggcagtcaattctgctctggcatcatgtcggcccgatctgccccgccgagccgatcaaaaccatgcccacgctctggattgtggagactggagcttgtgccttctgctgcccagcggggtcaacggcaccgaggccaaggacaagtggggcggcagcacc

SEQ ID NO: 78326 - DNA, 180 bp, Triticum aestivum
  Clone ID: PAT_TA_78326
ctgatgatcagcaatatgtacacacgttacacgtacgcgcgtgtgcatgagtattgatcagcagtgtcgtctttgctttgcatgtatgtgattgccttttgtacgtacgtgtggacgtggacctactaacttcttgtttgttgcgcacagacatacacccgggcttggtgtgggaaatta

SEQ ID NO: 78327 - DNA, 523 bp, Triticum aestivum
  Clone ID: PAT_TA_78327
cttccgattcgaacctcccccaatccgcagcagtcgacaggaggccaagctcccgcgatggcccgtaccaagcagaccgcccgcaagtccaccggcggcaaggcgccccgcaagcagctcgccaccaaggcggcgaggaagtcggcgccgaccaccggcggagtgaagaagccccaccgctacaggcccgggaccgtcgccctccgggagatccgcaagtaccagaagagcacggagctgctgatccgcaagctgccgttccagcgcctggtccgcgagatcgcgcagggcttcaagaccgacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgagagggcctaagccgtcctccccgtcaacgccgttagtggatcggaagtggaatgtgttgcttccg

SEQ ID NO: 78328 - DNA, 348 bp, Triticum aestivum
  Clone ID: PAT_TA_78328
ggccttgctgcatatgtcactagccagattgacagctctctttcttggaagtgcaggatatcaagtggctacagacgattacccggttgcctatcttagtgaaaggagtcataacagcagaagatgctcgacttgctattgaatgcggtgttgccggcattattatgtctaaccacgggggccgccagctagactatcttcctgcaaccatcagctgcctggaagaggttgtaagagaagcaaagggtcgtgtgcctgtgttccttgacagcggcatccgccgaggcactgacgtgttcaaggccttggcactgggagcctcaagagtatttattggaaggcctgtac

SEQ ID NO: 78329 - DNA, 652 bp, Triticum aestivum
  Clone ID: PAT_TA_78329
acactcttggtgttggtgagacagtcctcataacaatgggtatatgacaccacccaatttgacaatatactaaagaaactgaaaggcatccgctactcctgctataaaagaatttgaagatgatgtaagcaattcaccagatagtacaccaaaggaagctgaccaacaaacaatgaagttaccaaagttacccgaccccaaggaagatataagaaaagagagagggggaaaagtgtgagcggttattcagcaaaagatcttgaaggcatacttgttcgcaaaagtgatgacaattgcaaagtggaccaggaagttgaaccaacatgctgtgatgaacctgatcccatcatctgtcaagatacagtatcgcaagctgatgatgtgaactggtgggggcataaatttggattcaagtcaggcggctttctaggagcaaaatcacgcaagaacaaatcttctgctacaaaaggtacttcaaatgtccgccagacatttggggaagaagaccaagaaaacctatacaatcttgttcaggacaaagccacatctggaaagcagggtcttggcattaagggtctgccaattaaagttgccggacaccattggaaagggaacaaaacttcttttggtgatagcgatgaggaaaattcaa

SEQ ID NO: 78330 - DNA, 433 bp, Triticum aestivum
  Clone ID: PAT_TA_78330
tttacatcaatatgggtgcatttaacttccagcatagtgactgtcgcgcatgttgatctggactattggagccctttttctcttagattactgattaagcaccaaagcaaatggccattgacagaattcaaccagagtcttggctgaaaatgcttgaacgggaagggaagatccctggtagcatggtggtcatctcatataatggacctttctactattccagctgcacatcctacctgcagtattgaactgccctaagtgtattagtgtggccttcatgaggctctgcccctgtgggtggctgcattattctagcactactgatctggatcttggatggattcacgatttttcgtggaaacagtggcagtgttgaatacctatgaagcctgaaccatgggatgggtggcactggacgtgaacttgtgatgct

SEQ ID NO: 78331 - DNA, 384 bp, Triticum aestivum
  Clone ID: PAT_TA_78331
agttgaggggaaagcattgaaaatgtcatctactgtgccgaagtcatcaaatatcttctggcatgattgtccagttggcaagactgatcgccagaagctactcaagcagaaaggctgtgttgtgtggattaccggccttagtggttcaggtaaaagtacgttggcatgtacattaggtcgggagctccacacaagagggaagcttgcatatgtccttgatggtgataacttaagacatggtctgaacaaggatcttggctttaacgctgaagatcgtgctgaaaatataggagagttggtgaagtagcaaagttattttcagatgcgggccttgtatgtattgcaagtttgatatctccatataggagggaccgtgaatcttgc

SEQ ID NO: 78332 - DNA, 584 bp, Triticum aestivum
  Clone ID: PAT_TA_78332
gactcaaatcgacaatgccgcaaagagggagaatacacagccgtgcttcccctgcagtggttctggcgcgcaggtatgcaggttttgcactggaaagggcattgttactgtagtgcttggtgcaggcgagactgaagagtcacagtgcgtcaactgcgagggcatcggctctttgacatgcactacatgccaaggcactggaatccaaccacgctatcttgaccgcagggagttcaaggatgacgactgatgaaggctttattaccatctttggtagtatgtcaaagatgtaacatcacggtctagtttgaggatttgaggagagcattgcatacgcagaagagatgtacctacataggatccatctgattgttttgtgttgtattatatatgttccagtttggtaaatatagatgacatatgccctccagcagagaagataatgtctcaaatttaagtgctcaacgttttgcgggagatgtaatatattatattcttctgattttgtcatgcaaaattgcaagagtgaacaaaaagactccctccaaatagagggcgcactaagcatcaagcattgggtgcaa

SEQ ID NO: 78333 - DNA, 553 bp, Triticum aestivum
  Clone ID: PAT_TA_78333
cagagcccatagagccccagagccagttcccgttcccgtccatcaaccgtcaaaccaccaccaccacccgcgcccaccactccactccgtccgctctcgcctgctctgcttgctttctctcgcacgctccagcggatggcggaggcggaggcggaggccgcgcccgcagcagcagccggcggcggcggcatcggggacatcctcgccaccgccgagcgggacttcctcgtccgcaactccggtgagcaggtgaagatcagcagcatcgaggcgagccctgtggccatctacttctcggcctcatggtgcccgccatgcaggaggttcacgcccaagcttattgaagtgtacaaagaactggctgaacagggcaagagcttcgaggtcatctttgcttcggctgatcagaatgaggaaggattcaatgaatactttgcaaagatgccatggttggctgtccctttttctgacaccgaaggccgtgcggcccttgatgcccggttcaaggtctctgggatcccacacctgggcatccttgatgcaaaaactgggg

SEQ ID NO: 78334 - DNA, 479 bp, Triticum aestivum
  Clone ID: PAT_TA_78334
ttcacctttgtaaatatttttcgttggtcatctctgtcctttgtactactttttactttgtgaactaactgacagtgtcatgcattgccaggaaatggaggccacttattatgtcaaggtggatgaaaataactgtgcatactttgaccaagtggagaagctaaataattatggtgctcacaacagagatacaatatcaaggctgctctgggcttttttccattattgggcatatgagcacgattacacaagagatgtcatatcaattcgtactggaaggattatcagtaaggaacggaaggactggactagacgagttggaaatgacaggcatctcatatgcattgaagatccatttgagatctcccatgatctcggccgcgtaattgacaagttcagcatcaaaatactcagggaggaattcgagcgagcagctaatatattacaggttgatccgaaccccaacatgacactctttg

SEQ ID NO: 78335 - DNA, 611 bp, Triticum aestivum
  Clone ID: PAT_TA_78335
atgttgtccgaagacaatgcaggttcagagcaagcagcctcaaaattcaagtgatggcttccgtataagaggaactttccagggtctcttattgatcattcgttgccaagggtggagacaactctttgctggtttgagccttaactatgtcaaggttgtcccttcagtagctatcggcttcacaacatatgacatgatgaagacattgctaggggttcctcctagagagagagtccatgcgtcaggtggtaacaaatgaagcaatattggccatccttgtgttatgactgaagaaaatctaggctgtcgcattgttattcttgttatgaatcctattgctatcaccctatgttgcatatgatggagagtattgtatattggtcaaatagttctgtgtctgtaaccgtcggtcgagttgcttgtaccatccattatgctacttgtaatttgtaatcatgaatacaatgatggtaccagagttgccctacattaacaatattagtagtgcccttattggagattctggtgtttatgtcatcaaatgtgcctgaagatattttatatatcaaatgctagcaaagacgaagatgaagccttgatggtttctatca

SEQ ID NO: 78336 - DNA, 621 bp, Triticum aestivum
  Clone ID: PAT_TA_78336
agggttccatcttgatgggtgccttgagattattgacaggaaaaaagatatagtaaagcttcagcatggagaatacgtgtctcttggcaaggttgaatcggctctagcaacaagcaattatgtggagaacatcatggtttatgccgatccatttcatagttattgtgttgccctggttgttccggcacaccaggccttggagaagtgggctcaaaattctgggataaactataaaggctttgaagagctttgccaaaatgatcaagcaaataaggaggttcagcaatcactatcaaaggccgcgaaagcagcgaggctcgagaaattcgaggtgccagcgaagatcatgctgttgcctgaaccgtggacaccggagtctgggctggtgacagcggcgcttaaactgaagagggagcagataaagaccaaattcaaagacgatttggacaagctctaccactgaagaagcgacagagggtggttttgcacctatgcgtccagaaagcttgtgttgccaaaagctccctggatgaaactttactgacctgcacgagtggtgtttgtgcgtgtatccttgccgatacacaggagcttgttcttctgtttctgtgaggaaaaata

SEQ ID NO: 78337 - DNA, 402 bp, Triticum aestivum
  Clone ID: PAT_TA_78337
atgctattttgagttccatttgatcaccattgtgttaccttgacataaaatgcccccttttcttttactattttctgtatattaccactgtactttggattgcttctgttattcatatttctgtaggttcataaactatggtacacttctgtactcctgtataaaaatcttgcgatctaaaatgatgatgaataccctatgaaggcacatggaatacaatgttctgtttcaaggatatgcatatgcatgaaatgtcttaaggttaaattacacaaaatgccaggttgtatcgtattgacattggtacagaaccctatatttcttggacttcttataatgactactctggatttgtggacatttgtctataatacttctgttcttgtaccaatataattcatt

SEQ ID NO: 78338 - DNA, 116 bp, Triticum aestivum
  Clone ID: PAT_TA_78338
gccaagcgaagcagatcaaaaggactgccggcggagcagaggtgtcaatcaagtgcatcatgcgtcattccaaaccgccggcgaaactcaccatgcatggctgcggcgttgcctct

SEQ ID NO: 78339 - DNA, 655 bp, Triticum aestivum
  Clone ID: PAT_TA_78339
acgccaaagctgcgccagtgcttgttggccgctcttggacagctcacggtcgaccatggcatgccaccagcttctgattcctgggtcatggagaatgttgtggagcctgcgttgcaagagctgtctgctaatcagctcgatcagcctgtttcccaggaagtcttcttccaagaattcaggaaatttctgggcatcatggctctaagactgcaacagcaccctgtgatcgtcgcccatacagagaacacctttgacgggagtggtatcaggaggctactgtcgaacaagttcgaattagacaagctgctggattctgtatggagagacgttccgaaagaacacaaagataaaacgtcgaaggagtacctccggattgcgcttgataggattgccgattcagcgagtctgccaccttttggagccgtcgatcaggttgatgctgtggtgaacgaagcattcaagatggcgaaagctgacgaaatgaaggcggtggacgaagcagagttcaagaagctgctgacggagattcttggggccatcatgctgcagttggacggcaacccgatcggtgtctcaaccaacaccgtcgtccatgagcccatgtccacctcctccgcgctgttgtcaccgacgccgctgtctccaatggtgtcct

SEQ ID NO: 78340 - DNA, 299 bp, Triticum aestivum
  Clone ID: PAT_TA_78340
ttttttttttttttttttggaagagaagaagaaattctgttgtggtgttatgattctcatgacatattctctgaaaaaaatactgcgtacaaggtattctgcggtgacagcagtcaggaacttctgatgacttcctgtggaaaattaaaaaacgtagcaccaccacacccaaggcattcgtgtaaccaaaaactgttttcttgttttgtgcgtgtgggcaaccaatccacagaccacccccacacacacaccacctccaccaaaaataaatcatcgttttctagagttattcttccagt

SEQ ID NO: 78341 - DNA, 426 bp, Triticum aestivum
  Clone ID: PAT_TA_78341
ctgatcagctgtaccacctgttggtcttcctcctcgctcttcttcttgctggttgccaggagctgaggatcgagagtgcttctgttgttcgcgcggcgaggcggcggcggcggcggcggcagcagtgggcggccggagaccgattgatcagaaggaatgtcgtcggcccaaatcgcgccggcagatcatgtgtgctatgtgcactgcaacttctgcaacacagttctcgcggtgagtgtcccggggaatagcatgctcaacatcgtgacagttcggtgtggacactgcacaaatctactgtcagtaaacctgagagcactgatgcactcactcccagaacaagatcagctccaggagaatatcaagggccatggcggcaatggcaccttgcatgatcagggcgggcatttggagctcgggtcttct

SEQ ID NO: 78342 - DNA, 407 bp, Triticum aestivum
  Clone ID: PAT_TA_78342
gcccgttcaggatccacatccttcccgagcgagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggacattcaactccagggtgatcagaggaagaacggctctaatttcctt

SEQ ID NO: 78343 - DNA, 335 bp, Triticum aestivum
  Clone ID: PAT_TA_78343
ggcccgtgcctgcactgcgcagcagcgatgagggactgggcgccggcgatcatcgcgacggcgctgttcgcgctcctgtgcccgggcggcgtccttcagatgccaggccggcagcggcccgtcgacctcatgaacatgaagaccagcttcccgtccatgctcgtccatgccatcatctacttcctgctgctcatgctcttcatcggcatcctgcagcctcatctctacatctgatgtgagcgtacatgtgtttcccgccttgcagaggctcctagcatgttttaatttcttggggatgtaggttgggcctttattagctttgtaactttacggat

SEQ ID NO: 78344 - DNA, 529 bp, Triticum aestivum
  Clone ID: PAT_TA_78344
ttgccgcctcccaccagcaaattcgcaatccgccgcttcccacctcgcgttcgccgctccatttgatcgtttccccatggcgcccaaggccgagaagaagcccgcggagaagaagccggcggaggagaaggccgagaagaagcccagggcggagaagcgcgtccccggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctcgccgccgaggccgccaagctcgcccgctacaacaagaagcccaccatcacctcccgggagatccagacctcggtgcgcctcgtccttcccggcgagctcgccaagcacgccgtttccgagggcaccaaggctgttaccaagtttacttcctcttagggtgctgctgcacggggctacgggcttggttccgttcct

SEQ ID NO: 78345 - DNA, 366 bp, Triticum aestivum
  Clone ID: PAT_TA_78345
ttagttctgccctctgttcatggtcaataatttcacatggcacatgtagaaattttcatccttgttgttactaatccatccagattttaaacaataactaagtcaaggaagcagcgtagacttaacgatacatgtgcttcgcactttccatgctatgcttgtcaagagtagaaaggaaagctgcttctttttttaatggaagctcacaatgccatatgtgccatggttgtctagcaatgaagcaacatatgagaggaaaagtttatctgtcatcctgcactttgcgcaattctcgcttccaaaaaaaaccagaaaatctccactagggtcactcacctactcatgataggtaatagaacaagatat

SEQ ID NO: 78346 - DNA, 339 bp, Triticum aestivum
  Clone ID: PAT_TA_78346
ctggatgatgtcttccagcgccctgagagtgtggagtgtgtgcagaaggtgaacaggatcgccgagaagtattgggatctatactcgagcgacgacctggagcaggatctcccaggccacctcctcatgtacccaatcggtgtcactgccgacggcaccgttactgagcttccggggatggagaacttccctgacacccgtgcccgtgtcctcggcaacaagtcggattaccttccacccatcctcaccacatagagtgcagactgcaggtagcgccgtggctcctctcctgtctggcctcaactttggtgtccctgtgtttgtgttcgagacactgaa

SEQ ID NO: 78347 - DNA, 391 bp, Triticum aestivum
  Clone ID: PAT_TA_78347
tacaaaatgctgcgcatcgaggggcaggagtcgatgggctctgtaaattttcgactagccgaacagcttaaggtcaatgccctgactttccggccaacagggtatttgagctttgatatttccatgggtcgagagatcatgccggttgcactgtacaatgatgttgatgatgatcgtgacccacttttatttgagtatctggcgcggccaatatttccgtcctctgcagtccaagggaagtttgctgagggtggtggcgggtgtgagtgcactgagaattgctcaattggatgttactgtgcacagaggaatggcggtgagtttgcatatgacaagctcggtgctcttttacggggcaaaccactggtatatgagtgtgggccatattgcc

SEQ ID NO: 78348 - DNA, 582 bp, Triticum aestivum
  Clone ID: PAT_TA_78348
ttcgatggcttcagatttgatggtgtaacgtctatgttataccattctcgaggtgctggtcaaggattcagtggacattatgatgaatattttggtcttaatgttgatacagatgcattgatttatttgatgttagcaaactatatgctccataaattttatcccaattgcataacaatagctgaagatgtgtctggaatgccttcatcatgccgacctgtaagtgaaggaggacttggatttgattatcgtctaggaatggctatacctgatatgtggattaagctactaaaggacgttcaatatgatgattggaatatgggaaatattgtacatacacttacaaatcgaagatggatggaaaaaacagtagcctatgctgaatctcatgaccaggctcttgttggagataaaacagttgcattttggttaatggataaagaaatgtatacacacatggctgtctcaagtgatccatctttaattattgatcgtggaatagcattacacaaaatgattcggataatcaccaatagtcttggtggtgaagcatatttaaattttattggtaatgaatttgga

SEQ ID NO: 78349 - DNA, 644 bp, Triticum aestivum
  Clone ID: PAT_TA_78349
aagtgcaacttaatgactgacatccgagtatcaaatgctttgctctctatgtatggtaggagtggttttgtttcagaagtcgaggctgtgcttggcaagattgaaaatcctgatcttgttagctggacagctgccatttctgcgaacttccagaatggtttcagtgagaaggccgtagcattgcttcttcagatgcattcggaaggttttacaccgaatgactatgccttctctagtggtctgagttcttgtgcagacctggcattgctggatcaaggaaggcagcttcattgcctggcactgaaactggggtgtgacttcaaagtttgtactgggaatgcactaatcaacatgtactccaagtgtggtcaaattggatctgcaaggcttgcatttgatgtcatgaatcttcatgatgtcatgtcttggaactcactgatccatggtctcgcacagcatggagctgcaaacttggtactggaggcattcagtgagatgtgttcaagtggttggcagccagacgattcgacatttatagcagtcttggtagggtgcaatcatgcaggtctggtgaaggaaggggagacattcttcagactaatgactgatcggtatggtctcacaccgaccccttctcactatgc

SEQ ID NO: 78350 - DNA, 611 bp, Triticum aestivum
  Clone ID: PAT_TA_78350
cgaggggtggatgtatgtggagccgctccccatccccttgaccgtgccagggaccgagcccatgtcgcgggaggagctgaaccgccggcttagctgcgacgtcaagatcgaggattgcaagacggtttcgtacgagtggacgggcaagtgccggagctgccaggggacggggctggtcagctatttcaggaaaaagggcaaggagaccatctgcaagtgtgtgccatgcgccggcattggttatgtgaggaaaatcacatatcgtgaggacattcaaaatattgacgagctagacaatggcaaactaccatagtttgaaaggtctgaagtcattcggctgctgtaattttctaactgctgccgtatagcttgtgctcgcaacctacaaattgaccaatgattctttctaccgcacattctactgttcagacacgatacatgaaggggttgttctttaagcattgtaaactttgtgttaaaaaaaaagcattgtaaacttagcaatttggcctaggaattgtgccccttttacctttgttgtttgctgacagatatgataacgatcggtacagaaaagaaaataataattttcaatgggattcttttctcgg

SEQ ID NO: 78351 - DNA, 682 bp, Triticum aestivum
  Clone ID: PAT_TA_78351
gcacgaggcagaagctctgaggagaatgaaagaatcacttcaaaataaggaatgggttgccaaatttgagaaaccaaagggtgacccctctgcctttctgaaaccttccacaactgtcttgtcaccatatctgaagtttgggtgcctgtcttccagatatttttaccactgcattcaggatgtgtacaagagcgtcagaaaccatacaaaaccacctgtttcattgataggacagctgctgtggcgagacttcttctacacagtgtcttatggaactcctaattttgaccgaatgaaaggaaacaaaatatgcaagcagattccatggagcgagaacgaggagctatttgttgcatggagagatggccaaacaggatatccatggatcgatgctatcatgattcagctaaggaagtggggctggatgcatcaccttgcacgccattcggttgcttgttttttgacacgcggtgatatggtatcgaataagaactctgttgggaattatttacattgaaatctcctttacagaatatgtatgttggtaattgtaaattttgcacttttggcaactttcgagttctagttaagcaagaaggtaatcaataagaactgtttgttttgctagatgagtctcttcaaaaatatggctattgggttgttttgatgagctaattagtgg

SEQ ID NO: 78352 - DNA, 594 bp, Triticum aestivum
  Clone ID: PAT_TA_78352
gcacgaggcacagtcatcaaccacacacactcacacacgtctcaaactgacggcgacgatggctgtggtgagcaggaagacgtcgacgatggtggcagcagtggccgtggtggtggcgctgctgctggcgtcggcgtcgtctgcgtcggcggcgatcacctgcggtcaggtggggacggcgctggcgccgtgcatcccgtacgcgacggggagggcgagcgcgctgccgtcgtcgtgctgcagcggcgtgcgcagcctgaacgggcaggcgcgcagcatctcggaccggcaggcggcgtgccggtgcctcaagagcctcgccaacagcgtcaagagcgtcaacatgggcaccgtcgccaccatccccggcaagtgcggcgtctccgtgcctttccccatcagcatgtccaccgactgcaacaaggtcagctaaatgatgaaatctaccacgtaagtacataccagtgcacgtgatgaagctagcaagccaggaaaaataaaataaagttgtgtggtaacatacaggaggattaatagcatgctgtatctatatagtattatgtaaccgtgtgcatcatgcactgtgcacatata

SEQ ID NO: 78353 - DNA, 476 bp, Triticum aestivum
  Clone ID: PAT_TA_78353
tgacgtgcctggcgctggtggcggacgagaccgcggcggcgcacttcctgctctggggcggcgagtgcggcgcgttcgagcctggcgacatcgtgcggctcacggacggcatcttctcgtaccacagggggaacgccctggtgctgcgggcgggccgccgcgggcgcgccgagaaggtgggcgagctcaccatgctcttcgtggagacgcccaacatgagcgagctccagtgggggcccgaccccaatgacggccggaggatggtgcaggaggccgtcgtctcgccttactcccagatcttcaagccgctgcggtgatcgtacttccagttgcgtccgtcttgactcgtggcctttgccgttctttgtcaaagccgggatgacatgtaccctgttctcaatcttttttcatgtgcgctataacttctgaaacataatactaggagtatgaactttcgatcaaaaaaaaaaaaaaaa

SEQ ID NO: 78354 - DNA, 516 bp, Triticum aestivum
  Clone ID: PAT_TA_78354
attcaactcgtatgtaaacttgctcataagtgctctaccagggtcagtggatgatgaagttaacttggaaggtttagggaataagattgttagaatggcagagacagaggaccaacagttagctttgttagctaatgcatctttactagctgaagagttgctaccaagagcagctatgaagctgtactctatgaatccggtcagcatggataggttgcatagaagaggtcctgaaaaacaaaatcgtgcagcagagcagcgagaatggaaacggaagctgcaccgcatggtacacaaaattatagataggcactgcagacagcatgctctagatcttatattcacagaagaaggtgacacccatctgagcccagaaatgtacatcaatatggataataccgctgaagatccagaatgggttccatcgccgattttccaggaattgtatgcaaaattaaataacatggcaagtgttgcaccacacatgtttgttggcagggagaggctttctaccct

SEQ ID NO: 78355 - DNA, 649 bp, Triticum aestivum
  Clone ID: PAT_TA_78355
cctgcgttgcctcctctcgggatccacgggcgctccacgaaaccctaactgcgtcttcctcgtcggtggcggcaacagcggcggctcagctcgacttcataaacacagctagatacctctctagagattggcctgtgctgaaaggccagccgccagtgtagtcgaagatgtcaacttgggggataccttgctaaagtactgaaggtttgcaatattggatatatttacgactactacagaaatatatgcaaaaaaaaggattctgcctaggttagtggaggacttggcggacggtagcattgactaaaatttgcccaattttgcctagttgtatatctcattgaatgacaacccaacctactgagctctgttcaagctgtcaaacttgcaacatcttctcctatcgaccaacggtgatgccaccatactaaaaattaatgactttgggtttgccaagttatgggcagatagaagggtttgtttgctgttggaattctgtacagtgtacagatcctatctcctacagtgcatcaaacaaaaaaagggtgacgatgtaaagggttaatgaagatgggagatgcagaggtgtcagtccgtgtgtatgataaggcgaacttccttggcccatttttttttcagataatggctt

SEQ ID NO: 78356 - DNA, 693 bp, Triticum aestivum
  Clone ID: PAT_TA_78356
gcacgaggctgatcactttcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccggagagccagccaagctcatcaggcagcggtaccgggaggctgcagacatgatcaag

SEQ ID NO: 78357 - DNA, 621 bp, Triticum aestivum
  Clone ID: PAT_TA_78357
tctaagtctaagaaatactagctatgctggtgagcccccatcggagatagggaagctaaaacttttgcagacattagacctatggggaactgatatagaagaattgccatcaagtattattgggctaagaagactgatgtttctggctcttaattggcgtatctgtctgccaaatggattgaagaatctaacatccttagaagtgctacagtatgcaattgttgattctgcgcagattgcagaagagctaggccatttgatgcaactgaggatcctcagagtcgggctgtgtaaaaaggacacggaagcaggatattatgagggcatttgcaaagctttagtggagtccctaggcaaactgcaaaaaatccaacagctagtagtactaagcccaagtgacgtggtgatgaatcttgaaggctcgctggagtccctaggcaaccagctgtcctatcttcgtattcggaaaacatggatcaatcctggatcgcttctcctcctatcctccctggacataacggtgtctcaggtgcgaacggaggacatccaagtcctcgggatgctacaggctcttcgtgttctacgagtggatgtggctggtgacaacttacaagtgctggg

SEQ ID NO: 78358 - DNA, 477 bp, Triticum aestivum
  Clone ID: PAT_TA_78358
acgcgtgcgctcagggctgggaccgtctggattaactgcttcgacatcttcgatgctgcaattccctttggtgggtacaagatgagcggcattgggagggagaagggcattgacagcctgaagaactacctgcaagtgaaggcagtcgtcacccctatcaagaacgccgcgtggttgtagatgctgcaagtatggccttctggataagaactacggatattcatttcctcatcacatcccgcacaataatatgaaggcgataatcagttagatgacgatgaagaacgagcagctataataagatttgccctttggttgtcagttatatctctaataagccttttggttggtgccatattgtgcaatttggctgcaccctttttcttttggataagactatattgtagcaacggattttgcagagttcattatgaaaaaacatttgttagaagagcaaaaaaaaaaaaaaaaaaaaaa

SEQ ID NO: 78359 - DNA, 627 bp, Triticum aestivum
  Clone ID: PAT_TA_78359
caaggcatctgtcactagtgcagaagtaagccaggatggcaggttcatcactacagctgatggctcaagtgtaaaattctgggatgcaaatcacttcggccttgttaaaagctatgatatgccgtgcaatgtggagtcggcttcacttgaacctaagtctgggagtaaatttgtagctggaggagaagatttgtgggttcatgtattcgatttcttcactggtgaagaaatagcttgtaacaaagggcatcatggtccagtccactgtgtccggtttgcacctggtggtgaatcatatgcatcaggttcggaagatggcaccattcggatctggcagcttagcccggctaattctgatgacaacgaggcggccaatgcaaatggcaagacaactgctggggtgaacgaggttacaaccaagatagaaggcttccacattcccaaggaggggcagaccgaggggtaggacctcatgtgctttgtggtgcttgtggttcttattgcgaggagattgccctcagagctgcggtggttattcagtttctccctgcagagtcatcaacgcctgtttttgatccaagggtatcctggcttcatgagtcatcatcacagctctggggaaaaacc

SEQ ID NO: 78360 - DNA, 622 bp, Triticum aestivum
  Clone ID: PAT_TA_78360
ccacgacacgacgcctcggcgcctcccctaaacctccgcgtcgccattcccccctccagcccgccgcgatggccggaggcggcggcaagccgttcggggacaacgtgttcgccggccacgcggccgcgggagccgcggcgatcagcgcctcagccgtcgccgtccaccccctcgacaccgtcaagagcctcctccagttgagcgcggcggggcagaagcagaagatggggatccgtcatgcggtggaccggctcatgcacgtctccggccctgcaggtctttacagtggcattgggtggtcaatattaggtaaactgcctggtttgggagcacgttttgggacctatgagcttttaacagccttcaataaagatggcagggaggacaaccatgttaattattctgaggcaatgttggctggcataaccgctggtgctgtagaggcatttgtgtgcacaccatttgaacttctcaaacttcggtcccaagttggttctgccatacctatgaaagctacgaaccctgctaatgttatacaggagtcgtttccactgctttccaagctattacctggccatgtccctgacatgagagtatggaatagcagtgttagtctgttgtc

SEQ ID NO: 78361 - DNA, 499 bp, Triticum aestivum
  Clone ID: PAT_TA_78361
gaacactggagcgagtagagatagtaccggcttgttgttgtgtgtgtttgctgtcatctcgacgacgacggtcatggcgaaggcgcaggtggcggcggcgaggttcatgacggaggtggcgccgccgccggtggtgtcggtcatgcggcggaggaagcaggcgccgtggtgcctggacaccatcgccgaggacaccatcgccgagcagctggtggcgtgcgggtcaccatcgtcgacggactacggcttcgcggcggcgtggtcgctcaagaggatgccaccaccgcatgcgcatgcgcagccgcgggagcgcgcggccgggtttgtgggcaagtacttctccgacgcccatggcagccagcagctggtcagccgccggcgagacgtgcatgcgcaggagttgcacaaggtcggagcttgaagacaagagggggagcatagtagcaatataatgagccaagcttgtttgggagaagtatatttttagtttataccactt

SEQ ID NO: 78362 - DNA, 567 bp, Triticum aestivum
  Clone ID: PAT_TA_78362
atatattgatcaaattgctacagctactaaaccacatgtcaagaaaattagaactactctcaagccctatactaaaagagcacgccatgtatatgggcagtttcttgagacagctactacatatcatcagcaggctcaggcaactatctcagattaccttcaccaacatgaatttacaaaacaatttgtaactgaggagttggtgtggtatctggcttctgctttgttggttatgcctgtctttattttgtacacactcctaattgaaatattcggtatcaagaagcaaaagaagaaaacatcacggagcagtaatgccaaccatggtcatcgtagacataagcgccggcatgctgagaaataaaccattgataaacgctgtctttggtgtgccatattatagttgaagaagatcatggaagtttgaccatgttacctttcactgatgagttcgttgtcaggtatagacactttgatccgccatcgctgaaccttgctgtgtatctatgaactacaatacacacaagaactgggtttctgcccccattgtgtgggaagagttgtggt

SEQ ID NO: 78363 - DNA, 634 bp, Triticum aestivum
  Clone ID: PAT_TA_78363
gagggtctattttagaaactcttggaggtgctagttcagagacgggaacaacttgcacccagtgacactaagacagagaaaaaaggatttgatatgaagtggccagatatagcagactgtatcgacagggcaggaagggacattgagagaatgataaaagatgatctattggaagagctggtccttgagctactgttcagttaggtttccacggccggagtaggttttattatagcagtacagataccttgttttttctatatctagtttttttagtcagttgtaattgttcctttggtccctaccttcaatcagtgttcttttttttttctcttcgttattaaagcagtggttgacaggtttttttttggtctagtcgctgtgcttctggtggtattagagacgtgagttctattggattacgggatctctgtaggaaaattctttttacctcgaaaatcaagtactctttgaagtgaggtttgtaagaacagaagtcttttctgtcaagttttgtcggctgtgggagtttcaagtctgtaaatgagggcaaattgtagtccacagacatttgtattgtattgttcttgaaaggaagaataagcggcatgtcctttttggtcaaaaaaaaaaa

SEQ ID NO: 78364 - DNA, 656 bp, Triticum aestivum
  Clone ID: PAT_TA_78364
ccggcacgagggtccgtgacgcaggaaacttttgacagggcaggtttcacccttccaggagttgatgtcgatcagtatactgttaaatacaataatgctttggaacttgttgaacatcttagagcaatgggggaaacaaatgctctttttcaaagaaatcctgtgttgaaaagggataccgccttggcaactgcagcaatttaccagtcaatgtttggtttagaagacggatctattccagcaacctttcaagtaatttacatgactggctggagggagcatccatcacagcaaaaggctaagagaaggggttctgcgaccatatcattcagtgatatacagaaacaatttggtcccagtgaaaactgagcctcactgctacagaaatgtgttctcgaacccttgatctaaaataaagaaacaacactcgaggaaagaaaagaaatcctctggtgactcagcatacggctttgtattcctgaacattgattattgtggtgggcttctgttggctgtgtcaattttctatgggaaatcactcaattcgtatcagtcatgattctgctgcaaatgtcagtgtatggagaaccgatgttgcctgttatatgaacatactgagtttaatggaattcagagcttgtgaaaaaaaaaaaaaa

SEQ ID NO: 78365 - DNA, 349 bp, Triticum aestivum
  Clone ID: PAT_TA_78365
gcacgaggctgcatcattctgctgaacctgaaaccgggctccccggactacgccctcttcgccaacgcctccaagatcacgccatcaactaacccggcgagcgacagcaccgccggaagcggcttcaagcttcaggccggcatccatggcagcgtcgtgctcgccgtgatctctgcgatcgtctcgtcactcttctgatcggtctcgtcaaaggagaagcggcagttttttttaccctgtggattcgttctcttgttccactagtcgatgtttattttgtatccacataaaaaaagaagatccagctgagacctgttttttccgaaaaaaaaaaaaaaaaaaaaaaaaa

SEQ ID NO: 78366 - DNA, 398 bp, Triticum aestivum
  Clone ID: PAT_TA_78366
cgagggttcgatttgcttctgtaaggtgtgatttaatgctaggatgtggaaccaagattatataagtttgtcagtttgaagcttcatttgagtaagccatggaagaatacttcagttgtggctgctttcctaattttctgtcggtatttgtttctctggtggtatcaattatcataaggccttatatgtggttgcgggacattgatttacctggatcttttatttctcagacattgtcttcagtattggattggacacgactttttagcttctgttactggattatgtggtcattcaaatgttgtggtgatttttaattttgttggttcaatagtattgtaatatatttgtatatatatagtatgtatgatgttaaaattaaaaaaaaaaaaaaaaaa

SEQ ID NO: 78367 - DNA, 342 bp, Triticum aestivum
  Clone ID: PAT_TA_78367
ggtgaaggagagggtcgctggccccagcgccgacgccgacgccggcaaggggaagcaccggagggcggacgcagacaagtaccggtcggaggatgagctgtgagagagagacctcgccggcgccggcgttggatgatgtttgcattcagtgtcgaggatgtttccagcgtgtttaaagctctactttttttcacacagatctgtacactctctttagtcttctgtttcagccacgaccatgatgctgttcctgctctgtagtataataatctgttgacgtgtacaaaagcttcccacaaaatttgagttacgtacaacttcttgttatttccaaaaaaaaaa

SEQ ID NO: 78368 - DNA, 695 bp, Triticum aestivum
  Clone ID: PAT_TA_78368
tttttttttttttttttgaaaaatcagcatcaatttggaaagcaaaagaaattaaaagggttaatgtacacgcaaacaataccactactctttacaattagaaaataggtagtacgaataaaaaaactatgataaacggtgaactgattatagttgtacttgattaagtggtctctaatacatctagcggcccacacatgatcccttcagtgtcagcacaaacaatacctttcctcccatcgatctttcatcttctcttttcgttggccattttgtcttttctgtcttggagagctcacatagttccttttttttattgagggagatctacagagatcaatttttctctgttcttccccccactatagtaggtgtacattctccaagaaaagcatcgctgcatgttcaagcagacaaaaaccattccagtgaaagtggttgtggttagtgttccttttagcattcatcgccagtcgccactattttaccagtccttgctactatccatgatgatcttggttgtcaggtggccagtacgggtaaggccattctgtctcttgggggtgagcaattgaagtttcccctttcgtgcttgtggacgacgtgcatcccattatcagttcttccaagccggcagacctgaaatttgtcatggcgatggagaaggattgctggcacatggaactgatcatgat

SEQ ID NO: 78369 - DNA, 735 bp, Triticum aestivum
  Clone ID: PAT_TA_78369
acgagggagttctttttcctcccaatcccgtgcagccggcctcaccaccggcgacgggacgcggagacccggaccgcccctccttccgcactggttctcccttcgtcgcccccgccaaaaccctctccaccagccggggggtcaacagctgctcgagatctggccgggttgcttagactcatctcttcgttcctcggtatggacttccacacactatcgcggcctgagcttcaggtgctgtgcaagcgcaacaacgtccgcgccaacatgaccaacgccgccatggctgaggcgctggagagcctagattttgttgatgggataaactacgagatggcgcccattccaattctggtgccagcgtccacagtcacaacacgcttgactgcaaggaggtccgcgtcgcgtaagacggaaatggttatgttgaacccagttccagccattcttcagaggagccagagaacagcaacgcagaaggctttggatcagaaaccaaaagatgacatcactgaagtgaaagaaagggctgcttctaagataccacaagctaagctgacagatgagacttgtgaagacgacggcctcgatgaagatgactctgctgaggaaattgggtctactgatgaggagaatgacactgttttcaccagtggcttactacaggagtttgacaaggagatggacaccaggcccgaccaggcatttataaagagctgctccaggatcttaaaa

SEQ ID NO: 78370 - DNA, 689 bp, Triticum aestivum
  Clone ID: PAT_TA_78370
ttccaacatttacttcagtggacgatttccttcagaaagtggccacactccgcgggaaattaaaaaaaggtggtatagtggatgttgaagctgctgcaagaattgtacttcatgactggaatgagggtaaaataccctattttacggtaccacctaaaagggatgctgtagacgactccgatgcagtaattatttcagagactgggaaagaatttaacattgatgaaatttacaaagctgagtcatcatatattggtggtctgaaatcactggaggagttccgtcacatcgagattccatctaatgccccaccgcagattgatgaagagatgctagaggatggcaagaagcagaatgaacctgcgcaggaaaaccatgatgagtcgatgtccgatgcaaatgagcgtgaaggagccaagacggccagcgcgagcacacagaacgacaagctgtacacagcagagggaatacttgatcctcgcaagagaaaagccgagaagaagaagcgcaaggcaaacaagttcagcgtgctgaccgacatggatgcagactacgatttcaaggtggattatcaaatgaaggatgccccggccgaagatggcaacgatggtggagatgaggagcccaaggaagctgaccctatgactggtgtcgatgatgcgtgaagtgatggaacctggccaattgag

SEQ ID NO: 78371 - DNA, 553 bp, Triticum aestivum
  Clone ID: PAT_TA_78371
tgagtggaacgtgatgaacaagcataaacctatttggttgaggaagccagaggagatcaccaaggaagagtatgctgcattctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgagggcttctccaagaatctcaagcttggcatccatgaggactccaccaacaggaccaacattgctgagctcctgaggtatcactccaccaag

SEQ ID NO: 78372 - DNA, 573 bp, Triticum aestivum
  Clone ID: PAT_TA_78372
tgtatcatcaaccagggaagcaacgaatgatgcttcccactgttcctgttagaactactggaactgttgtcgtggagatggttgataaaaatggactgtatttctccgatgagttctcactcaccttccacatgcattactataagctgctgaaatggcttctgctactgccaatgcttggaatgtttggtgttcttgtcatcttgcgcccccaagaaggtgcaccactgccatcgttttcacggaatgttgactagtgactcatgtggtgaaatgccggcgacccattgagaagctgagaaagcaactcagagtatccccaacattttcacagaatgttgactagtgcttcacgtggtgaaatgccggggggccattgaagcagacaaagtgacttaagttaagagttcccaacatctccatgacttgaatgtcgtattcacactgtgatatactgggggattttaatctatatagaaaacatgcaatgtattactcccaacatttaaccgttcaaggattatagttttagttttacaatagacccatttagttctgcagaagaattttgta

SEQ ID NO: 78373 - DNA, 413 bp, Triticum aestivum
  Clone ID: PAT_TA_78373
ggccggcggcaagcagcgcaagcacaacaaccaaatggccaccatcagcgccgccgcggcgaccaccgtcgtcgcccgtgccaccatcgccaggccgcaggccctaggtctgccccagctgaggacgaggagcgagagggtgaggtgcagctactccaaggacgccaaggaggcgacccctgccgccgccgtccgcggggctggcgcgtccctactcgccgcggcgggcgcggtgaccgcgtccgcggggccggcgctggcgctggtcgacgagcggatgtcgacggagggcaccgggctgagcctggggctgagcaacaacctgctggggtggatcctcctgggcgtcttcggcctcatctggtcgctctacaccgtctacacctccgggctcgacgaggacgaggagtccg

SEQ ID NO: 78374 - DNA, 581 bp, Triticum aestivum
  Clone ID: PAT_TA_78374
atcctgacaagttcgagatcggcaagaagatggggatcaccgacttcgtcaatccaaatgatatcgcggagaagaccgccgtgagcgaggtcatcaaggagatgaccggcggcgaaggcgccgactactgcttcgagtgcatcggttcagtttcagtcatggcggaagcattcaaaagctcacgaacgggctgggggaagacggtcgttctcggcgtcgacggcagcttggcgctgatcagcgtgccgtcgttcgacatcatgcgggggcggtcggtcaccggctcgctcttcggtgggatcaagcccaaggacgacatccccgtgctggcacacaagtacctagacaaggagctggagctggacgacttcatcacgcaccagatgggtttccaggagataaaccgcgcgttcgacctgctcacccaggggaagtgcatccgctgcatcatctggatggacgacgactatggtgccaaggagaaccacggcgcgtgatgccgcgtgccgccgacgcgcacgcaggactgactgccaggacattgcttgtacgtgcactttgtgttgtgtggtggggacatt

SEQ ID NO: 78375 - DNA, 464 bp, Triticum aestivum
  Clone ID: PAT_TA_78375
gcacgagggggcagttttgcttcatccaagcggcatggcgccgttattacaagaggaagatggcagagcagcggcgcaaagaagaagaggcggcaagccggccaagtagtagtcaccctagccttggggcgactatctatgcatctcgttttgcagctaacgccatgcgaggggttcacaggctaagaagcaaggctgtccctaccattgtcaggctgccaaaacccccagagccagattttggtgtcgacgatgctgactaacgaaacaatcacactgaactcgcttgtaattgtactttacctcgtctgtagattatgtacaaaattcaatgacagctgcagaagataatgtttgtaaaggtttgtaaccacgcaaagacagaccataacggaggtatatcctgcttgacgtttatggaaatgcaaatgtatttttgcctaaaaaaaaaaaaaaaaaaaaaa

SEQ ID NO: 78376 - DNA, 320 bp, Triticum aestivum
  Clone ID: PAT_TA_78376
atcgcaaagcacaaagcttggtgttcacaccacaatccgtgtcagaaggatcattgctggtgtaggagttgagattaccttcccagtgtactcacccaggatcaaggagatcacggtaatcaggcacaggaaagtgaggagagcaaagttgtactacctgaaagacaagcttccccgcttttcaaccttcaagtgacatcagatctgctgacagaacatcttcttccaccaccatttcgatttctcttacaaaacctttttttcacttccctgtccaaatcaacgcatttcactgtaattctcacatatcagatgtgtaa

SEQ ID NO: 78377 - DNA, 298 bp, Triticum aestivum
  Clone ID: PAT_TA_78377
ttgaattggcacctcctcacccaggagaaatccctcaaatattcagagatgctggaaaattgatcaaaggagctgccactggaagatgggctcaagtctcagttagagaaggattagtcaatgctgttatcacagctgaagttatttgttggtttttcgtaggtgaaatcatcggaaagcgatccattattggatacaaagtttaatttatcaattcaaggatatgtaaaagtgtattccatagctaagtaataaatcttctttagagatatcgttaaaaaaaaaaaaaaaaaaaaaa

SEQ ID NO: 78378 - DNA, 760 bp, Triticum aestivum
  Clone ID: PAT_TA_78378
tctctctctctgctgcacaagctcctctcggcgacctccactgcgatccccacccgcgctcatgcccccacctgcgtgtgagctcatcggccatggcggatccatctctgcccatggtggatctggcgaggtaggtcttcttctcatggtagggtttcaacgagcctcttttccaacctttgtctttgccttccatagaaaaaaaattgtttcttgtgatctgtgatctgtgatttgtgatctgtgccaaggagtaaccagaggagagatgggctgcgtgccggcggctaggtgagcggcggcggtcgagcgctcgtcgggcagcagggcggagctaggtgcgaccggaggtagaagaagaggtgcaagccgttggatcttcatcataagttgaaaaaattgtgtgctagaacagggtgaaacacccaaaagccaggtctccatactccacaggacggttaattagggagcactcccctagtactcatggacctccataagcaaccttcgcttgaatcaccatgtggtacccatctgagatttttattagtgacaataacaagtgtcagctcaccatgcttagtatgtataggttatgcaaggctcaaagaaagcttgactcagctacactgcagtaagcatttttagttggtcatattttgtttattaaacttgtgttactaggttttatgcttaaagctcccatgtgaatataactaattatcatcatcaggattaattatattccaaaccattcata

SEQ ID NO: 78379 - DNA, 676 bp, Triticum aestivum
  Clone ID: PAT_TA_78379
ctcggtgttcttaactcacagaactcggaagaaagctgcgcgcggccgcagcacatagtcctcaatcatctcttcatagagaagggctggggcgcccaccctctggtggctctcggcctaacccacaggttcgagtccaaatatgtaactgtcgtcctgtacaaacccatcgaacgatagcaatagcccgcgcatcaagagcggaagttaatgcttgacaactcactgcgggagcagcgattgaacagcgccgaggtggtacatgcttgtaaaagcggttgaggttcaggagtattttttccgtgcccttagcttgcagaacctctggtagtctggttgttagctgtacctgctgcgctgtcatgatgttggccttctggtttgtttatcctgttacagagagccaaggcaaccttaattcctatatacatgtccgcttgtcgtcgtcgttcctcccccatcccatcctcgtcctcccagggatgaactgtgtgtagaggtgtcagactgaaaaccgtggaaatccacagaaatgttagttgccagggatagatcaagtgattcctagatttttgtttgtttttgactggtgaagacgatgtttttgttatgtaataaactcgagaattttacaaatgggatactgtgtgttcagtctttaaaaaaaaaaaaaaaa

SEQ ID NO: 78380 - DNA, 645 bp, Triticum aestivum
  Clone ID: PAT_TA_78380
tcatttccttggataccagcattgtacactggagttctttctacggtgttatgcatgtgggcagagctggtagcgatgggcgatgtttcagcaactgaaactgcaattgtttacggcttggagccagtttggggagctgcttttgcttggttcctccttggtgaaagatgggataacaccacatgtattggagctgcccttgtattatgtggcagtttgactgttcagctatttgggtcagctcctaagaagtacaagaaagttaaaaaacgcagcagcaatgctttagaaacgccagtgaaacaacaagactacttatcgttatctcctataccagttgattcggggaagttcataggaaggcaattagaaaggaggaacaaaacattatagcccaacttcaaggcaagaaaggaaatcctgcgatgataggctcacacaccaaattattgtcctgaggcatcacttcttggctcgtcaatatggggatggtgctggattgctccgcatgaagattttttttttagttttttgttttttttcccgcaatatcttggagctcgtttttggatttctattttgtctcaatgaccgtgctagaatacctcatgcatattaggaaatgaggcattgctagtggcaact

SEQ ID NO: 78381 - DNA, 106 bp, Triticum aestivum
  Clone ID: PAT_TA_78381
gattcagggaggctttctttattctggggaggattgagcttaatggaattacgctgacatgtgctctcactgcctgctcagcaacagcgaatttgatgtatggtat

SEQ ID NO: 78382 - DNA, 714 bp, Triticum aestivum
  Clone ID: PAT_TA_78382
tctccgccctccttgcgctccgcggccatggcgtccaccgccgtcaagctcatcgacatcgcagtcaacttcaccgatggcatgttcaagggcatctaccacggcaagcagtgccatgccgctgacatcccggccgtactcgcgcgcgcgtgggctgccggcgtcgaccgcatcattgtcaccggaggctctctgaaagagtccagggaggcgttggagatcgccgagaccgacgggaggctgttctgcactgtgggcgtgcacccgacgagatgcggggagttcgaggagagtggagaccccgagggtcattttcaggcactgctggctctagcgaaggaggggatagagaaaggcaaggttgtgtatgattatattatttcccagcatgcaaaaagtgttgtgactgttgttttcttgtaacctattgataaattcctagggacagatattcagtcatgtgttaggtttggagctactggaagttctcacagtttcttagttaaacaatgttatataaatcaatgatctaacttaaacttcacaggacccagaaatagcaataggcttttctgtcccaagaaaagttggattaggctagagattaaacccatctagagccaaaagaaagtggacataataaatatgtaaaagaaaaagagctaagttagttgtagtggtagtaaacaagaactgtgattctataagcatgaa

SEQ ID NO: 78383 - DNA, 218 bp, Triticum aestivum
  Clone ID: PAT_TA_78383
ggcatggtggctatgcttgaatacagagacattggtgacgacaatgtaccagtgttaatgttgttcaaacatgggctcgatgaagaaaaattttaaacaaatattatttgattcaatgatattgtcattttcaatgtatttgcttaaacattattcgctataccaactatattaagcgatataaaaataattttttgaaacaaaaaaaaaaaaaaaaa

SEQ ID NO: 78384 - DNA, 369 bp, Triticum aestivum
  Clone ID: PAT_TA_78384
tctcgcatcgcaatcgcaacacccaagcaaagcaagcctcgcggagaaggaagcaaccggccgatcggaatggcgatggcaccgtgcgcaccggtctcctccgttcccttggccgcccgcccggcggcgacggggtctccttcgtctgtccgtccgcgcgccgccgccgccgctggggcggtccgcgcggctggggcgacggagggcggcaggtggtgggcgccgctgctggggtggtcggggaaggccgactacctcgaggccccggcgccggcggtgccgcaggacgacgaggcgggcgcgcgcggcaggcagttcgtgggtggcctgacggaggagaaggcccggcagctgcatgcgcggatggcg

SEQ ID NO: 78385 - DNA, 666 bp, Triticum aestivum
  Clone ID: PAT_TA_78385
tggtattgtcacacagtgtctagctccaacaagagtcaatgatccgtacctgcttaatttgctgatgaagattaatgcaaagcttggtggtctgaattcgttgctgcaagttgaagcatctccatcaataccccatgtgtcggaagtacccaccatcatcttgggtatggatgtgtctcatggccatccaggacaagataggccttcagttgcagccgtggttagttctcgtcaatggcctcttatctctaaatatagagcatcagtgcacacccaatccgccagactagaaatgatgtcctccttgtttaagccacggggtactgatgatgatggcctcattagggaatcactgattgacttctacactagctctggcaagcgaaaaccagaccacattatcattttcagggatggagtcagcgaaagtcagtttacccaggtcatcaacattgaactggatcagataattgaggcatgtaagtttcttgatgagaagtggtcacccaagttcactgtgattgttgctcaaaagaaccaccacaccaagttttttcagaccggatcaccagacaatgttcttcccggaactgtcgtggacaataaagtttgccatcctaagaactttgacttctacatgtgtgcacatgctgggatgattggaac

SEQ ID NO: 78386 - DNA, 681 bp, Triticum aestivum
  Clone ID: PAT_TA_78386
gcacgaggctccctgatcttggcccaattggtgctaatggtttggcttcaccgagggatttcctttccccgacagcatggtttgagcaggaccaccaccctggatacacaatagtgcagaagtatggcggtgagctgttcactgccacgcaggatttttctccattcaatgtggtcgcatggcatgggaattatgtcccttacaagtatgatctgagtaagttctgtccattcaacaccgtcctctttgaccatggcgacccatcggtaaacacagttctaactgcgccaactgataagcctggcgtcgcgttgcttgattttgtaatattcccacctagatggctggttgctgaaaatacattccggcctccgtactaccaccgcaactgcatgagcgaattcatgggcctcatttatgggatatatgaggctaaggccgatggttttcttcctggaggtgccagtcttcacagctgcatgacaccacatgggccagacaccaagacatatgaggcaacaatcagccgtgctggtgccaacgagccattcaggctcagtggaacgttggccttcatgtttgagtcttcgcttatccctcgcgtgtgtcgatgggctctggattccccgtgtcgagatctcgattactaccagtgctggattggattgaagtcccactttt

SEQ ID NO: 78387 - DNA, 393 bp, Triticum aestivum
  Clone ID: PAT_TA_78387
tctgccatacctgaacagaaatctgaacatatgatgtcaaggccaacccgcaagacatcttgatatggctggcgacgaggagaaacatgatgtagcttccttactgccttcgtagtgtttgggctcagaaaggatcgagcatgcctttttttagggggtccaaatggtcagcacaataaacagacctgtattgataataactgttaaaaggcacattaaagtcatggttctgccattagccttactttacagggtctccgacaataataataataccatgattgttgaactgcattggatgatgccgagataaaaagacaagtgaaacatgtaccgtgtatattcccggctccagaagatatcatttccatagacaaaaaaaaaaaaaaaaaa

SEQ ID NO: 78388 - DNA, 168 bp, Triticum aestivum
  Clone ID: PAT_TA_78388
tgccaatgcaaaggtgacgctcacctgcaagaaaaaccctcttgtaaaaatcaacatggatgggatccctattggaaggaaaatagaccttgcagcctataacagctatgatgggctatcgtcagctggggggaactcttccatgggtttcttcaagctcaaaaggac

SEQ ID NO: 78389 - DNA, 329 bp, Triticum aestivum
  Clone ID: PAT_TA_78389
cagttcagtttagatttcttgttccattgtttagggtgctaggaagaactagggtgccatgtctttctgattccatcggtgatcggtacatcaatatttttgctaaggtgaaccatcaaggtaaacatgccccattctcctatgctttatctcttaaattttatacatgtcttgtatatattgattttaaaaaatgagaatgacctaattatgtagcactatattgccgttattttctccaatttcctccttttgtaatctgaccaagttgttacgatttaaatatatgattcatttaattgctcttaaaaaaaaaaaaaaaaaaaaaa

SEQ ID NO: 78390 - DNA, 763 bp, Triticum aestivum
  Clone ID: PAT_TA_78390
tgggcatgtttgttgggatgataatgacataataaatggaaaaccaactggtgctgtgaggatatcatttggctatatgtcaacatatgaagatgcagaggaatttctgaaattcctgcagtcatcttttgtgtccaaacctgtgggattgaaaaatggctacatggtgaatacggatacttttaatttagtagatgattggcgccagcaagctatttcagatattcgcttaaaatccataactatctatcctgtgaaatcttgccaaggatttagtgtgcagagctggccactgacaactggtggtttaaaatatgatagagaatggcttctccaaggatcaggcggtgaagttttgacacaaaagaaggttcctgaattgagctctatctgcacattgattgacttggagcttgggaaactcttcttagagtcgccgaaatgcaaggataaattgcaaatctgtcttctagagaatctgactcttctgagtgcagaagtagatgtttatggtcaaaggtatgaggtgcaaagttatggcgacaaggtaaactcctggttcagtggagctattggacgtccttgtacatttgtgagatgctcaagttccaagtaccgttcctgcacaattaatggcaggagagatcgcctctgtagggatactcgaagcaaacttagttttgtgaacgaaggacagttgcttcttgtttctgaatatagtatatctgatctcaacagtcgattaagttcaagtaatggaaat

SEQ ID NO: 78391 - DNA, 518 bp, Triticum aestivum
  unsure (1)..(518): unsure at all n locations
  Clone ID: PAT_TA_78391
tcagccttgggaatcaagtattgattcatctctgacaagcgaggaaagggagcaaaagcggaaacaagctaccgacagagcaacctttgtgcaaggcctagtgctgtctactctattcggagattgattgttcaaaacagccctaggttcttgcacttgctagatcggcacttactcctgcctggtccacatagtcagatagtgctcaacccggtttggtgcatctaactctgatggcaggaaattcgcctcaggaaacttagccgcgttcatctttgtttcagtgaattgcgcagttgattctaccatgatacagctttgatttaagctagctgttgttgtacctttgtttttatcaatttatcagccagcaattcttatctgtaactcactggtacattgtgtttgtaccgacatacataatagctgtaacatctacttacacaatgcaagaaagacacttgttcgagagcagttgccanaaaaaaaaaaaaaaaaaaaaaaaaaaaaaaaaaaaa

SEQ ID NO: 78392 - DNA, 628 bp, Triticum aestivum
  Clone ID: PAT_TA_78392
ttgtgaatggcctgtgcactccaatctctgatcaatcggccccagtctacatcaccatcggcgatggagggaatcaggaaggactggctaccaacatgtcgcagccgcagccgaggtactcggccttcagggaggcgagcttcgggcacgccatcctggacatcaagaaccggacgcacgcgtactacacgtggcaccgcaaccaggacgggagctcggtggccgccgactccatgtggttcaccaaccggtactgggagcccacggacgattcggccgacgatttccagtgaggactgaggacgagagctgcagctggttattcgtctgcggttcctcacgaccaataagcattgccccggatacacgaagcctccgaagctccgatgatcgtgctctcttgaagggaagaaaacgttaaacgtgtcaagagtaaaacggagtggctctactctgattgtgtacagaagttcacgtgcacagctacgttccctatcgcaatggtgaaccgtgaagacactgttggactgtggacgtggtctgcaaattgctaagaagcgtgtacggtgtggtgtactcgcctaggtgctgatcagtgatcaataataccctgctttcgcggcaaaaa

SEQ ID NO: 78393 - DNA, 563 bp, Triticum aestivum
  Clone ID: PAT_TA_78393
ttcatctcctacaagcactagtacatgttcagacaacggctctcctgtcctaggaaagcactccagggactccaaaccgcaaggagatgacaaggcagagaaaaacttgtggattccgaaaacgcttcggatcgatgatcctgacgaagctgcaaagagctcaatctggacaacccttggcattgaacctggtgaccgtagcatgttcagatcattccagtcgaaacctgaaagcagggagcagatatccggtgctgcacgagtcctgcaggcgaatccagcagctctatctcgatcgcaatctttccaggagacaacgtgatgtatattgaagaaatcgtgtgacaattgtagaacatgttactactataatttaagcaagtgctacagcctgaaggatgattggcgatgtaggcgctgctgcaaacatggaggcagcgtgatctgtactattgaaacctgaagagtactattcttgacatttttctataatttgcctgtggagcatgcaccagtctactgggttcatgatcaggctgtcagcatatgttttgttgtacaat

SEQ ID NO: 78394 - DNA, 671 bp, Triticum aestivum
  Clone ID: PAT_TA_78394
caggttcttgtaccagtagatggaaaccctcaagcctgtatttttctggatactccaggacatgaggcatttggtgcaatgagagccagaggagctagagtaactgatatctgtattgttgttgttgctgcggatgatggtgttctgccacaaacaagtgaggcaattgcacatgcaagggccgccggagtgccaattataatagcaataaacaagatagacaaggagggagctaatgcagaacgagttatgcaagagctttcccaaattgggctcatgccagaaatgtggggtggtgacaccccaatgattcagataagtgctcttactggggacaatgttgatgaacttctagagactgtcatgcttgttgcagaggtacgtttctgtttgcgcaatgttttctagcaatctattaagttcttttttgaccttttcttttgttgcaaatttgaagttgcaagaattaaaggccaatccacatagaaatgcgaagggcactgttattgaagcatgccttgacaaggccaaagggcctcttgctaccttagttgttcagaatggaaccctaaacaaagctgatattattgtgtgtggtgaagcttatggaaagatccgtgcattgtatgatgatcgtgggaagctcgttgacaaagcaggaccatccaatg

SEQ ID NO: 78395 - DNA, 320 bp, Triticum aestivum
  Clone ID: PAT_TA_78395
ctgaatccatgcatggcgaagatgtggcataggattggaatggtgaggctaacgggtagctggggaggacgacaataatgaggcagcagtcgcaaacagagagaaagcgatagtgatagcatgtttcggttgctctacagcaatggcttctacgtatcatactctcatgtgtggttacagacgagctgtgtaatttttgcagatagcttcactcgcaccagccgtaaaagtgtaaaacactgttagtattataatactaattaatggtatgtatcgataaaaaaaaaaaaaaaaaaaaaaaaaaaaaaaaaaaaaaaaaa

SEQ ID NO: 78396 - DNA, 174 bp, Triticum aestivum
  Clone ID: PAT_TA_78396
atcagcaactacgacatcttcctcactagagactgcttggcctatgccaagataaagcctgcagtgaaccaaatcgaggtgcacccctacttccagcgcgattctcttgtcaagttctgccagaagcatgggatctgcgtcaccgcgcatacccccttgggtggctccactgcc

SEQ ID NO: 78397 - DNA, 567 bp, Triticum aestivum
  Clone ID: PAT_TA_78397
gtgtgcgcggcggtgcacgagctctacaaggacccgcgcggccgcgagatggagcgggagctcgcccgccgcctcagccgcgcgccgcccgtcgtccccgtcgtcttcatcggcggcaggctcgtcggctccaccgacatgatcatgtcgctgcacctcgcaaacaagctcgtgcccatgctcaaggctgccggcgccatatggctctgagaattttgctagctactagcagctggaccgtaacgtaaccccccgaattttgcaccttaattaattatatatttcgattccatgcatgcaactaactaaatactccgatcctacggaggggtcttaaattaatataagagctaattaagtacgtattctccgcgtgcatatgtttgctgggtgcactgagaatctgcctggcccaggcgttggattttggtggcctgaggttcagatccttgttgcctggctgtaaactttgcctcgcaggcatgcagcaagcaaacaaacaggcctatatatatgcatgggtataggctatagagtgtgttcacaaatcgtaagatatatatgagg

SEQ ID NO: 78398 - DNA, 562 bp, Triticum aestivum
  Clone ID: PAT_TA_78398
cacgaggctctcccatgctctcccgttcccagcgcggagagatccccggtgacgcccggcaataacggccagccgcagcagccggtcgccaacgccaacggcagcgcgccgagcgagccgccgaagcgggcgccgctgactgcgcgggagcggctgcgggcggcgcgcgtgctgggcaagtacgcggagccatcggcgaaaggctcgtcgtcgtcgtcgaaaccggccaagccggagttcgggagcggcgtgctggacgcgctgcgcgaggcggacgcgaagaagggcgggggcggtggcggccggcgcgggtcgcggctgcccgaggcgccgggcaacctgttcgacgacagcaagcgtgggatgcccaaggacgggtggacgttcgagctgccgttcggggtggacgtgttcctcgtcctcgtctccttcacgctcatcaccaccatcatgttcggcaccgccttcctcgtgtggaagctcggcgccatacacttcaacgagtactagcctgttgtagactgtctctagatttatgggggataaatacagggcgattatt

SEQ ID NO: 78399 - DNA, 727 bp, Triticum aestivum
  Clone ID: PAT_TA_78399
gcacgaggggtcaaatctcctcggcacaaagtttgcaatatatgatacccagcctccatgcaatacatcacaaccagggaaaacaagccgtaggttctactccaggaaggtgtcgccaaaggtctcttccagaacctacaacatagcacaggtttcatatgagctgaatgtcttgggtactaggggccctaggcggatgaactgtgttatgcactccatccctgcctcatgccttgaggctggtggcaccgttccatgccagccggacagcatccttgctcgctccattgatgagtcattcggcagcatttctttctccaagtcatctgttgtggaccattctatgcgtttcagcagcacaagattctctgaaatctcaatgagcagccacacgattggagacgcggcattgggagacaatgacgagtgcaaggacaggccattgattctccgaaacaaggccccaaggtggcatgagcagctgcagtgctggtgcctcaattttaagggcagagtgacagtcgcatctgtcaagaacttccagcttgttgccgctacgcagccctctgctggagcaccaaccccatcatcacaggctaccccagtgccaccgcctgagcatgaaaaggtgatcctgcaatttgggaaggtggccaaggatatgttcacaatggactaccgttacccactgtcagcctttcaggcctttgcaatctgcttgagcagc

SEQ ID NO: 78400 - DNA, 495 bp, Triticum aestivum
  Clone ID: PAT_TA_78400
ctggctgataatttctcttctcctggccttctttttctagaagaagagtaggatgagtttatttatcgccacgatcgagtttcatgttgcttttcctaatccatccaccttgtcaccatacatgggcaatattgccattcttgttgccagaatgttattattaacaatcagtacatattctgcttcatagcttatgtcagaattatgcattcacaaagagatgccctgcttcatcaccatgcatctgactcttcttctctgagatgcttcccagcgaccaagatggcaggatgcttaccatacaggccagacaggacctcctgatgtcatcgcttggccacaaagtagcgaataatctacataaatatcaagcatattatttgaattaccgccacactatatagtaacgataattcatattatttgtggcatgcattcatgaaataattcagtttatgggaattatgcttcatcaataaaaaaaaaaaaaaaaaa

SEQ ID NO: 78401 - DNA, 591 bp, Triticum aestivum
  Clone ID: PAT_TA_78401
tctgttgggatgctctcggctgtcagctcaagctcaattcgtgttactgctggcatcatccaacttgatggcctcactttcagcagtggctccgatcggtggcccttgcagaagaatggagacttgagtttgcttgtgtcttttgccgtggagagcgacgtgtcatccaagcttcctgttggtcttgaggatgctactcggattagcactgttcccatggtgatgcgaagtggcttttaccttttctttatgtcggccatgattctcctgttgagctacaaagtagggtcgtgtatctacagcaggtgagttgaaggtgatggcgcctctggtccggtctgactctgagggctgtttattttgattttatacgtgggtcatcccctcagtgatgaggggatagtagtcgttcgacactatttgtttatttaccattctgacctgtcaaaacatatagcaataaacttttgaactggtgatggtggccatgccgggaccatgtcctcatcaggcaaagtagtgcactgtgaacttggggctctgcccttattattgtaaccaaaacttaactgcaaaaaaaaaaaaaaaaaa

SEQ ID NO: 78402 - DNA, 430 bp, Triticum aestivum
  Clone ID: PAT_TA_78402
gcgggcgcggagccccggcctgctgcccaccgtggtgatcaagcagtcgccggccacggccacggccacgccgcggccgtcgtcggcgaccaccgcctcctccgccaccgctgccaccggccggaccacctccaccatgccgtctccggcgtcgcaggactcctaccagcagtagctgccgccgcccgctctaagttttgtacatgccgccgtggacagaggaattgcgtcctccccttcccctctctctctctctttttctcccacgtcgatgacgatgagccgttgacaggtgggtccaaggacgagtttaaacatggtgaagtgaaagtaagttatatgatgtagtaacttatatatgttgagatgttgaagcttgagagaagggtgaaaaaaaaaaaaaaaaaaaaaaaaaaaaaaaaaaaaaaaa

SEQ ID NO: 78403 - DNA, 579 bp, Triticum aestivum
  Clone ID: PAT_TA_78403
cggccagatccgtccgggaccgtcgccggtgccgccggcggtggccgtggcaggtggccgccgtgctggtgcgcacgtttgccgctgtgggtgggggccttgacttgacgcgtgaaccacccttgaaaagggagccgccaccgccaccctcgtggcgacgtgtcggttgctacacgcaaagtatcccggaccgtctgatctgacactggcggtccggattgctagcctcggcggtcgcaatctcatgctgccgtttcacatgcgttttggctgtgctcggcccctgatggtggagagagctgttcaacggttgggttgctgtcagcgtgaaatgaaagccctgagactttcagattccttcggggcgaggtcacctaaagatattgttatcccctttgtttttttggattaggttgaatggataaatatactttcgttgacgcgctaataccaatgcgatagatgatgcttgatgctctagctctcatgtagttgtacttgcataatcaaaattcgaaatcggaataatgcaatggatggttaggcatttggaagaagcatattacatcatgttaaagc

SEQ ID NO: 78404 - DNA, 533 bp, Triticum aestivum
  Clone ID: PAT_TA_78404
cttcactgtctgggatgtcgggggtcacgacaagatcaggccgctgtggaggcattacttccagaatacacagggtctcatcttcgttgtggacagcaatgatagggaccgtgttgttgaagcaagggatgagcttcaccggatgctgaatgaggatgagttgcgtgacgctgtgttgcttgtgttcgctaacaagcaagatcttccaaatgctatgaatgcagctgagattactgataagcttggactgcattcacttcgccagcgtcattggtacattcaaagcacttgtgctacaactggtgagggattgtacgaaggcctggattggctgtccagcaacattgcaagcaagtcctaaattttcaagcgaggtttggatcatctaggagcttttggatgatgatggtgctggatatttatggttgggttgatatttccgtatgtaagatgtatgccctgagctcaacagatattgagctctgcttaacgtttcacagttaaattgttttatgtaatttgggccttgagat

SEQ ID NO: 78405 - DNA, 368 bp, Triticum aestivum
  unsure (1)..(368): unsure at all n locations
  Clone ID: PAT_TA_78405
ggcttagctgcagctatagcccgctatagctgatgctagctgttgaaagctcaagcagctaaggcccttagccggctatttaaatccctgggtatcctgcgtaagcgcaattgtgcaaatcatcggaaatcatcgtgcgggggtgctgcgggcggntgcgncnagccgcgatatttccccccctccgctcgccctcgactccgactccgactcctcgcgagttcgcccgccgccgccgccgccgccgcccgccgccgccgatcccccatccatcccgcgaccgagcagggttgcctccgccgcgacccggatttgtgcttcttttcttgtatgatggatagcaagggcaaagtgaagaaggaaacaga

SEQ ID NO: 78406 - DNA, 592 bp, Triticum aestivum
  Clone ID: PAT_TA_78406
accggccgcgcggaggaagctatcgaggcgtttgtcagaatgcttccaacagtcgcaaattctgcatcaccgaatgagtatactttctctgctgaattgctgcgtgtccaaatattgaacgtgcctatcttggagagcagttacatgcacaagctgcgcgaagagggctatctcatacccgctctgtggcgaattcccttgtcaaactctatgcacgccgtggccgtctttcagctgctgatgctatctttcgggagaatgctgtcaaggatgttgtctcctggagcacaattatatcaggatatgcacaggaaggcctggtcgaggagtcttttgccttgttctcagaaatgcggcatcacagcagctgccctcggccgaatgagtttactcttgccagtctcttcagtgtgtgtgcaagtgctgcatcactgtatgctggacgccagctgcatgcactcgctgtcgctgctggacttgaacaccatgcgatggtcaggagtgcgctcgttaacatgtatggaaagagtggtagcatgacagatgctaatgtcatattttccagtcgcactagaaaaaaaaaaaaaaaaaa

SEQ ID NO: 78407 - DNA, 468 bp, Triticum aestivum
  Clone ID: PAT_TA_78407
tttatcttgagcatccccaaaaggaaacctgctgacgaaacacaggaaaccctaagaacgtctgctttccccagccagcatgtgaaggacaaatgggcgaaaaatctctacttagcttccatttgctatggaagaacagtgtcatgaggtctgccctgtttggctggtgtacactgtagagtttatttatatggattactgaattactagatttggaattttgaacggcaacaatatttctaatttgccctcctataattaaccaatctgatagaagcggaagcctgctctgttcagttgatagttgccttagctgcctagcatggttgtaaaaaaaaatcttgtggtgtttgggtgttgtacttgcttgttcatagattgttaaaatcattgtgttgtaatttgtaaactatctatcttgcatatagttttaaattgatatttaaccaaaaaaaaaaaaaaaaaaaa

SEQ ID NO: 78408 - DNA, 710 bp, Triticum aestivum
  Clone ID: PAT_TA_78408
gacagaagggctgttgagtatgatgctctgcggtcgtctgctttgaggatacatggtttgttcgaaaggctaaataattgtgtcactgcacccggtgtgactggctttgcagagtcactgcgttctttggctatctccttggcaagctctgtaaagaaggatgaagctgataccactgttcagtttcaacaatgcatcaagatcctggccgacaaagtttatttattgacacgacagagtgctgatctgctagaacgctattcagctatgcaggcagtacatggaggtatcacaaaagagttggatgagaagaaagagctgattaagaatctctacaataaacttcaactagaaaaacaggccagcaaggagaagatatcatttggtcgatttgaagtccatgagcttgccgtcttcttccgaaacccggctgggcactatgaggcgatcaatcggaactgctcaaactactacctgtctgaggaatctgtcgccttgttcactgagcaccacccggtgcacccagcatacataatcgggcagatcgttcacattgagcggcgcatagtgcacccaggtcagatgggaggagctccacgccgtgatagcagtggtggccgtcggtcgcccgcatccatgctcaacccctacaaccttcctgggggctgtgagtacttcgtggtgactgttgccatgctgcctgatgctgc

SEQ ID NO: 78409 - DNA, 632 bp, Triticum aestivum
  Clone ID: PAT_TA_78409
gagggtctctttgctctgtaaaaagatgatgttcttgctctatagactgagtgaggagagaacataaattggtggaagagaagtttgatgctaccactttgctataaggactgagccagacacaataacatcaaactgagataccgcagtttacaactttttcaatatggcagattgaagagcagcaagatcagcttccatgaagctggcaagctgcagtttgaacagcttccacctgcagtttgaagaaatctttctaaggtcttggactaaaggcgaatccttctgtgtcaatcttgccttcaccccaagcatgctggataccttgtaatgattgtagtacttgacaactgttaccaaagtagtggatgcttttctttcgcatgaagttttgttggtaccccacctcgtctgtctgtaagaaaaaatgttatgcatcctggtccatttcttctatgcatcctgagaaaatggtcagtataatctagggctttcttttgtcatgttgatttttgtatgtcctaagagcatctctcctatatacttaaaaagtactagcattctaggagatgaaagtggtacagcagatctcctatctcatcatctatacctataaaaaaaaaaaaaaaaaa

SEQ ID NO: 78410 - DNA, 684 bp, Triticum aestivum
  Clone ID: PAT_TA_78410
gaatgatgagattgaggtggattagctggaaatctggtgcttaacagaagctcaaatgaaatgatgccacaaaagtgggtcagcgtgaggggtgatccgcagcagcaactgcaatgatgctgtcgcggccatgacatgtaggtggattagtgtgaagttgacaacctgacgcgctgcacaagtaaattttggtcaaatgtttgtgttcatccctcagtcaccattaatcgtggataaggtgcttacacagaataaattccaagtccagctctggccttgtgaaccgatcatcctcgcaatcgagatcttcgggggtctgatatttgtatttttggttcaatcgaagggaaatgatctttctgttcatagaaggccagcttgtatgttaaaaaggagtgtattgtttcattacgagggaaagcaataggtgacgctgccattgagttactgttgttttttggcaaacttgtttcatcttccgaggactagagattttgtacctaaaaagaactgataatagaacatcatggaggcagaattaaactagttacttatggcttgcttgcttgatgtgggagttcttcattgtagttcgatgttccttcctccttgccattgtgatgcgtaaaattgttttgtcgtcggaagttgttaattcggcagatgatagatctgagtattata

SEQ ID NO: 78411 - DNA, 706 bp, Triticum aestivum
  Clone ID: PAT_TA_78411
tgtcataactaaatcagtggagaaggtcaaagagactacaacgactgtgttgcaggggacacaactcttagcaattgatacaggagctgctatgggtttgctaaaaagagctcttattggggatgaactaactcagaaggaaaagcaggctcttcaaagaaccttgacagatttggcatctgttgttcctataggaatactcatgcttttgccactcaccgccgttggtcatgctgctattttggctttcatccaaagatatgtgccatcgatgatcccgtccacatatgctcccgataggttggatctccttagacagcttgagaaagtgaaggaaatggaagttgctgaaggcagcagtgaagatatattggaggccgttggttcgagaactgagcaagtgaaataagctggccatgtacagatggacgattatactgcttagcttacgatctttcctgtaaagttgttttggaacacgacatgaggggtttattttgtttaaagattctttgaatgacacataccgctggaaacagaactgcaaggccatacgaataaccaatcatcgggtcgataaggcgaagaaagatccttccaaatgctccacgtctgtaggctgtatccatacttcacagtatacatgggcgcatggtgcccttcaacatagtagagggtgaatgtccaagctcctcttgggcagtct

SEQ ID NO: 78412 - DNA, 374 bp, Triticum aestivum
  Clone ID: PAT_TA_78412
agcatcgccacaagtccgcaataaaccaccacacaccacgtaccggggtggccactagtctcaggcggctctcaagctctcaagctactcgctgcctaccagtatggggaacgccgcgccgcgcgtgcggcgccgcgacgagcccgcggcgaagagttggtccaagggcgcggaggctgccggcgagctgctgccggtggccaaggccgcgggcggcgaggagaaggcggcggccgagcgcgcggtcgtgacggtgaaggtggtgatgacgaggaaggaggcggagaggctcgccgcgcggctgagggagcagagggcgagggggcggaacgccaggatggcggagctgaagaacgcgctccgggcgggggacg

SEQ ID NO: 78413 - DNA, 312 bp, Triticum aestivum
  Clone ID: PAT_TA_78413
gaggaactgacattatagtagagatttaccaacactatatctttgtaacatctaggctgcctgttgtagattagggaatcagttccatttttttttaccatgagcctattgaataaccttgtaatcaccctgtacaaacaacaacaaattctagttaaacgccagttttgcctactatacaagggttggtaatgttggtatagaatcagaagaaatcggctatacactacagaatgatgtatctgagctaagatgtgaacggcttaagaattttcagttaattcaaaaaaaaaaaaaaaaaaaaaaaaaaaa

SEQ ID NO: 78414 - DNA, 579 bp, Triticum aestivum
  Clone ID: PAT_TA_78414
gggagtttggtggattggataacttacctgtcaaacaactctatacttcaggatgcgattgacaagtctttgattgggaagggcaacgatgctgagctgcttcaatgcatgaaggttgcctgctcttgtgtgctttcttctccaaaggaaaggcctacaatgtttgaagtttaccagctgctgagagctgttggagagaaatatcatttcagtgcagctgatgatgaattgacaatgcaacctcaaaatgccaatcctgaagatgagcttattgtagcaaactagttgaacctatgtgatgatgagtaggtgcttgtcagataccaaatattgccggagctattttaacttggaataatcaggtcaactagaatcattctctatcttttatcaggcaagcagtaggatttgtccttctattgtaaggtctatcaatatgtggtgtttacatttgtacatccttgccttgctgtgtatcctcaggattgtcttctccttgttgtaagatggatcagctgtattgtcaaccaaattttagctgtagtgatagcaatgtgaaacaatgttggcccaaaaaaa

SEQ ID NO: 78415 - DNA, 311 bp, Triticum aestivum
  Clone ID: PAT_TA_78415
gaggcgtgggagtagtaggaggagggcagcagacgccggccccgcgacggtggcgcctggcggacgagctgcggtgcgacctgcgcgccatggagacggactacgtgcgtcggttccaccggcacgagccccgcgaccaccagtgctcctccgccgtcgccaagcacatcagggcgcccgtccacctcgtctggtctctagtgaggcggtttgatcaaccgcagcttttcaagccctttgtgagccggtgtgaaatgaaggggaacattgagattggtagtgtctgggaggtcaatggcaggtctgggctg

SEQ ID NO: 78416 - DNA, 698 bp, Triticum aestivum
  Clone ID: PAT_TA_78416
gacgagggttatgcattgccccatgccatcctccgtttggacttggctggtcgtgacttgaccgactacttgatgaagatcttaaccgagagaggttacagcttcaccaccaccgctgaacgagaaatcgtccgtgatatcaaggaaaaattgtgctatgtcgctttggacttcgaacaggaaatggccaccgctgccgcttccacctcattggagaaatcctatgaattacctgacggacaggtcatcaccatcggaaacgaacgtttccgttgcccagaagccttgttccaaccttcattcttgggaatggaatcttgcggtatccacgaaaccgtatacaactccatcatgaagtgcgatgttgacatcaggaaggacttgtacgccaacactgtactttccggaggtaccaccatgtacccaggtatcgccgacagaatgcaaaaggaaatcaccgctttggccccaagcacaatcaaaatcaagatcattgccccaccagaacgtaaatactccgtatggatcggtggttccatcttggcttctctgtccaccttccaacagatgtggatctccaaacaagaatacgacgaatccggcccaggcattgtccaccgtaaatgcttctaagtcatcacctcccacaaacatacaaaatcaaaattacaatcacgctttatgttcatttatactga

SEQ ID NO: 78417 - DNA, 483 bp, Triticum aestivum
  Clone ID: PAT_TA_78417
tctacatgggttgtgttgatgtgagagacgtcgcgcactctctgataatgttgtacgagaacccatcagcacaaggacgccacttatgcatggaatccgctgaacgcctggttgatttggccaataagattgctgatctttaccctgaacacccagttcagagaatccgggaggacaagcaagggtgggtggtgagagcaaaggacccttccaagaaattgatcaaattgggtgttcgtttcactccactggacaaaaccatcagggacaccgtggattgttttaggagcaaaggactcatctagcttgtgagtgtgcttcaagaaaaacttttgtaaactatgtggtcaaataaatcacccgaaatgtggcaaagtaatatctgcctttaaaggcatatagaatatgccaggtggatatcatcattagatgtacatgttgcctaaatgcatatgctctttctaaaaaaaaaaaaaaaaaaaa

SEQ ID NO: 78418 - DNA, 696 bp, Triticum aestivum
  Clone ID: PAT_TA_78418
gagggtgaggatcggttgttggtgtatgattacatgaagtttggcagcttggaggatgtgttgcatgaccgaaaaaagatcggtaaaaagctgaattgggaggcaagacggaaaatcgctgttggagcagcaaggggtttggcattcctccaccacaattgcattcctcacatcattcaccgagacatgaagtcgagcaatgtgcttatcgatgaacaactggaagcaagggtatctgatttcggtatggcgaggctgatgagcgtggtggatacacaccttagcgtgtccactcttgctggaacgccagggtatgtaccaccggagtactaccagagcttcagatgcaccaccaagggtgatgtttatagctatggtgttgtgttgctggagctgctcaccgggaaaccgccgacggactcggcagactttggcgaggacaataaccttgtggggtgggtcaagcagcacaccaaattgaagatcacggatgtcttcgaccctgagctactcaaggaggatccatccgtcgagcttgagctgctggagcatttgaaaatcgcctgtgcgtgcttggatgaccggccgtcgaggcggccgacgatgctgaaggtgatggcaatgttcaaggagatccaagctgggtcgacggtcgactcgaagacctcgtcggcggcagcgggttcgatcgatgag

SEQ ID NO: 78419 - DNA, 607 bp, Triticum aestivum
  Clone ID: PAT_TA_78419
ctcagcagcacatgcgatattatagtctgaaacaacctctacattgctcacgatcaaatgcaggagtaaacctgtccctgctttcgcgggtcatgtcatcgaggctgtcgcgagggacctacaacggcggcctcctctcaacggaggccgggacgctggcccgtgtggtcgcggacgcgacaatcaccgcagcgggctacctaggcacggacatgctcctcaacgtcaccctgctgccgcctctcgtgatcaccatcgtctccatcgtcgcaacattctgcacatacaacaccctctactgaggaggctgatcagtacaaccttttctactctctgaagaatgtacaggcagtgaaaatggttcctgcccacattgggctgggtagttcaagtagtggcgatatttgtttgtagacttcatcaacttcaataaactgtgtaaatgttgatctgttgcacgtccatgtaagaaaaaggcgtcgtagtgcggtagtgcatgcatcgaacagatgtaaattaagttgcttttttatttgtatccctgaacctgcgaattcagatgcatttagtgtgtgttggaaatgcagcatggatatgatttctggcg

SEQ ID NO: 78420 - DNA, 720 bp, Triticum aestivum
  Clone ID: PAT_TA_78420
tagcgtttgatccaaaggaccgtccaacagcagaagaggcattgcgtgatccatacttcaaaggtctttccaggattgaaagagaaccatcctgtcagccaatcagaaaagtggaatttgactttgagcacaaaagaatgtcaaaggaagagataagagagttgatattccgtgagatactggaatatcaccctcaattgctgaatagctacattaatggcacagagaggacaacctttctctacccaaggttttagcttttctgtgtttgcacatcgctgtcgatcaatttaagaagcagttttctcatcttgaagaaagtggtggtaacgtcccatcagttccaacagacaggaaacacgcatccctgcccaggactactgttgttcactcgaatccaattcctgccaaggaacaacctcttgctgcctcatcaaaggttagaccagtctctgatgattcatgtaagaatccttgggagaaaggaagtggtcctggaaatgttcccagggcatctctggctccacaagggctgcaaacacaagcagcaggatcagtaagagttaatggttcagtgatgaattcagggtatcctcctcatcaacagatcccacaagcatatggttaccgccaaatgcctgcaagattggacagtacgaacccatcacaggccatgggaggttacacacagcagtcgcaggcttatgctttttcaacagc

SEQ ID NO: 78421 - DNA, 148 bp, Triticum aestivum
  Clone ID: PAT_TA_78421
ggcgtttggctgaaatgcctgctgatagtggttacccagcttatttggctgcacgtttggcatccttttatgaactgctggtaaggaaatgcctgggaagtccagacaggactggaggtcacaattgttggagccggctctcctcctg

SEQ ID NO: 78422 - DNA, 405 bp, Triticum aestivum
  Clone ID: PAT_TA_78422
cacgctggaggtcgagtcgtctgacaccattgacaatgtgaaggcgaagatccaggacaaggagggcatcccaccagaccagcagcgcctgatctttgctggtaagcagctggaggatggccgcacgcttgcagactacaatatccagaaggagtccacgctccacctggtgctgcgcctccgtggtggtcagtgaagtgaagttgttcgccctggtggttcactgggtggtgtgctctttttagttgtcctgggtgtgtttccataccgtgtgtttctactgtgatgtcgagtcctgcaaacttgagctgtggtgcagcagcaagttaacttggtttgccttagctatttctctttgattgcctgctatgaaatttaccttgtgttaaaaaaaaaaaaaaaaaa

SEQ ID NO: 78423 - DNA, 575 bp, Triticum aestivum
  Clone ID: PAT_TA_78423
gccgccgccgccgtgaaggaaggaagaggaggagcgaagagcacgacgcgatgggccactccaacgtctggaactcccaccccaagaactacggccccggctcccgcgtctgccgggtctgtgcgaatcctcatggtctgatcaggaagtacgggctcatgtgctgcaggcagtgcttccgcagcaacgccaaggacattggcttcatcaagtaccgttgaagaatctactctgtgtagtggagaacttcctggatcaaagaaatggatgcttcattagaaggcctaaattatgtgcttaagcattttgttcagaacttgagactcatgtgctagtaaacttgttaaaatttttgatgggtaccatgtgcctgttggaccatctgtaatcagaagattgaaatattttgttacgcttgatatttggtgttcttatcttgtttgtattggttcttacatgtgttattggtgtcaaagatgaatgatggctattacactcaaggatattgaagtgtgaatgtaataacttctggtttgtttggctggtatagtggatggtactgtgatgtgcagctt

SEQ ID NO: 78424 - DNA, 375 bp, Triticum aestivum
  Clone ID: PAT_TA_78424
aacggagcagatctcatgcatctataagaattgcataatcggtgctttactgcttttggtacattctctagcaattttcttttctttttgaacctcttggtatctttaaggaatgataaaaatctcttgatcagttgtatccaagatgaagcttggactcaaaggtatggtattttttttcataaatacacagggacttttgtacgagacgcaatagtatctctagttatagtaactctagtatgcaatcatgtaaatatctcttctcgccatccccatatagcatattagaaaaatgcatgcattttgagaagggtcgtattctattgttacaattctactgaatatacctttttattctgttcagaattggtt

SEQ ID NO: 78425 - DNA, 505 bp, Triticum aestivum
  Clone ID: PAT_TA_78425
ctcgcaagcttctagcgtcttggttttcgattgctgcaggaagggaagaggcggcggcaatggcggggagagccaacatcccgaccaacaactctgcgctaatcgccatcatcgccgacgaggacacggttactggctttttgttggctggagttggcaatgtggatctgagaaagaaaacaaattatcttattgttgataacaaaacaacagttaaacaaattgaagatgcatttaaggagttcaccgccagagaggacattgcgattgtactcatcagccaatatgttgcaaacatgataaggttcttggtagatggctacaacaaacctgttcctgctatactggagatcccgtccaaggaccatccatatgatccagcgcatgattcggttctttctcgcgtgaagtatctattttctgctgaatcagtggcctcagataggcgataaaagtcttatgacttcatgtatcttgtctatgatgtgcctgggccattttattg

SEQ ID NO: 78426 - DNA, 669 bp, Triticum aestivum
  Clone ID: PAT_TA_78426
tcacggccgggctcggcaccggcgcgctcttccgcgccgctaacgggccgcgctcggcggtcgtcgccggggccgtcggtggggttcttgctggcgccgccgcggctgccaagcaggttgggaagagatacgtccctgccctctgaatctgattccgctgcaggtatctaccgcttgcaaagttgcaattgaacactactatgtgactgcccatgcctgtcttcgttcctctgcagttccaactttctgggtccagaattagtatttgatgcgtacaaaactgaaatgagcaatagcttcattattcactggacactgtttttcgaaaaaggactggcgttatgccaacggaaagatgaaatgagcgatagctttcagtatttcagcgcggccagtttgttttcacctcgtgtagatctattttcgaatggaaattggtctcggtacgcatgtaaataatttttgtgatcaccaattcaccattgcgccgaggcaatttcttttttttttcgacaactagatactgcaactgtgatggagcgcgtaatgattcttgtaactggagccatgtcatcagaatatttttttaaaaaaaattgagatgcttattgcaaacgaataatcagagcaaaattaccataaaaaaaaaaaaaaaaaaaaaaaaaaaac

SEQ ID NO: 78427 - DNA, 717 bp, Triticum aestivum
  Clone ID: PAT_TA_78427
gcacttcccacattatataaggttttagagtctgctattgcagacagaggaactgggtcctcggcacagggacaagtaatttggatccactttggagtcaacagtggtgcaacaaggtttgcccttgagaaccaagctgttaatgaggccaccttccggtgtccagatgagttaggatggaaacctcagagggtccctatcgtgccctctgatggaagcatctcacggacgagagagactaccctgccagtgaatgaattgaccaagtcgctccggaagataggctacgacgtggtgccctccgacgacgctggtcggtttgtatgcaactatgtgtactaccattctcttcggttcgcggagcaacacggcatcaaatctctgttcgtgcatgttcccctcttcttgacgatcgacgaggaggtccagatgcactttgccgcttccctcctcgaagtcctcgcttcctcctccaactagcaacagcagttcaaagatcagcgtttggattcctatctcaaggatggatgtaaagctggatgcaggctgaataaggtggtgtggtcattggcgatagatgttgatcttgttccagaaggtgtgttcggaaaaaaaaaaaggaaattggtgcatagagtcagacacttggtgtatgttcgtgtggacgtgtggccaatgcggcttgtatgccatcatcagtcaagcgatgtaaacatg

SEQ ID NO: 78428 - DNA, 669 bp, Triticum aestivum
  Clone ID: PAT_TA_78428
accttcttctctctagtctctaccgatggccgtttcccccggacagcagccacgttctatgtagtatccaccacggcgaggttgctactggtgcagctcaaaccgagccgatcgagggacacacgactattaatacctactgcgcgtgtgttctgctcaagccgtggacagcgtttgatcgatcttctgcttaactgctttctacttttttggtagccatccgttatctcgacacagctccgaaaggttcggcgagatcgatggcaaccatgcctgctcctgtagcgacatgcttcgtccctgccacatcgggcgtcaggtgcagggcattctccacgccgatccccaattatagcgcaccgggcgtcgtcgctgatcccccgaagctgctgagtcgtccggggaacctgcagctaacgtcgggcggcgcgcggttctccggcaggttcagggcgtccgcggcggccgtgcacaaggtgaagctcatcgggccggacggcgcggagagcgagctcgaggtgcccgaggacacctacgtcctcgacgccgccgaggaggccggcctggagctgccttactcgtgccgggccggctcgtgctccacgtgcgccggcaagctggcctccggcgaggtcgaccagtcggacgggtcgttcctggccgacgagc

SEQ ID NO: 78429 - DNA, 457 bp, Triticum aestivum
  Clone ID: PAT_TA_78429
tccccgtctcctcccgatgccacacgccaggggcgacgagatggcgacggcgccgacgccggccgcgagcggctcgccgcgggcgccctcctcctcctctgcctcttcatctgcctcctcctcctcctcctcctctttcagtcctcctcctccgtcgttcctcatgtgctcctgtgctacaggaaaccctaggtgcttctgctcgaggaccccagctgcgcgtgccctcttcctttgcgccggcggctcagctccgcagctggatgtggcggttgctggcccctccacctagggttttgcagcggcggcggcgacgccaagtcatcccctcctcgcttctctctctgtgcgcacaggctcagccaccacatgtgatttgttaatgaatattgattgttagcctgctcttaggcaaccacagaacaaggactcctaggacatcatttcatcttctaat

SEQ ID NO: 78430 - DNA, 593 bp, Triticum aestivum
  Clone ID: PAT_TA_78430
cgctgaccatgaaaggagtgagtttcgagtacgtcgaggaggacctgaacaacaagagtgagctcctgctcaagtccaacccggtgcacaagaaggtgcccgtgctcatccacaacggtaagcccatctgtgagtcactcgtcatcctgcagtacgtcgacgagctgttcgctggccggtcgatccttccagccgaccccttcgagcgcgccactgctcgcttctgggctgcctacgtcgacgacaagttgttcccggcgtggtacggcatggtgaaagcccaggcggaggaggagagggcggagaaggtgaaggaaacgcttgccgcaatcgagaaaatggaagtggccttcgccaagtgctccggcaacggcaacgccgccttcttcggtggcgactccattggctacgtcgacatcgtgctcggctccttcttgttctggttcgaggcggtgcgcagggttgacggcctggagatcattgacgcgagcaagactccgctcttggctgcgtgggcggagcggtttggagggagtgtagaagcgaaggaggtggtgccggtgcctgaggcggacttggcggtacagtacatc

SEQ ID NO: 78431 - DNA, 189 bp, Triticum aestivum
  Clone ID: PAT_TA_78431
ggctgtcgcggtactacgagggcaagtcgcagtcgttcgcgtgcatgtcggaggtgcgctgcctggaggacctgcgcaagaaggacaacccctacaagcagaagatcaagtcgtgcaagagctacgtcgcgctgggagggatgatggccaagaagcagcccgcctccacctcctgcgtcaacctcgacc

SEQ ID NO: 78432 - DNA, 350 bp, Triticum aestivum
  Clone ID: PAT_TA_78432
aatgcttcggagctgtcgtcgtatgtcatgtgcgtgtgtcccgttggcagttgggctactctgggtgtgcatttgatgcagcgctacgtaccactgggtccgagtagctgccggaggacagtgcgaagtgcaccagcggctcggggcggtccacggcgaagccttgcaactcgtccttgtccctgctggacttccacttcgggtagagcagcagccgaagccactgcagaattcattcataaaaaaccaccaagaatcgactactctatcagccactgcaggattcattcataaggcataactaacctgtccagaatagtgtgctcggcatcacaggatctggtactcta

SEQ ID NO: 78433 - DNA, 473 bp, Triticum aestivum
  Clone ID: PAT_TA_78433
caaactatctttattggaaccctcatgttcaactttgcttcgttacaatccaaatccattcatagcgttgtgatcctgaagctctgcaccgccaataaggttattgagttctgttgcaaacaaaattgagctgcatgtgattttgttgctctaatatgtcttaacaggtagatcttgacaacattgatgaaaaagagcacccgaagactgcagctcttgaattcatggattgcatattggaggaaggtgacctgctttacattcccccaaaatggtggcattacgtgagatctctttctattagcttttctgttagcttttggtggcgaacgtcagatcttccttcaggaagttcataattgctattgttttgacaattttgatcatccatgatgtttctatcatcagattggtagagacctaataaaactttattgcgcccaacaaaaaaaaaaaaaaaaaaaaaaaaaaca

SEQ ID NO: 78434 - DNA, 560 bp, Triticum aestivum
  Clone ID: PAT_TA_78434
gcacgaggtaaaaatttcccaccttgacctagatgaactccgccagattccgccgctttacgggtgagctcgagcaccgcttgcccgagcagtcgattgtctcgagctcgccaccactgatcaagcgccttgccgctgagttggagctgatgcatggttcagctcgtgcaaattaatcaatgtccagctgcatcaaagtgcatgagcttggatcgagaaggtccatgatgtgatcgatgctaacatcgtcaagtattacgccaacctgtggatccaatccagcccgtgtgacttgattttgttcacccatcagagggatctgtggactcagcaggatttgataatgatgatgatgatggggcagaagtatcatccaagaatgcgaacgtaccgcatgttcctgtattctgcaattgtgatggcattggttcaggaatcgggagttcatcatggtgccaagatttgggagagttcttgttagtgtggaggcgcaatctgtgtagatgaaaataaaacaactgtgtatttgtacttatgtaccgctctaatcctttttcccg

SEQ ID NO: 78435 - DNA, 762 bp, Triticum aestivum
  Clone ID: PAT_TA_78435
gcacgaggcagcttattcctgtcgccgtgctcctttcgcctcccttcttccagcggcggcaccggcacgaagcagagcgaaccaccaggcctcagcgtgcggtggacggcgagagctctggcgccctagcccgagctcgcaaccatggcgaggggattgaagaagcatctgaagaggctcaatgcacccaagcactggatgctagacaagctcggtggagcctttgctcccaagccatcatctgggcctcacaagtccagggagtgcctgcccctgattctgatcatcaggaaccggctcaagtatgccttgacataccgtgaggtgatatccatcttgatgcagcgccatgtgttggttgatggcaaggtcaggactgacaagacctacccttctggcttcatggatgtcatttccattccaaagactggtgagaactacagacttctctatgacaccaagggtcgcttccgccttcactctgttagggatgaggacgcaaagttcaagctttgcaaggtccgttctgtccagtttggtcagaagggcattccgtatctgaacacatatgatgggcgcaccatccgctatcctgatcctcttattaaggcaaatgacacaatcaagattgatctggagacaaataagatcgttgatttcatcaagtttgacgtgggcaatgtcgttatggtcactggagggaggaacactggtcgtgttggtgtgataaagaacagggagaagcacaagggaagctttgag

SEQ ID NO: 78436 - DNA, 445 bp, Triticum aestivum
  Clone ID: PAT_TA_78436
accttaggaagctccgccgcctcatccttgacgccaagctcacgcccttccaccggggcgccgacgacgcgcgcgccgacctcgacgagtgcccatctacttcctggtaaccatcctcttccccatctgccccagatgcagttctacactaactactcctcgttgtgctgctctgtggcgacgccgaggcatccgggccttcctctaggtttcatctccaagggacgtaggtccccggctactgcgcgtgccgtgtcgtacaactccccaagcgaggaggagccaccagtcctgctgctcctccattttctatatgtgagtatagtaccggatttcttcatctaaattgcatcagtgttcctagatgtactacatgctgctgctctcaacgcactgggatatgatagatttaaattcatgtaccacttcactatgatgcacttat

SEQ ID NO: 78437 - DNA, 739 bp, Triticum aestivum
  Clone ID: PAT_TA_78437
cagaaggaatatgttgatttcgagccatattatacgcatatagtctgtcatgaatgctgccatggaattggaccccattctatcacccttccaagtggtaaaaagtcaacagttagaagggaacttcaagaattctattcagcgttggaggaggcaaaagctgatatagttggtctctgggcactgaatttccttattaagaagggattgcttcctaagagcctgtcacaatctatgtatgtctctttcctggctagctgcttccggtcaatccgctttggactggaagaagctcatggaaaaggacaagctctgcagtttaactggttgtatgaaaaaggggctcttgtcttgcactctgacggaaaattctcagttgactttacaaaggttgaggaagctgtagaaagcctgagcagggagatactgacaatacaggcaaagggtgataagccttctgcccagtctcttctccagtcccgtgcgaccttgacacaaccattgagagtggcattggagaagatagaacacatgcaggtacctgttgacattgccccgatattcggcacggcaaacaagctacttgcaaacgtttagttggattcagcaattcagcaaacgttgtgcttaccccccaggcccccaagaataaaggcagcgctaggaattgctcaagaataaggcagcgctccatgtcaagcaaagctgataaaaacaaggcgatgagtgacttttcatc

SEQ ID NO: 78438 - DNA, 508 bp, Triticum aestivum
  unsure (1)..(508): unsure at all n locations
  Clone ID: PAT_TA_78438
ttcacttccttccattcattcggagagtagtgcttatttgcccttgtgattcttttggagaaggcgagctagatcgtatttcaacttgtaggtgtttattgcacaaccacagctttcttttggctatttcttcctgcagtatttgtcgcttggatctggtctcatcgacattgccagggtgtggtatatttggaggcccaatcaaccgactactgaaattgagaatatgaaggagatgcaagttttatgaaggcttcatgaacatccttagcctctcaggaacaccagcgaatgtctgtctaggcgtagcaatattttttgtgcaaaagtgcatctttgtacaatgtctcaacattttgtatgtacaagagggttagctgtccagatactatgatgttttcaagtacagctgtatattggaagaactgtaaatttatatagcgaaaccaaatgctggcaaatgtttgtttctctccnnaaaaaaaaaaaaaaaaaaaaaaaaaaaaaa

SEQ ID NO: 78439 - DNA, 733 bp, Triticum aestivum
  Clone ID: PAT_TA_78439
gcagcgtagctttgcagatatactgcagtgctgaccaatacggaagccgtttcatacagcaaaaacttgaaactgccacagttgaagaaaagaacatggtctttgaggagatcatgccccatgcactatcattgatgactgatgtatttggaaattatgtagtacagaagttttttgagcatgggagtgcagaacaacggagggagttggctgataaactacttggacatgtattagctctcagtcttcagatgtatggatgccgagttatccaaaaggcaatagaggtggttgatctggaccaaaaaacaaagatggttactgagcttgatggtcatatcatgaaatgtgtacgtgatcaaaatggaaatcatgttatccagaaatgtattgaatgtgtcccagaagattctatccagtttataatatcaacattctatggtcatgttgttccattatcaacccacccatatggctgcagagtcatacagagagtacttgagcactgtgctgatccaaaaacacagcaaatagttatggatgagatattgcaatctgtatgcatgttggcacaggatcaatatggaaattatgttgtccagcatgttttagagcacgggaagcctcatgaaagatccatcattattgagaaattagctggacagatcattcagatgagccaacagaaatttgcctcgaacgtggttgagaagtgtctaacatttgggggagc

SEQ ID NO: 78440 - DNA, 640 bp, Triticum aestivum
  Clone ID: PAT_TA_78440
aagacaaactttactgtcagtgcaagggttgcagctgcaagaatacatggggaagctatgagtgcagctgtggtgatgacaatatgctatacatgagggagcatgacacttgcatcagcaaaaagggtactaccagtactgttggctggagcttcctctgggttattttctttggacttgtttttgccggggttggagcatacgctgtgtacaaatacaggctgaggagttacatggattcggagatccgtgccatcatggctcagtacatgcctctggataaccaagaaggggcaaaccagcatcaggtcgtgcacgcaaatgatatttgaagcggcactccttttctggagcagcatagaaggagcgcgcaacatttcacttgtgctgctgcatcattggacatgggttttacaaataggtcaactaggctcaaagatacacgggttgtgcgaggagatcaagatttactgtaacatgtattatgagagacgttgtgcacctcttgttacgacacttgatgaacagcataggggatgaataccatatcgtagttttagtagcacttggttgcctttagtttttcttcaaacttgtgagttcttgttgcctcgtcccatacattttcttttttttttag

SEQ ID NO: 78441 - DNA, 489 bp, Triticum aestivum
  Clone ID: PAT_TA_78441
ctcggctgctgagctccgccatgtcatgaccaacctcggcgagaagctgaccgacgaggaggtcgacgagatgatccgtgaggctgacgtcgatggcgacggccagatcaactatgaagagtttgttaaggttatgatggccaagtgaggagcggtccccatgaaataagtatatctataaattgaagcgagttatcatgcacaaaagctgtactttgtcatgtccctttgagtacgcatcagtatcatgcagttggtaatgtctgagtagtggtcggttttaggtggtgtagtcatgggaacgcgacatcagatacctggtttcttttgattgtgatgttatcttgcattattgcacacctgttggagcttttaggatttgttgaagctcgtatttttcaggggttttggttcttttgtgcgagtcttgtatcttgtgtgcgttgcattgcattgttgtgttatagctaaaaaaaaaaaaaaaaaaaa

SEQ ID NO: 78442 - DNA, 494 bp, Triticum aestivum
  Clone ID: PAT_TA_78442
tgcctttccccacctgtcgcggtgctcgccagtctagggtttcgccccccttcgcccgccgatccgcccccgccggccatgtcgaagcaaggagggaaggccaagccgctgaaggcgcccaaggtcgacaagaaggagtacgacgagagtgatcttgcttatttgcagaagaagaaagatgaggaaaaggcactgaaggagctgaaggccaaggcacagaagggcgcaattggaggctcgggtctcaagaaaagtggaaagaaatgagcctggtcacctgtctctaatacttagagaatgataaggtggctgcttatctgtgttgcgcttcactatatgtgattgtaaccgtgctacctattgtgttctgtgttttgcaaattgcaatgttgcagttggttgcttgatccgaaaatgtttcagcctcgcatctgctatctatgaaactgatggttccctgataataatgatgacattaaaaaaaaaaaaaaaaa

SEQ ID NO: 78443 - DNA, 672 bp, Triticum aestivum
  Clone ID: PAT_TA_78443
aacatggcaaagaagaggaccaatgttatccccattattgaggatgccaggcacccggcaaggtaccggatgctggttggcatggttgatgttatcttctctgatgttgcacagccagaccaggctaggatcttagcccttaatgcttcatactttttgaagaatggaggccactttgtcatttcaatcaaggcgaactgtattgactccaccctgcccgcggaggccgtgtttgctgctgaagtggagaagctcaaggcagatcagttcaagcctgctgagcaggttaccttggagccctacgagcgtgaccatgcctgtgttgtgggtggttacaggatgcccaagaagcagaaggctacctcttagatctgaatcggtgcccgtccctaccaaagaatgctatatgttgtattggggtgacaagaaactttgaagtattagggttctatatagcatctactatgtgtacggtacctgctgcagtgttgctggtttaacggcagttttttttgttgatgaaaaacgtttgagccatcagctttgatttgttgctcttgtttcttgaagtcacggactgagttatcttccgttctgggcataacggattcgacatactcatcctgctctcgaggagtaggggaagttgccagatttaaggctccattaaat

SEQ ID NO: 78444 - DNA, 350 bp, Triticum aestivum
  unsure (1)..(350): unsure at all n locations
  Clone ID: PAT_TA_78444
cgaaaataaatcccggaagtagcatgactatttattattaagttatttttctctctcttctcccaaaacaactagaacccgagcagcattgactcgtggaaactgaactgttgctactgttccaaaaagtgaagaacctggagccaacacgagcttgtgccaaagaggcctgaaatatttgcagaagctcactctgtctatgcacaatcagttgcagttaaatgtttaggttggcattgtagtaactgccggatgctgtttgtggtttactgagcttttatcggctcgtggaagccgttgcaactgtagcaaaaagagccgagttttttttttacngaaaaaaaaaaaaa

SEQ ID NO: 78445 - DNA, 599 bp, Triticum aestivum
  Clone ID: PAT_TA_78445
ggcatagaggcctcaaggttgcttgaatctgaaggagttcaaacacatctaacatttgtttacagtttcgcacaagcagcagcggcagcacaagctggtgcatctgttgtacagatatttgtggggcggttgcgggattgggcaaggaatcactctggtgatccagagatagatgaggctctgaagaagggagaagatgcagggcttgctttggcgaagaaagtatatgcctatattcacagaaatgggtacaaaacaaagttgatggttgctgccatacggaacaagcaggacgtatttagccttctggggattgattacatcatcgcaccactgaagatattgcagtctctggaggaatctgtcaccgatcctgatgtgaagtacggttatgtcccaaagttgacccctgctattggcaagacttacaacttcactgaagaggagcttgtgaagtgggaccagttaagcctatcagctgcgatggggccagctgctgaagaactgcttgcttcaggactagagggatatgtgaaccaagcacgccgcgttgaggagctctttgggaagatctggccacctcccaatgtttaacaacg

SEQ ID NO: 78446 - DNA, 634 bp, Triticum aestivum
  Clone ID: PAT_TA_78446
ggagaacatgagaatctttccctcgttaataaaaatggtaccccctcgaagacatggaagagaagcattacccatgtctacatgtgtcatctcatccaaatgcatttggacaaagagaaggcatcacaaaaccgggtaaaacctgaggaagtttgtcacagtcacatttcaaggtctccagacggttctaccataagtaagaatggtgcacaagacgagaagttctacgccttgcatttcgatgtaaggctacctgttcagccatcttgcagtgtttgcgacacgaccattgcccgacaaaagatggtcagtggtaattttctgaacttgcccacttctgcggcgttatcaggggtgcagcatgttcagtatttacatcccccgatcgctccccgcggtgcaatgccatatccaattcagcatctcccttacaccagggggaatttgacgcacactgcactactacttcaacagcagatgccacagtacatgtgcaatccaaacccagccattatgaagattcagcagcagctcatgcccaatcagcatcagcatcagcagcagcagcagatgtggcagtttcaattccctcaataccatcatccaaggccagacgccgccgccgccgccgccg

SEQ ID NO: 78447 - DNA, 682 bp, Triticum aestivum
  Clone ID: PAT_TA_78447
ccacacaccagcagcagcagcaagtcgatcgatcgtcagcacacacgaccaagatcgagatggcccgtgcacagctggtgttggtcgccctcgtggcagcggctctgctcctggcgggcccacacaccaccatggccgccatcagctgcggccaggtcaactccgccgtgtcgccctgcctcagctacgcccgcggcggctccggcccgtcggcggcctgctgcagcggcgtcaggagcctcaactccgccgccagcaccaccgccgaccgccgcaccgcctgcaactgcctcaagaacgtggccggcagcatcagcggcctcaacgccggcaatgccgccagcatcccctccaagtgcggcgtcagcatcccctacaccatcagcccctccatcgactgctccagcgtgaactaatctgatcgatcgatcgctaccggccggagggtgtgacatcgcaggccgtacatgcacctgtcgtcgtctcacgctttgtatcttgtgttatctgtgtttatgctgaataaaatgagagctagctagctaggtcgatccatcgatcgccatgcatgacgagactagctagcattgctgctagatcgatgcatgcatatggttgatcgcccggtcactacgctatctgtttccttaatttattcgtcgatcgactacgtacgtacctg

SEQ ID NO: 78448 - DNA, 480 bp, Triticum aestivum
  Clone ID: PAT_TA_78448
acgccgcggtgctcaacctggagatggccttcgccgagatcacctccagcaacggcggcggcaacgacgacggtgcggcggcgggcttcttcggcggcgactccgttgggtacctggacctcgcgctcgggtgctccctgccgtggttcggggcgctgcgcgccatgttcggcgtcgaggtcatcgacgttgctcaggctccgctgctggcggcgtgggccgagcggtttgcggaaaccgccgtggccaaggaggtgctgccggagccggaccaggctgtggcgtacgccaagaagattcaggcttactgggcttctgctgcttctgctaaaaagtgacgctgttcagaattcagagtacactgagtcctgtaataataataaattgaagcagaaatctcaagaggatcattctgtacctgtaatgaagattataactttgtaaatctgtcatttaccacctaaaaaaaaaaaaaaaaaa

SEQ ID NO: 78449 - DNA, 641 bp, Triticum aestivum
  Clone ID: PAT_TA_78449
ccctctctgcttctttatcaggaataaaggcgcattcgttgttgaaggaggggagcgatggagcacgggtcgttggacgattcgagctcgtcgacgttctctatcatggaggaggaccataccctggccaactctgtcagattcgtcctcaaccaggacccaagggtcgcattttgtggatacagcattcctcatcctgctgagaacaaagttaacatacgggttcagactacaggagatccagccaaggatgttctgaaagatgcattgcaagacctgatggtgatgtgccagcatataagggggacacttgacactgcagtggctgattttcgagggaacaaaacagcagaagccatggacatcgatttgaacaaaaaatagaaggttccatatggtcattagcaaattgcagaaatacccatatggccgcgtatccttagaccttagtgtgcaactcagttataaattattcagttgtatgggatgtagtccttcaagtaggcttaaaccaaagtacgaaatggcattgccactggggtacttgtctgagtaaaattcgtgcacctattctggtgttcctttttcttgtgtgtgtgtgtgccatatgaaaatcacatccaaaaaaaaaaaaaaaaaaa

SEQ ID NO: 78450 - DNA, 480 bp, Triticum aestivum
  Clone ID: PAT_TA_78450
aacctgacacaaagaagaaagggatgcccgacagggtgtgggacgacaaaccttccaacaagaagctggattttacagacccagctgatgagagaggggacgaggtgacagacaatgtggcggtcattgagggagaaagcatgatggataaggatgaggatctgagcagcgacagtgaggacgaagaggtggaagatggacccaaaaagaaaggatggttctcatcaatgtttcagagtattgctggtaacaatgtattggagaagtctgatctgcagcctgcgctcaaagctctcaaagataggctgatggcaaagaatgtggcagaggaaattgcagagaagctttgtgaatctgttgcagctagccttgagggcaaaaagctagggtctttcaccagaatatcatctacagtccagacagctatggaggatgctcttcttcggattttgaccccaaggcgctctattgacatactga

SEQ ID NO: 78451 - DNA, 599 bp, Triticum aestivum
  Clone ID: PAT_TA_78451
ccgcctccgccgccgccgccgtttccgcctccgccgccgccgccgagctcctcccgcgcgctccgagcccatcatggcggacgtcgaagtcgagacggaggtcgccgccggcgcacagccaaagaagagaacgttccgcaagtacagctaccgcggcgtcgacctcgacgcgctcctcgacatgtccaccgatgacctcgtccagctcttccccgcgcgcgcccgcagaaggttccagaggggtctgaagaggaagcccatggcgctcatcaagaagctgcgcaaggcgaaaaaggatgcccctgccggcgagaagccagagccagtgaggacccacctccgcaacatgatcattgtccctgagatgatcggaagcatcgtcggtgtctacaatggcaagaccttcaaccaggttgagattaagcctgagatgattggtcactaccttgcggagttctccatctcctacaagccggttaagcacggtaggcccggtattggtgccacccactcctctcgggtcatccctctcaaatgagtcatgcagcttctagccatccagaatcagaattcagtgttaagcgcccatggcttgtcct

SEQ ID NO: 78452 - DNA, 681 bp, Triticum aestivum
  Clone ID: PAT_TA_78452
ggtcgctactacaaccgctacaccctcctcgacctcaccacattcgacctcgatgaagagtcacccattggtccgatgcaatttactgattccccccacaaagtaatcgagaccgaccacttcaaactgtctggggctgtaaacttcttgtctgtcaaggtagcctcttcagatattggcttcccaatccatgtgtatggcactgtcattgtcagggacagcatcgatgagaggtgtgtttatcacttccgctgcgaccctgaccattgccaactcatcaattctgaggctgaatcgttgatcttgactgggccgaaacgtgggctcgcattgtgtggttacatgtatgtggagattgatctaaagatcaaggatcatctaggacagtccagagaatttagtaaaggactcttaagcatcagtgacccaacaaattgtgcatcgatggtatctatggtcgaaactatatcccttgctaccaggctcagtactgtggacgtgacttatgcagttgtgaatcgtgcagcggagggatttattgcagttaaagttctgcagggaggtttccatggaaaaatcaccgcatacaccaccagcgtcaaggacatacttgtgctttatgacagcaaagaggctgatgctatgacctttgatgattgtggagatatcctgcagcttatg

SEQ ID NO: 78453 - DNA, 501 bp, Triticum aestivum
  Clone ID: PAT_TA_78453
cagattttcagagtgagtgctcgtgtgttgtgcgatcagtgcccgcagttcgatcgatccgtgttgatctttgaaagaaagatgtcgtgctgcggaggaaactgcggctgcggatccggctgccagtgcggcagcggctgcggaggatgcaagatgtacccggagatggctgaggaggtgaccactacccagactgtcatcatgggtgttgcaccttccaagggtcatgccgaggggttggaggccggcgccgccgccggagcaggagcagagaacgggtgcaagtgcggcgacaactgcacctgcaacccctgcaactgcggcaagtgaagcaagcaacctcctgacgaaaccaaggagatggaagggcctagtactgctaagctagtagtttgatccagttacaagtgatgagttattgtcactgtaactttgtgtttcctctgagtttgtgatctaagacctgagactgaagaaatgcatcctagctaaataagtgct

SEQ ID NO: 78454 - DNA, 619 bp, Triticum aestivum
  Clone ID: PAT_TA_78454
gaggcgcgtttttttgaaaggttcaatgggcgtctacctggttacatcgggcatgggtatgaccggggatcgttcagccatgtcgatgatgtcgtcaaagggcacatagcagccatggagaagggcagagtgggcgaaagatatctgctcaccggagagaacgcgtcattcgttcagattttcaacatggctgcgaatcttacgaacacaaagccacccaaattccacatacctctatggttgcttgccatctacgggtggatttcagtttttgttgctcgcatcaccggaaaacccccactaatcagttaccctggagtggattgtctcagacatcagtgggcttactcatgtgacaaggccaagagggagctgggttatagtccacgaagcttaactgaaggcttagcggagacactcttgtggctgaaaaatgcaaacttgatcaagttttagttctctacccatttcagtttgatattccattttgataataatgtcatattgtcatcttaaataacttgcatggatggtatagaaacaaataaggtaagaaaatgtgatggcagaaagcataaaaaaaactttgatatattatgccaaaaaaaaaaaaaaaaaa

SEQ ID NO: 78455 - DNA, 702 bp, Triticum aestivum
  Clone ID: PAT_TA_78455
tgatggtcccagctcatactgcattaccagctgacttatcagtcaaggatgagagggaattgaagcgtgaaaagaggaagcagtcaaatagggagtctgctagacgatcaaggctgagaaaacaggctgagacagaggagttggctacacaagtggagtcccttactacagagaacacgtcccttaggtctgaaatcggcaggctaacagagagctcggagaagctcagattagaaaattccgctctaatggtgaagctgaaggacactgcagcactgacccctgcagaaccatctccgcacacagcagtcacatcctcgtcctctccgggtgccgccgcggaaaatttcctttccatgatcgacagcgccaaggcggccggcgtcagcaggcacacggagcacggcgagcccaagctccggcagctcctggactccagtccggcaacagacgtcgctgccgtaagctgatgacgatccggctaatattacagcacagcacatgcatgtggcctggggatttcacaagctcatgctgcgcaccataaatgtcagagttattacagacttagtacaccagtttaggcactgattccagtaaagtaactgaggacaccggtaattttatctgctccgctgagtgccggactgcgacctctcctagtgtaccagtgttgtaacatagggtgttgtgctgcatgcc

SEQ ID NO: 78456 - DNA, 410 bp, Triticum aestivum
  Clone ID: PAT_TA_78456
ttgattttgcacccaagtggcgactaccaattcaccaaggacccctgctttctctatctgaaagcgaaaggagaggtgactgaaaccgttcagctgccctgcaactagccttaaacattggtggctaaagagcgagggtttttaggaactgcagtttttgtggccttgctgcacctgtaaataactactatgattccttttggtttctccttcagacattaggctaaatagatgtagcggaggaagctcacaagaactagctaaatagttctctaggaagaacccgctacatagcaagaaggatcctttttgcctgtcgccatttgttgctcttcctgcatgtgaagttgtgaacgcaatccaagttcctaattctataaaaaacaacaaaaaaaaaaaaaaaaaaaaaa

SEQ ID NO: 78457 - DNA, 484 bp, Triticum aestivum
  Clone ID: PAT_TA_78457
tgtcgcatatctgagtgttggtggcttttgccttttccttgcactgctttttttagttctctacatgattaagcccaggactcttggtgacccctcattcttgtcatggaataggtgtaccctggactatccaaactaatacgtcggaaccttctctttatagaaatagaagagcaatctaatgggcaggattataggctccatgggtgtggatatgctcctagcgcacatttcagggccaatctctgtgaccccttcttcctgtgtaattatagttccactgatcaacaaccttgttctagagacgtcatgaattaattaagtgaaaggaaaaggaggaggaaccattgcccattggactatgctgcacagtttcagcttgtgtcctgcattgctcacctcaaacaatgacactgcacacaaaggtggaaacaatattactccgatcagttatggatgcatgcacataccagaaaaaaaaagg

SEQ ID NO: 78458 - DNA, 500 bp, Triticum aestivum
  Clone ID: PAT_TA_78458
cggacgcgttggcagttttggaaacgctggagggtgcgttcgccgagtgctccggcgggaaagagttcttcgccggcgacgagcccgggtacctggacgtcgtgctggggggcttcatcggctggttgcgcgcctgggacaaggtgggcggcgtcaagctcctggacggcggccggaggaccccgcgcctcgccgcgtgggcggagcggttcgccgcgctcgacgtggccagggacgtcatcccggaccccgaccacatcgccgagttcgccaaggtgctgcaggcacgctccgcggcagcagccgccgccggcaactgagctcgatcacaagtgaatgctgctctgccttcctgagaagtcatggtttgtttggctggcgaggataaaacatggtttgttcactgaaatagctcgttggcttgccatctgttttagcaaaagtatgcatgcttgttatttattcataataattgatcgatgaaaaaaaaaaaaaaaaaa

SEQ ID NO: 78459 - DNA, 634 bp, Triticum aestivum
  Clone ID: PAT_TA_78459
gctgttattttgaatctccaagattaagctaaaatctgagcatgtccgtgtcattgatagagccaagttgagaatatatccagctggaactgataagcgcaaacttcagcttgaactgcacaacctcaaatccatccttccaaaagtgattgtgaagggcattccaactgttgaaagggttgttattgacgaagttaaagtaaaaaacgagacagaaagataccaattgttggttgaaggaacaaacctcctggcagtcatgggtaccccaggagttgatgctacgaagacaaaaagtaatcatatcatggaaacgaaccaaacgcttggaattgaagcagctaggagatctattattgatgaaattcagtacacaatgaaaagtcatggcatgaacattgatcggagacatatgatgctcttagcagatttaatgacatacaagggtgaaattctcggcattactagatatggcattgcaaagatgaaaagcagcgtgctgatgcttgcttcatttgagaaaacctcagaacatctattcaatgcctcatacagtggtcgtgaggatcagatagagggagttagtgaatgcattatcatgggcattcccatgcagctcggtaccgggattctc

SEQ ID NO: 78460 - DNA, 441 bp, Triticum aestivum
  Clone ID: PAT_TA_78460
tattatatcactgggtgagagcaagaaggcagtggagaactcccccttcctggagaagctgaagaagaggggctatgaggtcttgtacatggttgatgccattgatgagtatgctgttggtcagctcaaggagtttgagggcaagaagcttgtctctgccaccaaggagggtctgaagcttgacgagaccgaggacgagaagaagaggaaggaggagctgaaggaaaagtttgaggggttgtgcaaagtcatcaaggaggttctgggtgacaaggttgagaaggtggtggtgtctgaccgtgttgtggactcaccgtgctgtcttgtcactggtgagtatggctggactgccaacatggagaggatcatgaaggcgcaggctctgagggactcgagcatggcgggctacatgtccagcaaaaagactatggagatcaaccc

SEQ ID NO: 78461 - DNA, 710 bp, Triticum aestivum
  Clone ID: PAT_TA_78461
ccccagagtagtacagcgtcgatctctgcagccgtggttagcaacagcaagcgaaggcgagtgaaagaaactcgatcgatcatcagtggcggtgaaagaaacaaaccaggacgttcgaacgatacaggagagatgaagatggagcaggtttcgcagaggaaggcgccgctcctggttctagtaatcttgtgtggccttcttcttcttcttcccctggtttcatctgtgcctctgtccagaagcgtgtccttgaggaaccaccaagcatcagtctctgctctggaggcgcctgttcaggttgtgtcggcggcggctgaagagcgagacctcgacgaagtggcggcgaggatggtgatcgaggtcaacgactaccctggctccggcgccaacaaccgccatgatcctaagagccctggaagagcatgaaacgatctctgatctgatctgatctgcagggccttgttgatcgatacatataggaatattcagtattagcttttgtacgtagtgatcgacatgcatgtgtgatatatgcagtgcttggacaggggcttagttagttaagtcttcaccgattattatcagatcgggtgaagaggttgattagctagctaccactctagtttaaaaaagagaaggaaacttttcaacaagttccttgtgatatatgtatctgcacgtacatgtgtccatgtccaccccatccgccc

SEQ ID NO: 78462 - DNA, 717 bp, Triticum aestivum
  Clone ID: PAT_TA_78462
ttatgggtcgtggcctgttagctaaaacgatatccctatagtatatgcgctggagatttgatcgagaattgatcgtgtacgtcagttcgcgtccttccggctgccgcgtctattcgtttctcaattccaatctttattgtttccgtctttcctgtggtctacgggactatggcggcgctggtgacgcaactgcagaactgctgccggcggcaagcagccgagcaccagtcgaccaccacacattggactccatcgaaatctccacgaccacgatctgaatcctagcggctccaatctaaactgttcagtggtctacgatctgcacagatagacagtctatagacaaagtgcagacgccacataggaattattgaaacatgaagaggaaatgcgatattgcttgtatgtttgagaaatatgaagcaaagaacaaggcggcttctccatctccttccctggttgcagctgatccagaagaacaaattgaagaacaagaagatgtggctgcagctggttcagaagagcaaattgacgaacatgaaggtctgcagtcagcaaccaagatcttagggtgttgctgattcttctcagagagcttttcaaggtgctgcaagatcatctcaaagacgtcaggcggtgttagctagcttgttggcaggaaggatgttggaagtaaacttgaatgcttttgtattgtactggatgctatcttatggt

SEQ ID NO: 78463 - DNA, 611 bp, Triticum aestivum
  Clone ID: PAT_TA_78463
ggcgccgagcatgggctactccttctcctactgcctcccgacgtcgtcgtcgtcgtccgggtacctgtccatcggctcctacaacccggggcagtactcgtacacgcccatggcgaagagctcgctggacgactcgctctacttcatcaagatgaccgggatcaccgtcgccggcaagccgctctccgtgtcggcgtcggcctactccagcctgccgaccatcatcgactccggcacggtgatcacgcgcctgcccacggacgtgtactcggcgctcagtaaggcggtggcgggcgccatgaaggggacgccccgcgcgtcggccttctccatcctggacacgtgctttcagggccaggcgtcgcggctgcgcgtgccccaggtcagcatggccttcgccggcggcgcggcgctgaagctgaaggcgaccaacctgctggtggacgtggacagcgccaccacgtgcctggcgttcgcgcccgcacggagcgccgccatcatcgggaacacgcagcagcagacgttcagcgtcgtctacgacgtcaagaacagcaagatcgggttcgccgccggcggctgcagctgaggcggagaagctacacgcacagatc

SEQ ID NO: 78464 - DNA, 752 bp, Triticum aestivum
  Clone ID: PAT_TA_78464
cgtgctatggtttcgaccgtttgagaacacgactggccaacgagtgttcctcgaagcattatacgtttccaaaccttaccgacagaaatacgtcgaacaagcactttttgagaaaacgattcaaatctattgaatggaggtggacgagttatcaatcgccatgccgccgctgtgttgtatgttgtaaccatactgactatatatacatcaacgcgtctgcaggcccaatgcttataatgttatacatatcaatagcaataataataacaataataactattattatcctcgtcgtataattgtatgctattaaaaatccgctgcgttatagaaaaaacggaaaattaggacaactgcaaactgaatagaacgaaaacaattattaataataatattatattcacattgttatatgtgttgcggacgtctactacaaaaacggaactgtaggtctgtagcggattacccaaagatcgaaagcggaaatgagtgaccccttaaagggctcatagagaccacccaaaccggtcccatgtcacacgccaccttaaattaagaaacatcgtgccgcgtcgatacagtattatttatttatcaacatacattgtatctatcatcacaatgacattttattccgcgacgagctgctgtactataatattattttattcgttctcgccaagaaggcgttgagattcgactatctggtgacacttttttgaacggatatttctaattcagccatactcact

SEQ ID NO: 78465 - DNA, 442 bp, Triticum aestivum
  Clone ID: PAT_TA_78465
tgctgaccaacgcatgtacaagagtacagtggactgctggtctaaactttacaagaacgaaggagtttctgctttcttcaagggtgcattctccaacgtacttagaggtactggtggtgccttggtgttggtcttctacgacgaactcaaaaacctcatgtaaatttcatttttttaatgaaattgaacaatattgtgcagtttaaatgtaattcaatggacactgttgtagcataaacattcctaacaagtgcaacatttattattcataactgggcttctcattccaatttttcatgtattattctgtaccgtatttgttttaattttatcagttatgatccaaatttttttagaaaacctacttatgtaaacaaactatttaggtccggttaatggtttatttttgatattgcattatttatttcataattaataataa

SEQ ID NO: 78466 - DNA, 638 bp, Triticum aestivum
  Clone ID: PAT_TA_78466
ccctccacccgccgccaccgacgccgtatccccttccgccgtcaccgcatccgccgccgaagacgccgcagctgccgtgccatggctaagggccaggcccacgacaaagcgacgggcaggtttctccccaagacagccaaggtgaagggtgcccaggagaccaaggcaaagtccgccgccgcaccctgcatcttcctagagatgggtcttctgcaagaccgatttgaggcgaaagatttgaaggatcgtctactcaacctggaatacatggtcttcaagaatgctatcgaagtcgcagaagatttgaaggcgacggacaaagttatcgcatagctgtaggagcacctggagaaactaaaggagaagaaataaggatctgttgactattatgtagcacctcctatgtcttttgtttggttttctggatgtacctgtatatgtggagcttgtatgttgtcttttaggtactggttatgcataagtcgcacttgaagttggatgtaagaacctaatagcaatatctaatcaggatatgtcttttgttctagaatgctgccatgtctcatagcatcctgatgtgttgctttgtttcttttctataaataaaagcatgtttttctgctggaacagaacaaaaa

SEQ ID NO: 78467 - DNA, 680 bp, Triticum aestivum
  Clone ID: PAT_TA_78467
cttttgctccaccctacttagctccaaattcaagtgctgaaatgatgaacagtggtgttaattatgcctctggttcttctggcatatttgatgagaccggctctttttatattggaagagtgccactagggcagcaaatcagctacttcgagaaaaccagagctcgaatactggagatcatgggggagaaggctgctactgggttcttgaagaaggcgctgttcacggtagctgcaggatccaatgacatcttggagtacctttcaccttccatgccattctttggacgagaaaagtatgatccttcagtttttcaggattccttggcttccaacctgacattttatctgaagcggttaaatcaacttggagcaagaaaaattgttgttgctgacgttgggccactgggatgcataccgtatgttcgtgctttagagttcattcctgcaggggagtgttcagcatttgctaaccaactcactcaaggttacaacaagaaactgaagaggatgatctacaagctgaaccaggagatggggcctgagagtagatttgtttacgcaaacacgtacgagatcgtgatggaaatcattcagcagtaccgtcaatacggctttgagaatgcgctggacccatgctgcggaggcagctaccctccatttctctgcatcggcatcgct

SEQ ID NO: 78468 - DNA, 450 bp, Triticum aestivum
  unsure (1)..(450): unsure at all n locations
  Clone ID: PAT_TA_78468
aggacctgacggccggactggctatgtggcaggatacgtgctgtggagaacatcgcccagctgatggctccggcagcagaaagcccggccacggccacggccacactggctgcttaaaatgtaacattgttgtgacatctcgagggacgagggatgtgcgtcacagcgtcagtcaacatgtttaggtttacaattgtgttggttcattgtgttcagaatccgcttaaactctgagttcattgtgttcagaatctgcttaaactgtgttgaagtgagctttccattcggcaatgtctgtacgaagctcgatcgtgtatgtcttgtaagtgttgtatttcaaagataaaaatgtgactgttgtgcgtcttgtgctggtattattatcgaacttgacgtctaaagaaacttggttgtttacactatgtatgacagcttcngaaaaaaaaaaaa

SEQ ID NO: 78469 - DNA, 509 bp, Triticum aestivum
  Clone ID: PAT_TA_78469
ttttttttttttttttttttttttttggcagaaaatttttggtgcattatttcttcattcacctcgctttccacgagatcaccggctagttaggggaaaacgcaagtaaaatgattacaacaagcgcacactccactattgatttaaacataatatgagaacaaaaaagaagctccctagaaagacaggtaccaaaccataccatcatatagcagtatctggtggtatagcgctttacaactagggctgctcagtcagatcagccacacggttcttttgttttcaattcatcaccggaaaatttttttgtctgtaataatcagagatgactccgtcgcaataagggggggggtcgggcgccaaaggtttttttcgtcgacatcgatcgcagcaggcggctctcacaccgggtacttctgctggatggtgtcgatgtccagccccttgagcttcaccaccgactccacgtggcccttgagggggttgagctccctcagcctcgcgatctc

SEQ ID NO: 78470 - DNA, 375 bp, Triticum aestivum
  Clone ID: PAT_TA_78470
acacaccatgtgccattgacttggcttggaaagggtggtctccgggaaaacaaattgattctttgatcatgatgctcctgcgactaccggagtgaggaatttgttacatatatttgttctttaattggaggttcgctatctgatgccttctgtgacggggctgccgcaccaactatttggatgtctgggagcaactttatctgcggaatctggaagagatgtgtctgatgccttgtcgtgctgaaattttttgtcgttgatttgacattattgtctaattataactaactagtttaaaattttatcttgcaaatacagagaagtggtattatttatcttttaaatatactatgtttagaaaaaaaaaaaaaaaaa

SEQ ID NO: 78471 - DNA, 492 bp, Triticum aestivum
  Clone ID: PAT_TA_78471
tggctacaaatgaagcttttgaccaagagggttggttcagcactggagatataggttggattgtacctcaccatggaatagggccaagtcgccagtgtggagggatgattgttcttgaagggcgtgcaaaggatacaatagtcctctcaacaggtgaaaatgttgaacctgctgagatcgaggaagcagccggcaggagtaacttgattaatcagatagttgtgatcggccaggatcaacggcgtcttggtgccataattgttcccaacaatgacgaaattctggcagaagcaaaaaggaagtccatccttggtgagaatggcgacctagccaaagataaggtcatgaacatgctgtatgatgaattgaaaacctggaccatgcattgctctttccgagtcgggccaattatgattgtcgacgaaccatttacgattgacaatggcctgatgacacccaccatgaaaataagaagggacaaagtgacagaca

SEQ ID NO: 78472 - DNA, 220 bp, Triticum aestivum
  Clone ID: PAT_TA_78472
tcgattggaggaagctactggcctggcattccgctttgtgattgggaaaagcaattcaaagaacaagatggctgctcttaatagagaagttgaagaatatgatgattttgtgcttttagatctcgaagaggagtatagcaggctcccatacaaaacgttagctttctttaaggctgcctatgcattgtatgattctgattctatgttaaagcgatgatga

SEQ ID NO: 78473 - DNA, 540 bp, Triticum aestivum
  Clone ID: PAT_TA_78473
caaatagatttcagtgctgggaccagttccaaacctggtgttttgactaaaaaaccagctggtattgatggggatggtgcagaggtggatggcttgtgtaaagacgaaggtccgccacctgcattagaagaccggcggcctagaaagaggggaagaaagcctgcaaacgggagggaagagccactaaatcatgttgaggccgagcgccagaggagggagaagctcaaccagcgattctatgcactgagagccgttgtacccaatatatcaaaaatggacaaggcatccctccttggtgacgccataacatacatcactgacctacagaagaagctcaaagagatggaggtagagcgagaaaggcttatcgagtctggaatgatcgatccgagggatcagacgcctcgacctgaggtggacattcaggtggttcaggatgaggttctagtccgagtgatgagccccatggaaagccaccctgtcagggccatcttccaagctttcgaagaggcagaagtccatgcaggggagtcgaagatc

SEQ ID NO: 78474 - DNA, 291 bp, Triticum aestivum
  Clone ID: PAT_TA_78474
ggtaaggccttgttcgtttgacagtgtttgagggtgggaattgttccagctaatctatattagtagaaataaacctatcaatccacctggaataattccagggcatccaatccggatgaaacgaacgggccctaaaggatctggtgggaattttcttgagtttatatcactacgaaaagcgatgattgacttgtctgagttctggttattataccgtgttgtttctgtatggccctcggcccctggcctatccagcagttgacagttctgtgttcaaaaaaaaaaaaaaaa

SEQ ID NO: 78475 - DNA, 539 bp, Triticum aestivum
  Clone ID: PAT_TA_78475
accccgccgccggacgcgaggaagagacggggggagccccggaggcaggagcggcgggaggggatggcgatgcagacggggttcgccacctccaaggtcctcatcctcgtcggcgcagggttgacgagctcgatcgtgctgcggaatggccggctatctgacgtgttggcggagcttcaggagcttatgaaaggtgtaaaccaaggagaaggttcgagtgcctatgacatcgcccttcttcaatctcagattcgaaatttagcacaagaagttagagatttgactatatcaaggcctattaccatattgagtggcaactccgactctggaggcagtttatcctcctacatactgcctgcagctgcagttggagcaatgggttactgctatatgtggtggaagggattgtccttatcggatgtcatgtttgttaccaaacgcaacatgaccaaagctgttgagagtatgtcgaagcaattggatcaagtgtcttcagctttagctgcaacaaaaaggcatctaactcagcgcctggaaaa

SEQ ID NO: 78476 - DNA, 660 bp, Triticum aestivum
  Clone ID: PAT_TA_78476
ctctcgttccccggatccgccccgcatgtgcgcgcgcttgtaatcgaggagctgctgcggccaacaccaatcgaccatggcgacccgtattcagtttgagaacaactgtgaagttggtgttttctccaagctcacaaatgcttactgtctggtagccataggaggctcagagaacttctacagtgcctttgaggctgagcttgcagatgccattcctgtggtgaagacctctattggtggcaccagaataattggccgactctgtgttggaaacaagaatggacttctattgccacatactacaactgaccaagagcttcagcatctgaggaactgcttgcctgatcaagtggtggttcagcggattgatgagaggttgtctgcccttggcaactgcatagcctgcaatgaccatgttgcgcttacacaccctgaccttgacaaggagactgaggagttcattgcagatgtgcttggtgttgaggtgtttaggcagactattgctggaaatatccttgtggggagttactgtgccttctctaacaggggtggcttggttcatccccatacatccgttgaagaccttgacgagctctcgacgctcctgcaagtccctcttgtcgctggaactgtgaacagaggcagcgaggtcattgctgc

SEQ ID NO: 78477 - DNA, 671 bp, Triticum aestivum
  Clone ID: PAT_TA_78477
aagatcttcctggcataagaaaaattattcggccgctggaggattctggcgttttggtgcgcagaacagatgcagagcttcttgaagcgttagaatcattttatgttgttgaaagagatggttcaatcatcgcttgtgctgctctatttccatttcccgaggaaaaatctggtgaagttgctgcaattgctgtatctgaagaatgtcgaggaagaggtcagggggacaagttacttgattacgtcgagaaggtggcattatcccttggtctcgagaaactattcttgcttactacacgaactgcagactggtttgtgcggcgtggcttttcagagtgctcaattgaatctatccccgagcagaggagaaaacgtatcaatttgtcccgtggatccaagtattatataaagcagctgcagccaaagcctgctggggttaacgcgaacaattttgtcatcagatgactcagcacgcacggagcttggtgccacttaagaagatagctaagatcacaccaattttgcgcttgcccaaaggcataatttcacaaagaatcaaaacaccatctttgtttaagtatgtgaaggaagtttgtttcaccaatggaatcaaggcagagaacaaacagctgatcgaattatatgtaaaccctattaacaagcaataccaaa

SEQ ID NO: 78478 - DNA, 638 bp, Triticum aestivum
  Clone ID: PAT_TA_78478
gtttcagccagccacgcctaaagggccggacccgaaatggcggtacatgtggagagtgggtcctcgccctgcaaatacccgctttaaggagctaaactcagaacctgttatccctgagggattacctgagtggaaagagacgatggattcctggggttctaaaatgatttctgcaattgaggttgttgctgagatggctgcaattggctttggcctgtccaaggacgcatttacttctttgatgaaggagggaccacatctcctagcaccaactggaagtgacttgcagcgtcatggttctgagggcactgtttttgctggattccactacgatcttaattttttgacaatacatggccggagtagattcccaggcctaaacatctggttaaggaatggtaaaaagatggaagtgaaagtccctgttggttgccttctaattcagtctggaaaacagctggaatggcttactggtggcgattgtttggctggaatgcatgaggtagtggtgtctaagagaacgctagatgccatagcactagcgaaagagcaaaatagaagcttgtggagggtttcatcaacattggtcgcgcacattgcttcggatgcaattcttaagccgctcggccactttgctg

SEQ ID NO: 78479 - DNA, 473 bp, Triticum aestivum
  Clone ID: PAT_TA_78479
aggaagaggtcccagggcatccgttgccactatcatcggctccgccaccaacctgatcatggtgacgacgacgacgctgatgctgttcgcggggcggttcgggctggcgccgtcggcgaaccggaaggcgacggcggggctgaagctggaggcgcgcgactccgggctgcagacgggcgaccccgccgggttcaccctcgccgacacgctggcatgcggcgccgtcggccacatcctcggcgtcggcatcgtgctcgggctcaagaacaccggcgccctcgaccagatcatcggctagacgatccctacggttgttcttaagctctgatgaagctcacaatcctcgatcgcgccgccgccgccggtgcatatgcctatgtaacgtgcgtgcgtgtgtgtttgtgcgcgcatgccatgcgtacgtctcgttccaatggacatagctcttgttgctccaaaaaaaaaaaaaaaaa

SEQ ID NO: 78480 - DNA, 371 bp, Triticum aestivum
  Clone ID: PAT_TA_78480
gagggggatgacggtgccgagaggtgcgcaccaaacagacggtgccgcgggtgacatgagctccttggaggccgaaatgaagtcagcctcgtcacccttcactggaagcaggatgcaataagagaacctttgtgttcgcatagtgagcgagtcctgagcagcctgccatgctttgcatgcatgggcgtatactaaatccgttacagcaggttgttatagtgtacactgcacaatgcatgggagtagtataagattgctgcattccatgcaatgttgcaataaagggtaaagacaggtctgaacctaatctgaagacatgcatggtgagcaacgggagcttctttgctactaaaaaaaaaaaaaaaaaaaaa

SEQ ID NO: 78481 - DNA, 414 bp, Triticum aestivum
  Clone ID: PAT_TA_78481
gcggctgctcttcatgggcctctccttcgccatcggcatcctcacgttcctcctctacctcgccatctggtacctctgcagccgccgccgccaactccgccgccgtcagcgcggcgagctcttcgcgcccggggtgggcgacacggacggcgaccacggcatgagcgcggacgcgatcgccgcgctgccgacgttcgtgcacggggcggaggcgccggcgctcgactgcccggtatgcctcggccaggtggaggccggggagaaggtgcggcggctgcccaagtgcgcgcactccttccacgccgactgcgtcgacgcctggctccgcgcccactccacctgccccatgtgccgcgccgccgtcggcaccgcagccgccgccaccgccaccaagcagcaggccgaggtggcggc

SEQ ID NO: 78482 - DNA, 614 bp, Triticum aestivum
  Clone ID: PAT_TA_78482
atccttactttgatccacttgttgacatggatccgaggctagttgtcaccatgcttgatctgccacgggatgctgatgtcaatgctctagtcctaaggtttggtggggaatgtgaattggtctggctgaacgacaagaatgccatagctgtattcaatgatccagctagagcagcaacagcgctgaggcggctggattatgggtctgcttaccagggcgctgcgatgtttatgccaagcagcgctcaggcatcttcttcaggcaatgtttggactggagagcataaggatggggggctcactgctaggagcaatccgtggaagaagcctgatctgccctctggagactggactggtgttgctggccatgctccagcacctggatggagaggtgccaacactgccactcaagtcatggggactgcgaaccgatggaatgttctggaatcagacactgctgcaagctctggttcaggcgatgagcggaagcctgctccgcggacagatgctgcctacagcgcaataccaaacgctgggaatgctgggccatctgtgactaagctgcagccggatgtagaggtggatgactgggaagaagcttgtgaatgaggaagc

SEQ ID NO: 78483 - DNA, 649 bp, Triticum aestivum
  Clone ID: PAT_TA_78483
atgaaccacatagctctggattgtggcctcttttgtctctgaatggatcagatggcagtctgcaggggtttgaggagctattggcctcagtacttggaaagaaagcaggcgagaagggtaccttcaagctactgaaggcacgggcctcggctcaaacctatgtcaagatggcattcacggtggagaagaagcttgttgaaggggaggtgaactggtcaaatattccggaatggaagacgaagcccaagaggctgagagcacactatgaagtccttgctcgagtggaggagggtcaggcgatccctgagaggatcgcgcaggtgcagcctttccaggccgacgaggccatgtccgagagtgtgctcaccggcaacgtcacaaggtcgaagatggaaatcgtccatccaccgcctgtttatttcactctctgatggaagagctggagcctggaggctgttttgatgttttctcttcagagctactacacgttgggtggtggttagtttacggtgcctcgtaggtaacaaagtcatacaagcggcaagagtttgttgcctatacactgactgcttcgacataaatattggcattttatgtgtactgacagactgccaagccttgtatattatcgaccttgaataatgagcaa

SEQ ID NO: 78484 - DNA, 601 bp, Triticum aestivum
  Clone ID: PAT_TA_78484
cccctctcctctcttcccccgcaaccggggataaaaataggggagcttgaacgggacgaggcattcaggcatggatactctgctgggctccgggagattcttggcgcggcggcccccgctcgcgctcgcccctcgctgctcgcgaggatccccggagaaaggcggcggcagcgacaaaggtgacacatcatccactgactgggacaaagcttggtctacatttaagaagaaagggaagaagaccctattttcggagttctcaccaaacaagtatgtgagctggaacccacgacgcagcgagtatccattatcagaagaggttgatccaatcagaagaactgagaggtctaacctaatgttgtggacaagtccgaaatttaccttggtaatggcgattgtcatcgtctcgacattgctaatctatacaatagttgttccacccaagtaactgaagaagtgacaggcatgagttgaactgtaagagaaacattctacttgcatgtttgtactgtacatttgtttgtactagtattagacaactatagcgtttctattggcctgttgctttaattgcatgcagatgtaccaaaaaaaaaaaaaa

SEQ ID NO: 78485 - DNA, 564 bp, Triticum aestivum
  Clone ID: PAT_TA_78485
gagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcacaggaagaacgtctctaatttccttgtccaggccggcattgtgaagaaggaacacatcaagattcatggtttctgagcgaccgccgggtccatagcaagccctgcatgcaaagcagctatatatctgaggtggagcatatctatctggctgtgtacaagcaggcctactactacgcctgcgcgttctcctatactacacataacacatagcc

SEQ ID NO: 78486 - DNA, 659 bp, Triticum aestivum
  Clone ID: PAT_TA_78486
ttgcttttcttaagtttgcctcttactactatgctagagaagcattttgtcgcttaatgaaatctgatgctgtttttggtactgatagaagagctaaagtatctttttctgaaacccccacaaaatcatccaagagtcttttggaggcaaaaaaagtatacctggaacatgtccctgtttcttgggatgagaataagattaaagaatactgtgaagaatatggggagattctgaaagttgatcttttccagatattaaagaatttggaaaaggaaacaatttcttttgttgaattctcatccagcacgggtgcattagcttgtgtggcaggaataaacaaatcaaagatagttgatggaagcttcaagttgtgtgcatatcttgcttggccaaaaagtgctttgaaggtcaatagtgctacaccttcaaatgctgccaccacaactgagaaggacaaaaaccacacagagaaggttgttgtagataagaatttaccccataaattccagaaaggcgacaagagcaaacttacctctcggacaaaggaggcaattatgaagacaaattcatcaagtaaattaccaaatgacaatgatacaaaactaacctcacaaggtgctgcagaagtaccacaaacctcaaaatcttctgaaggcaag

SEQ ID NO: 78487 - DNA, 729 bp, Triticum aestivum
  Clone ID: PAT_TA_78487
ttcacgtcaagcgcaggagcaaatccatatcgcacaatctgtccatgtaagttcatgggcacggcgatgacgaagactgtgtgcagatactgtgtaccggcagatacttactcctgcattgagcatggttgccattttgttccgcatggcgatgaggaagactgtgtgcagatactgtgtaccggcagatactcactcctgcattgagcatggtcttggttcctgagctacccataaaaggagagcggttcaactaatttcagagatagcatttgataccttccggtacatcaccaccaggagcaactcagggcgagcacgagctgccatacttacaaactactaacatcatcaacactgttgcatccatttgtgtttctattatccagagtttttttggcttacaatcacgattacacatcagtgactcacataaattaagtcatcactaaaactcattgttgtctctttctattgttagacacctccacctggatcggttcttcaaaaaaacctccacctggatccaaccctgaggaaacacctacgaaacagatggtggccatcagtcctgctacaacaactggatcctcaactttggcccataacaatgttcctaaacatttgttcggggacacttcacttgggaatcaggatgacaagagctgtggagaggaaggccataacagcaccgagagcaatggcagaaaacaaaaaacaaatgtgtga

SEQ ID NO: 78488 - DNA, 579 bp, Triticum aestivum
  Clone ID: PAT_TA_78488
gagttagccgccgagcacgacgactcctccctctcctctccccttccggcttcccgcgtcgggaaccgaagtccaaaccgagagaacatcgacatggcggcggcggtggcggcgcagctccgcgggccctcggcggcggcggcgaggaggtggccggccccctccggcggcgtcctccgcttcgcgccgctcgctacgtcgacggtcccggcgtcgatcgcccggggatcgctccgcggggttcccgctggcgtcgtgctgcccaagccattgatagcaatgtgcatgaaggcggagtataccagcagtcctgttgatcctaatgctgtcgtggagcatacagaagatgaaaatcaacagccaaccactgtatcgcctactaatgcagaaatagacatagaccaagaggctgttcctcaacacaagggtgcaataatacatgacttttgcctagggatcccttttggtggaattttattttccatgggccttgttggatttctgttttggaggagtaccgtaagtcttactttcggtgttgcacctggccttgcaatattggcccttggtgtgcttagc

SEQ ID NO: 78489 - DNA, 592 bp, Triticum aestivum
  Clone ID: PAT_TA_78489
tgcaagcaaaatatctcctagtgttatttttgtggatgaggttgatggcatgctgggtagacgtgagaatccaggggaacatgaggccatgcgtaagatgaaaaacgagtttatggtgaactgggatggtcttaggacaaaagtcaaagaacgtgttttggtacttgctgccactaataggccatttgatcttgacgaggctgttgtcaggaggctccccaggaggttgatggttaacttgccagatgcacccaacagaaaaaagattcttagtgtaatactagcaaaagaagatttggcagatgatgtagatctggaggcactagcaaacctgacagatgggtattcaggcagtgatctgaagaacctgtgtataactgcagcacattgccccataagggaaattcttgaaagagagaagaaggagagaaccttagctgaagcagaaaataggccagctccacctcagtgttgtagcggcgacgttcgctccctgaagtttagtgatttcaagcacgcacacgagcaggtttgtgcgagtatatcatcggattcaaaccatatgaatgagctcgtccaatggaacgacctc

SEQ ID NO: 78490 - DNA, 659 bp, Triticum aestivum
  Clone ID: PAT_TA_78490
gccgacgcatctcgggcgccccactgtcgagtcctcgtggcctccccgacgccgacgtcgacgtccattctccgctctcgccaccttccattctccccgaccacaagattatttctttggtgcactcatgatttagcaccatttacattgacctccaactctggtgacataggctgttgctagggtagcaaatcaagagctaagaatggcggattcaatggtagcgagcttctgggggcctgttacatcaacgactgagttgtgtgaagagaattatgcacactcatcatatatcgccgaattctacaataccatctctaatgtcccgtgcgttcttttggcgcttattggattagtgaatgctttccgccaaggttttgagaaacggttcagtgtccttcacatatccaatatgatacttgctattgggagtatgattttccatgccaccttgcaacttcttctacaacagagtgatgagactccgatggtttgggagatccttctttatatgtatgtcctttattcaccggactggcattacaggagcacgatgccaactttccttttcctatatggcgctgcctttgcagtagttcatttctttgcccggttccaagttgtattcaagttgcattacattggcctctgcttcctct

SEQ ID NO: 78491 - DNA, 564 bp, Triticum aestivum
  Clone ID: PAT_TA_78491
agcaaatgtggtgaagaagatgactcaggaacagatcttagcctttgaaaaatgtggagagatttcattcttcggtcattgcttgaaggtagatgatattaaggtggtccgacagttcaagcgtcctgaaaatgtgtcagagaaggagattgacgctgcaggagatggtgatgttttagtcattttagatctacgaactgaccagtcattgtttgaagctggagtggctcgagaggttgtgaacaggatccaaaaattacggaagactgctcagctcaaacctactgatccagttgatgtgtattacgaatctgtgggcaatgacaaaaacacactggaagagattttgaagtcacaaggtcagtatgttagagacacacttggttcgccaatcattcccaaggaaatggcaccaagggatgtggtagtacttggcgaggagtcacacaatgtacatgacatgtcatttgtcatatgcattgcaaggtccacccctattctttcaccagatcttctcccaaatgcctcagcaatcatgtggaggcattgagcgtatatcttctg

SEQ ID NO: 78492 - DNA, 656 bp, Triticum aestivum
  Clone ID: PAT_TA_78492
aaagtacacttaaagcaacaaaaagaatgggacggtgtgcttcttgtcgcacctatgtgcaagatttcagaagatgtaacaccacctgcacctgtattgaaggcactgagcatattgtcatgtcttcttcctgaggcgaagttatttccgcagaaagatataggggatttggcatttagagatccaaggaaaaggaaagtagctgagtacaatgccatctcatattctgaccaaatgagattaagaacagcagtcgaacttttaaaagccacgaaggacattgaatcacagttggagaagatctcctccccattgctgattcttcatggagccgcagacatggtaaccgatcctcaagtcagcaaattcctttatgagaaagccagcgcgaaggacaagaccctcaagctctatgaaggcagctaccactcaatcttagagggagagccagatgaacggatttcaactgccattagcgacatcatttcatggctagattcacactgttaaataacttgtgtctatagcctctcatgtcctcatccattcttttggatttatagtttcttagggtactacgggactatagtttaattttgccatggtgtgcacagaataagtatctctcgaatttaattaattttgtgtttgctaaa

SEQ ID NO: 78493 - DNA, 442 bp, Triticum aestivum
  Clone ID: PAT_TA_78493
ttctgttgggctatgtgactaactcctggcgacgcggaggccatgggcagttgcggcttgcgcctttgacggcactgcattaccattgtcattgccataggggagacatgtgcagtactgtacgtagtagtagatgatactcactatcccatttgtacagagagaacgagggaagagcgagacagataatcaggccattagcatagtaatagtagtaataataatgtaatacaggagggaggagagggtcattcattcattgattcatttgctattgctagttccttttccggtcgttcgatgatgtagccagccacagagttgtgataggctcatgctcattctttattttgttcttggacatatcatgcatatttatcatcatcagacaaataatgcatgcatgaacttggatggaaaaaaaaaaaaaaaaaaaaaaaaa

SEQ ID NO: 78494 - DNA, 544 bp, Triticum aestivum
  Clone ID: PAT_TA_78494
ggcagccatcttgaataccagccggtcggatcccaaaataaagctacagacttccaacagagcccgagcatggaagaacgaaccgaggggcctcccgcttctggacaagcgttcagggagcgtggccacaacagggggctacgcccagcaggccgcttcgtccggcgaaaccctgcctctacgcctaccagtaattctcaccaaaatgaataatcttccacggctgccacatccgctgagctgcaggaactcgcccttgtggttatgtttcacaacaggtttggatgcacttgggtgggcggcaggtgtctatgcctctatgctggtgagcattaggatcattgtaccggtaaagtggtaatagtcttttgtcccaagggcacctggccccacacgcgccacgtgtgattgtggatttttcctgaagaacatcccctttgttgggatgcgatgttggaacgtgtactaacagagttgtgtttgagaactgggtttgaatgttgttagcttgctgctaatgggaacagaaagtgttcgtttttgg

SEQ ID NO: 78495 - DNA, 687 bp, Triticum aestivum
  Clone ID: PAT_TA_78495
ccccacccctctcaaggacatcttccatgggaagaaagtggtcatcttcggcctgcctggtgcatacacaggagtctgttcacaggcacacgtccctagttataaaaataacattgacaagttgaaagcaaaaggggttgactctgttatctgtgtctctgtgaatgacccttatgccctgaatggatgggcagaaaagctacaggcaaaagatgctattgaattttatggtgattttgatgggagtttccacaaaagcttggatttggaagtagacctctctgctgctttgcttggccgccgttcccacagcctttgttgacgatgggaagatcaaggctttcaatgttgaggtagctccttctgacttcaaggtttctggtgccgaggtgatcttggaccaaatctgatccgagtaacgaaattctgtcgttgtttgttttctcatgcagcatgcatgcttttgctgtagtaaataaacgaaaactcgactactcgagtatccatgtaaagatgtttgtagtctgccttgctacgcccagaatatttgttttcctgttacaaatcagcttgccgggcaacatgtttgtcagcattgacgtgagctctaacttcaactggattaccaaattggttggttgagctctgtccttgactatcattttagctggtcagaaatatgaggat

SEQ ID NO: 78496 - DNA, 432 bp, Triticum aestivum
  Clone ID: PAT_TA_78496
aagaaggccatgaacatccagtgcaagatctgtatgcagacttttatctgcaccacctctgaggccaagtgcaaagagcatgccgaggcgaggcatcccaagaatgacctctaccagtgcttcccccacctcaagaattagtaagcagcagcatatgcttcctcagacaaggggcatatgctcagctcaacaaagagagaaaagtgtcgtcatccaccaagtactgtcgtcttcatcagtgactggttgccatatactatgtgtcaatgggtctcagctgctgttgctgttgctgcagctgctttcggttgtgttgccccatctaaatatgtaatgtaatccttcgctgtcagcctgttgtgctaaaaacattaattctgtgtgggctaagaacattaattctgtgtggaaaaaaaaaaaaaaaaaaaaaaa

SEQ ID NO: 78497 - DNA, 326 bp, Triticum aestivum
  Clone ID: PAT_TA_78497
caaccccttgaattctaacagcctttggataaaaacatcatcagaatgcagaggctgtgctgttgaaggtttccccatgtctgcaactttgatctggcctttgaataaaatgtttcctctaacaagtgaagggcactgtttttattgtcttgtgggctagatgcctgctgaacaatttatgttcatttcttctttacttaaagaagcatgcaccaaaaacatgaaggatgcatgccatggaaagtttttgagctccaagtcattggaacgtatgaactcctcacacaatgcatcatttttctcgtattaaaaaaaaaaaaaaaaaa

SEQ ID NO: 78498 - DNA, 644 bp, Triticum aestivum
  Clone ID: PAT_TA_78498
ctctgactcctccgggctccggcggccggcgagagagatcccaccctcaccgacggcgagcgaccaccatgtcctcctccaccttcagcggcgatgagaccgcccctttcttcggcttcctcggcgccgcctccgccctcgtattctcctgcatgggcgccgcctacggcaccgccaagagcggcgtgggcgtggcgtccatgggggtgatgcgcccggaactggtgatgaagtccatcgtccccgtcgtcatggccggagtgctcggtatctacggcctcatcatcgccgtcatcatctccaccggcatcaaccccaaggccaagccctacttcctcttcgacggttacgcccacctctcctccggtctcgcctgcggcctcgccggtctcgccgccggcatggccatcggcatcgtcggcgacgccggagtcagggccaatgcgcagcagccaaagttgttcgtgggcatgatcctcatccttatctttgcagaagctcttgctctgtatggcctgattgttggtatcatcctctcgtctcgtgcgggccaatctcgagcggattagagggttttggaagaacaagacacggttcaccattgtattctattccaagtgttaatttcttcttatagactgctt

SEQ ID NO: 78499 - DNA, 330 bp, Triticum aestivum
  Clone ID: PAT_TA_78499
ctgaacttgtatgcaagcttccagcacatctgttgcctggaacgcctttgcattgtatctagtagggtgatcacttactcatccttggtctatattgccgtgagcttgtggcgagtgacatgactgctaataagtgacataataaccatttactgtcttgctgatacgctgtgttgatgctgtggatgaagcgctctgaagattattcatgtgcattgattcggtcgtgccctgcgtttacggtgctcatgcaggcactgaatgtttcgactgtattatctgaccaatcattgaagttattattttctgaccaaaaaaaaaaaaaaaaaa

SEQ ID NO: 78500 - DNA, 507 bp, Triticum aestivum
  Clone ID: PAT_TA_78500
ttccgaaacgaggagctgaagtttcgctgaacgacattgataacctcacctgggagaggctggatggcctgctggacatgttcctgaaagacttcgaggccggcgcggtggaatccaacggctggccgatgtatttctcggcgtacaaggtggccaaggcggccatgaacgcgtactcgaggatcctggcgaggcggcaccccgagctgcgcgtcaactgtgcgcatcctggctacgtgaagaccgacatgaccatacactcggggctgttgacgccttatgaaggcggcagcagggtggccatggtggcgctgctgccggaaggcgggccgaccggcgcgttctttgaagactttgcagagtcctcgttcgtgtgatgttgaacatgcagctgcacctcatctattctctatagatattcatctgaaagatgctacaattttttttcccatttgcgtctaaactcagcgctcaacctttgaactcttaaacttcaataataaagct

SEQ ID NO: 78501 - DNA, 534 bp, Triticum aestivum
  Clone ID: PAT_TA_78501
ttcagatcattttcagtggtacatttgttgcgatttcaagaaaccgagcaggaaaaacaaaagggatcaaataagtaaaaccttacttcaaatctacaccggcgaagatgccattgccgctcagagtttaataaaaacagtaaaaaaaattagtctcgatcctcaagggtgctgattggttagatggtgtagaagctagtacatacatgattgcatacggtacccaccatgatcattcgctacatgatacccagcaatcaaaatgcgtcagccaagcgaaactggtacgggcaaacgccagcatatagtggtgtgactggaactccggaagtcccatctgcagctagtgtataaagaagctgaaggcatttgcatcttctcaggtgtgcacctcatctcgcttttggactacatcatttgcaagtggatatcagcagcctgttgagccagctcattcatcatggcctcgtcgaagaatttattgatgctcacatcttcactcatgcccttccttcgcctggtctttaccatgaa

SEQ ID NO: 78502 - DNA, 596 bp, Triticum aestivum
  Clone ID: PAT_TA_78502
ggtacgacgagcgtgagttctggtattccagcgaccagctccgcctccacaacttctccagcctctccatcgccgactccatctggtcctccccctcgcctgccgccgtcgatcatagcagcaacaagctcgccctcgccaacaacagcaacaacaacgccaccgccaagacctacttcaacaagtccgtcggcaggccggccaacaacaacttcaacttcaactacaacagcaacagcgtcgtcgtagatgcgttcaacgggaagaagaaggccgctgtcgacgctcctgctggaggaggaggaggaggcaggaacagcaacaagaagaacagcagcagcaacgacaacaagatgagcagcaggttgaagaagagccagctgccggcgtcggagtcggtgccaaaggaggaggcgatcgggggatacatattcgtgtgcaacaacgagacgatggaggagaatctcaagaggcagctgttcggcctgccatccaggtacagggactcggtgaggggcatcaggcccggcctcccgctcttcctctacaactactccacccaccagcttcacggcatcttcgaggccaccagcttc

SEQ ID NO: 78503 - DNA, 472 bp, Triticum aestivum
  Clone ID: PAT_TA_78503
ctcactaacaagattatagcacccaaaattccatgggacagacacaagccagaatgtgactcattgtcagattcgagccgaaggtcagaagatcaggatgaatgtggcttagttgacgcgctgacagcagcaataacacgtgttagaatatcagagccgaagagaagtcggctctgtagccctgcaattaccattcagcaggaatgctcttcaaacttgaagaataatctttgcacggctttctgacctgacccaatgtatagcacctgtgatcagaatggtgtccatttttctggctgagatggttgttctgatttaggtgttgtagagccgaggataataactcaggttttccggcaaagcaacaagccgttggtgtgtagtgtttctttcagtgtcgatgaaccccacagttgtagcttctgtaaattctgtaaatagaatgatcatttcccaaaaaaaaaaaaaaaaa

SEQ ID NO: 78504 - DNA, 150 bp, Triticum aestivum
  Clone ID: PAT_TA_78504
gaagacgaataacctcgaggaaaagtgatacattagaagaaaataccttcaaaacattgtacttgaatttcttgtgatcaattgctactatattcatggacaatttgtggatgaaggatgaccacacagatttaacttttgaactgatgc

SEQ ID NO: 78505 - DNA, 355 bp, Triticum aestivum
  Clone ID: PAT_TA_78505
cagatgtgacacggaggacacctgattatttcctttgagttatctgccatactatttcagattttgtcaatattgcaatagtgatgctggtcagtaacatttttgttggatctatatggtaacttaaccgaccagcaacagtaagaaaatgtggaagctgcttatctgcatttgtcattgcaagaggttctatcagatcaacctacatcccaagctgtcaaaagatccgcttgtctacccagtggtgaattggcacctcccttgggctttggccccatagaccttcactgtttctaagggcgttgggacgtcggagcttacattttcaacgtaagttgcctcaagtctgtcttct

SEQ ID NO: 78506 - DNA, 671 bp, Triticum aestivum
  Clone ID: PAT_TA_78506
ccaagtggaaacgcgtgtggtgatattcaactacaagtgctttcaactgagaagaatgtgcgttccaaattccttaatggtattacttctgcgaaggttgctggacagataatggataatgccttgaggtttgctgattcaagttcacttcgttcaagtgatcctggaaaagatcttttggttgttgcccagaccacagctgacagaaaatgcaaatcttcagcactggaaaataatgctgtcatggaaaataaccttagtgaaaattcaaaggggactgcaacaggccatgctgaatcttgtccgtctcactttgtggagataaatttagaaaagcaacatcatctcaatggttatacaaaccacaagttgaatgagaaagatatctttaatcactcaaattcctctgccttttcgaggtatggtaataagaggatagaatcatcagctcaacggccatttcccccttccttccgcgtggttcaccaacaacctgtttacgacaagaatccccaatccagccgggtcttgctttcctgtgaacataatacacgcgagagtacagtgcaagctcaggtccctttggacagaagcacagagggtgctgcaatcctgtgttccagtagtgtaagagaagatgctggtacaagcagttcctctcctagaaagga

SEQ ID NO: 78507 - DNA, 372 bp, Triticum aestivum
  Clone ID: PAT_TA_78507
atgctgattcaaggggaacctgtcaatttgtgattggtgcagccaactcagtttacagctacgttcgtgaagttgatggatccatcatcttgtcaagatatccagaagaaccacaagctctagaatctatgtgactttgtctgccacgaaatacacccctgtacagtatttttattttcattttgtgtacagctcatgaaatactgagcgctcccggagctctccagaggataaggagaggctcaccttttaaatgtgccccctttgctcaagtgagaattgtacatgtaagctccataagattgtccgcacaattcaattcgtatatataaataataccatatattagtaagtaaaaaaaaaaaaaaaaaa

SEQ ID NO: 78508 - DNA, 664 bp, Triticum aestivum
  Clone ID: PAT_TA_78508
cggcacgaggcaatatcctcaggctaaccttttttttgcctttatcaaataaataggggcttcatgctctgtttctgaatcctcataaattcaagattcatgattttggagtgaaggtagcaaatgtttttgcaggattggcactacgtattaaagtcaggatattgacgaaggcactatctgttaccttgcagcagaccgggttggcacactttgcctctgctcttcactaatcggagtggattctatgagcattctctatttatttcacctgtgctaggacaccatatctacagtttgttgtgaatctcgtattgatacattgcctattgtgaatctcgtattgatacagtgcctactttccggttcattcatcttgtccttttttatattgattggtggaatgttgccacactttgcctctacatataagttatagtctcataggagatatgaccacctattgaatcagttctattttagctcaaagtaatattgtgtcgtgttaatttcagtactgtagtatcaggcctagcaatgattcatgagttctcagcaaaagataacagtagatagaaaatgcattcatacctataaatgctagaagcattacaattgctaaaagtaaccatatacaattgccaagccaggatcaaaccttatc

SEQ ID NO: 78509 - DNA, 610 bp, Triticum aestivum
  Clone ID: PAT_TA_78509
agggcttattctttgcagcacctgacacattggtgggacattcatcacagatgaatccctgtatgcggttgcaaacagctgcacaaatctgaagagcatcatcctgtggagctgccgccacgtgacggaggccgggctggtggcgctggtgaacaagtgccggcggctggagtgcatcaacgtcggcgggatgcgggtgccgccggagagcttcgtgggcctcctctccatcagccccgccctccagatcaggtccatccaccgcatcctcaacgccggcgtcggcgtgcaggtctcttgatcggatgatccatacatgcattatccatggatgataaggatcatatgtgtcagtcagttacagtatcaagccataaacccacatttgttgccactgtgtttttcatggaaaaagaattgtcagaagggattcatcaaattatggatcaacatatacgtgtgtgtgtgtgttcctgttgtcttattgttgttgtaaagaaaaaaaggatacattgtcttgattctatcttttgtacatgtatacatgtaaataaattgtaccgatacttttcatctaaaaaaattgtaccgtcactgcaaaaaaaaaaaa

SEQ ID NO: 78510 - DNA, 533 bp, Triticum aestivum
  Clone ID: PAT_TA_78510
cagtcgtcgaacctccgcaagttcaccttcggcgagctcaagggctccacgaggaacttccggccggacagcctgcttggggagggcgggttcggctcggtgttcaaggggtggatcgatgagcgaacgctgacgcccgtcaagccgggcaccggcatgatcgtcgccgtgaagaagctcaagcttgacagcttccaggggcacagggaatggctggctgaggtgaattaccttgggcagctctcccacccaaatcttgtcaagctcatcggctactgcttcgaggacgaacagcggcttctggtgtacgagttcatgccgagaggcagcttggagcaccaccttttcaggaggggatcacacttccagcctctcccatggaatttgcggatgaaggtcgcgctcgaggctgccagggggcttgctttcctgcacagtgatcaggccaaagttatttaccgagatttcaagacatccaacattcttcttgattcggactacaatgcacaactctctgattttggattggcaaa

SEQ ID NO: 78511 - DNA, 567 bp, Triticum aestivum
  Clone ID: PAT_TA_78511
taaatctgtcttgattgctaagattgattgtgatgagcacaagagtttgtgcagtaagtatggagtttccgggtatccgacaatccaatggttcccaaaaggatccttggagcccaaaaagtatgaaggacaacgcactgcagaagcccttgctgaatttgttaatactgaaggaggcacaaatgtaaagctggcaaccattccttcaagtgttgtggttctgaccccggagacctttgactcaattgtccttgatgaagccaaagatgtccttgttgagttctatgctccatggtgtggtcactgcaagagtcttgcaccgacatatgagaaggtggcttctgttttcaagttagatgaaggagttgttattgctaaccttgatgctgacaaatacagggatttggctgagaagtatggagttactggatttcctacattgaagtttttcccaaagggaaacaaagctggtgaagattatgatggcggtagggacttgggtgactttgtcaagttcattaatgagaagagtggtaccagccgtgacacaaagggtcaactaacctc

SEQ ID NO: 78512 - DNA, 565 bp, Triticum aestivum
  Clone ID: PAT_TA_78512
ccgccgccgccgcagcggagcagcaacagcaggcgagcgacatgggagggtttgtcaagacccagaagacccatgcctacttcaagcgtttccaagtcaagttcaagagacggaggcagggcaagactgactacagggccaggattaggctcaccaaccaagataagaacaagtacaacacaccgaagtaccgctttgttgtgagatttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgccgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggatggtggtcttgacattcctca

SEQ ID NO: 78513 - DNA, 178 bp, Triticum aestivum
  Clone ID: PAT_TA_78513
ccctggcgttgtcagccacaatgagattctagagatgtacaagaaatacatcaatcctgatttcaagtggaccaacttcacactcgaagagcaggccaaggtcatagtcgcacctagaagcaacaacgagatggacgcgtccaaactaaaggctgagttccctcagctgctgtccatc

SEQ ID NO: 78514 - DNA, 597 bp, Triticum aestivum
  Clone ID: PAT_TA_78514
tatacaggtgtagcctgcaacccgacgaccttccttaagggcattcaagcctatgctacacaaacaacctttgccgctggatgcaaggatgtttcctgtaactcaacagaattgtttggcgaagctattgctgcagctaaaagagccgatattgttgttgtagttgctggcttgaacctgacagaagagcgtgaagacttcgatagagtgagccttctccttccaggcaagcagatgagcctcatacatgccgttgctagtgtagcgaagaagccccttgtgttggttctcttaggtggtggtcctgttgatgtttcatttgctaagcaagatccacgaattgcaagcattctttggctcggatatcctggtgaggttggtggacaggtccttccggaaattctttttggagagtacaacccaggaggaaagctggctatgacttggtatcccgaatcctttactgctattccgatgactgatatgaacatgagagctgacccttcacgaggctaccctgggagaacatatcgattttacactggcgatgtagtgtatggttttggatacggtttaagttactcccaatattcgtat

SEQ ID NO: 78515 - DNA, 678 bp, Triticum aestivum
  Clone ID: PAT_TA_78515
gcttatggaggtttttggctctctatacaagatcaggaagctttgggaaattcaggatgtgttagcactacgccgtcatcaatcccttcaaggccttttgatggtgctatgacaacgacacctgaagcagcttcttccggtggatttgcttttgcagttgcagctttagctgagcagcagcatatgcatggagagtcttctagcgcatcagcttgccaaacaccaaggtttgatatccttagcagatcagacagatcctctacagaggatctgagtgtagttgggagcagctcttcagattccagagttgaggaaccatcaagcagcagtacacaccgaacaatagagggttcagagtattctaattctaatggccggtggtccgaggttgctgaggctggaaccagtattgctgaagctgatgttatagtggaggctggtgttggcaattcgtcaacttcagttgggtccaacattggttctagcagtgttcccgatagctttgaggagcagatgatgcttgccatggctctttctttggtggatgcccgttctagagcaggttctccagggttagcttggcgatagcatttggtggtaggccctttcactccctttatttattcttttcgggttttctgcgttttgttcttagagttcctattaccacataaaaca

SEQ ID NO: 78516 - DNA, 645 bp, Triticum aestivum
  Clone ID: PAT_TA_78516
tttttcctcgtgaaagtgtccatctattccactcttcatactgccttcactggcgctcccaggaacctgagggactagaggcatggagaaaaacttatctaaataaaaacaacatttacattacgaagaccacaacaccttttgtggtcaaacaattccaaaagttgttctacaaggacttctccctcttcctacagctgcgtcatgaagaacttgtgcatggagggcaaatggtccttatatttcttgggaggaagaatgaggatgtatataatggtgatctcaatcaactttttgcattggttgcaagatcgttacagtctcttgttttgaagggcattgtggagaaggaaaagctagaatctttcaatctaccaatctatgggccgtcggttggagaagtgaaggaactagtcatgcaaagtcatttattcaacatggatctaattaaacaatttgagatgaactgggacccttttgatgatttagaaggtgatgatgttgaggataatacccgcagtagcatgaatattgctaagttcatcatgtccgtactaaaatatttaattgttcaccattttggagaaaccatactcgatgcatggtttgccgagttcaagtgcctcgttggtgagcaccttgaaa

SEQ ID NO: 78517 - DNA, 474 bp, Triticum aestivum
  Clone ID: PAT_TA_78517
gcggtggccacggtgacaagactcctccaggaagagtgaccggcgaggctgcaatccccagcaacccaaccccacggatgcatggctttgaggcaccatgggccggcgagttctctataaggtgcgtcccatctcaggtgcttataaccagtgcactaattgaaggcactaagttaagtgaagccgtgtgatgcatttgaagggatgacagtgatgatatcgaggacgaggatgatattgatgatgtgtgatgcatttgaaggaaaataattttggcccctaggttgaaataaaataattttggctagttgaccttgagctatgtatgtgctgactgctggaacttatgttagttggctataacttatgaagtattgtattttattaatgtaattgtgttggagactttgtaatatgcttggagtgcaagtggtggacactttgtgataaaaaaaaaaaaaaaaaaaaaaaaaa

SEQ ID NO: 78518 - DNA, 688 bp, Triticum aestivum
  Clone ID: PAT_TA_78518
tcagaaggctggttgaaaactggtgacctatgctacttcaatgaggatgggtttctctacattgttgatcggttgaaagagttgataaaatacaagggatatcaggtacctccagccgaactggagcatatcctgaattctcatcctgatatcatggatgcagcagttattccgtacccagacgaagatgtcgggcaactaccaatggcttttatagtgaggaaaccaggctcaaaccttaccaagcaacaagtcatggatttcgtggctaaacaggtcgcaccgtacaagaaagtccgtcgagtggcctttgtttctgcaattcccaaatcgcctgctgggaagatcttgcggcgggagcttgtagagcaggccgtgtccatggttacctccaagctttgaagtttattactggcttggaaatctaggggatttcttttgtataatactcgacccgggatactatgcacgtactatgctgcggtggttttcagattgctcagatattcagatcgatggttgtacctccgcatgcttctttcatgtaaccacgggataatttctgcgcagaacaagcaagacaggaagaaagtggcatccattgtacaattagttgcggtcttgcggaatactcactgtgtgtctaaaaaagaatgcaactataagttgtgtgccggttgactaaaaa

SEQ ID NO: 78519 - DNA, 711 bp, Triticum aestivum
  Clone ID: PAT_TA_78519
ccgggaggcccggaataagccgctgccgctcggctgccacgacatcatcccgcgcgtgctgccgatgttcagcaaagccgttgaggagcacgggaaaccatcattcacttggtttggcccaacgccaagagtgatgatttcagaccctgaatcaataagggaagttatgtctaataagtttggccactatggcaaaccaaagcctacccgtctcggaaagttgctagcctccggagttgtaagctatgaaggcgagaaatgggcaaagcaccggagaattctgaatcctgcctttcaccacgagaaaataaagcggatgctgccagttttttctaactgctgcacggaaatggttacaagatgggagaattcaatgtctatttaaggaatgtcagaggtagatgtttggcctgagttccaaaatcttacaggagatgtcatatcaaagacagcattcggtagcagctatgaggaaggaaggagaatttttcagctgcaagcagagtcagccgaacgcataatacaagcctttcggacaatttttataccaggatattggttcttaccaactaaaaacaacagaaggttgagagaaattgaaagagaggtcagcaaacttctacgaggaataattggaaagagagagcgggctattaaaaatggtgaaaccagtaatggtgacttgttgggcttattggtggagtcaaatat

SEQ ID NO: 78520 - DNA, 350 bp, Triticum aestivum
  Clone ID: PAT_TA_78520
agatgagatgaaggagtttgctgcctatggcaagctccgccttgagcggatgaacaagaaacacctcggtgcccgccagaagaaggcagctgaggcggagaaggaagataagaagtgaagtggccgaacatagtacctgttttgttctattcagccattagtggatgctactaccatcaagtgcttgttctaagttttttttgggtactggaaatagagaccagacaaacattttggtgtcctactgtttgataccttgtacttgtttgcgaactcagctatctaatgggttattgaattcttgcccgtttgcatggttatgccttgcttaaaaaaaaaaaaaaaaaaaa

SEQ ID NO: 78521 - DNA, 500 bp, Triticum aestivum
  Clone ID: PAT_TA_78521
gatcgcatccgcctctccacacgcatctccctctccaccttgccagcatccgcgcgcgcgcgcatctctccacgccatggacgggtcggcgttcctgtcgctgtcgccggagctccgcgacgcgctcgccaaggtggccgtgttcgtgctcgtccaggggctggtctacctcatcctccgcagctcctccgacgtcttctccaaggacggcggcgggctcaggtccctcagcttccgccccatgcgctccatgagcgtcaggcgcgtgctggctccgctctctgacgtccccgtcggcaccgacgagccctcgccttcgccgtcgtggtccatgtcgcccgccgcgtcgtcgtcgcgccgcagggctgcccgcgaggattgaaatggccgcaacttctgggtctgggcaccttggaatcggaggtagtttatttggtcgttctggattgtaattggtttgttattgtggatggaaatggtatttgagttcctatatgtaa

SEQ ID NO: 78522 - DNA, 610 bp, Triticum aestivum
  Clone ID: PAT_TA_78522
ggcagagggcgctcgctgctctggtcggcggacggcaccgtggttaccggtcggaccggaccgccgttcgccggatcatccctgttttctcttgcgtgcttctctcgtcatcttgtggcgacgactgggcgactgccgacggccgctgcttgctggagacgagcacccaacagatcgttaaggagaaccagaagcttcacaaagtcaatattgagattgaagatgagatttcagaacagaagggcgaaatactgcaggtcgaggaaggctttagagggactcttttgacatcaagtgtttcaccacagctttgttagggtatatcatttagtgaatgagtttctttcgtcagatatatggctgcataccggttgatgtaagctagttaaggtctctagaaggtgatactgattgccttgttctttttttggttacatatcataattttctcaatagaaattactaaattcatgttgattgctgcctgttttaagaaccttttgggcattgctcgcatgcatatacagcacattcaccaaagcatcttaagttacctactatttcaaaatttcagtaatcctacccttacgaaaaaaaaaaaaaaaaaaaa

SEQ ID NO: 78523 - DNA, 747 bp, Triticum aestivum
  Clone ID: PAT_TA_78523
taacattctggctctccatggatatcactgatagtaaaacaaggtttgagaccctggatttattcggtactgtatatagctcaaattggttgtggtgtgtgttcgtgtcctttagagatgcaggaggacattggaggtggactttcctcaattggagataacaaattgggaaaaaaattgtgacacttgacctttcacttctcacttttgtttatttggtctgcaattgtgttcatctgttttgattatatttccagccacttaaactttaaaaggatggtaggatgcctaggaattccttttgtgctgcaacaatctaaattacaaggaggcttctaattcttcatttctatcaacagtcctatccagttacttccttcaaccagtaactctttcaagtttctgcagatgtgacacacagaagctgagatagaatttccaaccatagttgctgtctccaaagcccatccctgttccactggccatttgttccgccttggatttgaaagtttttgaagcctatccctgaaccaaaatagacaggaatcgtagatgggctctttgggaacttccggactgacctgctgtttggatgctctgcgctagttagatgattcacatgatcacaaccaagacaatgctctgcccagattctttgagagcgttaatgcttggaatcttggatgttaggagtgatggggcacaccttacaatattcttccatctaaccagattggagctaaggtg

SEQ ID NO: 78524 - DNA, 420 bp, Triticum aestivum
  Clone ID: PAT_TA_78524
acgaggcgcggcggtaagttcacctgggagggcgccgacggctacgccgacgaggacctcgacctcatctcccccaagaactccacctcccactccaagtccgccgcttccgccgccgccgccgacagcagcagcaacaagaagtccggcgacgacgagtagtaggcaggcggccgccgcctcccccggtgtcgctcggtcggtgttcatcccctcgcaatcctagctgttcttggaataagtgtgtcgtgttcatcggtagtggttggatcgacgggccatggggatttgtagatatatcatcattatctatcttttaactcttgctaatgttggagtcttcggttcggttctttggcctaaaccgatttatcttttatctcagccgtattagcaaaaaaaaaaaaaaaaaaaaaaaaa

SEQ ID NO: 78525 - DNA, 461 bp, Triticum aestivum
  unsure (1)..(461): unsure at all n locations
  Clone ID: PAT_TA_78525
tgatcttgtagatacagaagctaacctaccaaaggctcccttgcagcatgggagtgagaagcaaaagccttctaagcctgctgacgaggccagtgctggtagcctgccctccatggcgacaactcaaactgtgcttggcctaccaacggtgtttggtcataaccaacaacctagctgattatttcggcatagtgttttcaggtgctgtaagaaattgtggcgtctccatgtgttcagcatcgattgtcgagactaacatgtttccgagtcgagaggatatttgactttgtaattttctagcattgcatggttcctttgcccagattatctgtgcagcgctgatagatatgatcggatgcagatttgcatccgtccaaatatcagttgtaattatgaatcgtttctattgctggtagtcgagacatgtattgttcnnaaaaaaaaaaaaaaaaaaaaaaaaa

SEQ ID NO: 78526 - DNA, 217 bp, Triticum aestivum
  Clone ID: PAT_TA_78526
aatctccaatggtgacaagatagtgagatattccttaccattgaccaaaccattcgatgagccctttaggaggttttttacactcaagaccaccgtcacccaagaaggcaaccaactcatattccgtagtaaactctcagatggaaacattatcactcgcggataccatttctcaaattctagaattcaggccgattactcccagaaaaaatatgga

SEQ ID NO: 78527 - DNA, 448 bp, Triticum aestivum
  Clone ID: PAT_TA_78527
gactggacaggtcaaaagtaaacgtgaatggaggcgcaatcgccctaggacatcctcttggtgcaacaggtgcccggtgcgtcgcaactcttctgaatgaaatgaagcgccggggcagggactgcagattcggtgttgtcaccatgtgcattggatctggcatgggggcagcagctgtgtttgagcggggtgactcggtcgaccaattctccaacgtgcgccaccattagcggcagttttctaagagaaatgcaaagcgaagcagtggtgcaaaatcatcatggtggtcagtccaatggagcatactctggcagtaagatctataccgaaaactaaatgcaggaaacacgtaatcttctccggtgaaaggtgtaacagtatattgaagatcttttcatgtaacattttgcactaataataatttatgcgaataaggggcatgcatgct

SEQ ID NO: 78528 - DNA, 658 bp, Triticum aestivum
  Clone ID: PAT_TA_78528
ttctgcagagaatgcagagttgtacgcacagggtttggctggcgatttgaagaaggccatgaaagatgggaagccaattattatagagggaatacatttggatccaagcatttatcttatggatgaggaaaagagagatggtaattccaggacggagaagacagtaatggattctgaaaatccaggcatctctgtagaaaggaagaccgaacaccaatccaaaaatggactagcagagaacagaatgaatcctacggaggacaacaaaaactttgtcaaaatcaaagaaagcatgctggagggaagtagaacccgtaaaggactatcttatgctgagagccatgaaaccaagattcatgattctgcatgttctcaagaaagaaatccaaaagatgaaagtgatgggcacaaagatttggaccaacagaagaataacaccaccaagaaagacaaacctgctgctgaaccaatagttgttccaattgtactgaggatgtctgattttgatcacaaagcattgttagaggaatggatagccactagagctttcagagataattgcattcctcaggatcaccggaaacttataaataaccttaagcttattcaggactacctttgttcttttgagtcacagggattgaccattgttgacatc

SEQ ID NO: 78529 - DNA, 434 bp, Triticum aestivum
  Clone ID: PAT_TA_78529
tggtggcgcgggtgctgcgcatgccggagatcaccgaccagcagctgcactggtgcgaggagaagatgaacagggtccggatcgatctggagggcaagctgcagagggaccctacccctcttttctaccctgcacattgacagcgacggacctgctgtctgctgctggtgctggtgttggacaacaacagtcttgtgcaataatcttctagtagctcttttctttttttttactttgttttttcgtatcttcttttgtccaagatatgtagtattgggagaagggaacgaaaaagataaagttgcattgcatagacatgagaatatgcatggcacttagcctcatctagtactactgtaaaaagagagatcacacatcgatgatgttattgtaaaggcacatactatacatacgtatatatactagagtaataa

SEQ ID NO: 78530 - DNA, 729 bp, Triticum aestivum
  Clone ID: PAT_TA_78530
caaggcggcgcgacgacccatctcgccgccgcgaattctctctccggcgaattccaactcgaaccctccctccgccgactccgctcacgagacctaaaccctccttccctctcctctcgtctcgttcccaccaccatgctgggcgtcgcgaggaggcgcctcggatccggatgcgcgctggggcaactcatgcaggcgctccgaccggccgccgccgccgccgcggcgaggacctactccgccgccgccaaggagatgactgtgcgtgaagcattgaattctgcccttgatgaggagatgtctgctgacccttctgttttcttgatgggagaagaggttggagaataccaaggggcatataagatatcgaagggtttgttagacaaatatggccctgatagggttcttgacacaccaatcacagaggctggttttactggaattggtgttggtgctgcctatcaaggtcttcgccctgtggttgagttcatgacatttaacttctctatgcaggcaattgatcacatcataaattcagctgccaagtcgaactacatgtcagctggtcagataaacgttcctattgtttttagaggaccaaacggtgctgctgctggtgttggtgctcagcactctcagtgttatgcagcttggtatgcgcatgtaccaggattgaaggtcctaactccttattctgcagaagatgctcggggcttgctaaaagcagca

SEQ ID NO: 78531 - DNA, 680 bp, Triticum aestivum
  Clone ID: PAT_TA_78531
agcttggagtgtctggcgtgaaccttgcaaaacgttcacgacttctgttctgccatcgcttgtcacaagacccatctggaatccctgtcagtgtggttcaacaaggacatcaatcgagctggctgtttggatgcaatctcttcatctccgatgaaactacacagccttgagctttacggccatcaagacaacaagttgccatcatggatgaaactgcgaccggtgcatcagaacccgctcagcaaactggacctgcatatgaccaccataccgcaagatgagatagatcatgtgctcggggatctacccaagctaagaatactacgtatttctttcgaggaatttcaagatggtcatctgcagatccggggaggtttcaaagcactccagctccttgagatttctctaaaccacgggttacagaccgtgacttttcactcttgggcaatgaacaatcttgaggtcctcaagctctgctgtagcgacaacgtcgacgtgcatccatcactgcggttctctgggaaaaactgcctcaacagtctctaccaagtcatgcttagcggatactgtcaggacgcgatgaagcagcaacttcgtgagcttccatggccatgggaaatcccaccggttgtgacggcagattcacgttcgtcctgatgagtgctgagcctaattaagca

SEQ ID NO: 78532 - DNA, 578 bp, Triticum aestivum
  Clone ID: PAT_TA_78532
ttgttcattgccagatgacttaaaaaatgtcttgtcaaataaaaagttatctagcagatgatacacttccatgtataaaaatagatggagattaattttaatcatttagataatatcaatgccatctcactaattgtatctatattcatcctgacttggatatgtacattaatcatcagcttcaaaattgatattattattattccatagttatatattttttacaaacatgttacagtttaatacatttttaagtatccaaaaattgtctaaatattttcattgacatttatcagttatgaattcctaattttacatttttgttaaaattaagcgcagatattttagaataaacaatattcatactgccttaattttttataatactatcttgattcttccaggaaataagctggttaatatatgtttatataatataatattattatggtacatgttctaaatgttgcccattaatataaaatattattatatgaaagacttagtgttataaatagttaagttgctaatttcggagtaaaagatatgttttttcccggacatataaaaaaaaaaaa

SEQ ID NO: 78533 - DNA, 318 bp, Triticum aestivum
  Clone ID: PAT_TA_78533
gcacgagctagatagcatagcaagaagggccaaggagaaagcggtggttgattcgccatgagcagcgggcgcgagagcaggtgggagctcccggcgacgctgcgtgcgctggcgcgcgacgccggccagcagctgcgggtaccccgcgcggccgcggccgcggccacgccggcggcaacggcggggcggcgcgcggcggacggcggcggcaaggcggacaaggtgatgcacctgctgctttgggggcccaagtgatcgatcgatgggcctccgccgcgccggccggccgccgccggcggggcatcggctcatctccga

SEQ ID NO: 78534 - DNA, 621 bp, Triticum aestivum
  Clone ID: PAT_TA_78534
atgagaggcagcaatattatgtccgatgcaaattcaaattagccgtgtagtattttgccatagctatctgcttatatggaatgatacagaataacgcatgatacagttatgcgctgtgatgctgtactgccatgcacatctgtgatgatttgagccaatttggtatttgactttggcaagcttgtttatttccctttcaattactactaatgcctgggcaagtgtctgcaaaatcaataccccagttatcatccatcatgtaaacaccaagatccaggcccatgatgacttagttgtctgaggtactggcagtgtctaccagtgcataatttcgtcatattttcagttcccatattttctgtcacttcctttttaaaagctttggacactgacatttataagtaactggtttgttcaccaacaaagaagttcctattcatcacctagttctgagcagttatattgacggtgaatggatcttaagttcttaactgaataaaaaagaactggtgtgtcacctgcacatctgcattctgttttgtaactctgaacctatgttcttagtctgagagatcaaagaaggctggaaatcctccttcacccccgtcgtcgctgagttct

SEQ ID NO: 78535 - DNA, 696 bp, Triticum aestivum
  Clone ID: PAT_TA_78535
ttgtttatggttttgagagcttcttttttgtatctagatgggcaatgcatcaactgcttgttgaatgcccatcaatctatgaaatgttaccaaatccggaattcaagtggagggaaaaaccaattattcaggtttggcgtaaggatcctgaaaaggatgggattgtggagcttgtccagtatgaagcgactgattgtgtgtccttgtttgaagaagctttaaggaataatgagctcacgtataatggaaagaaagtagcgctaccattcaatatgtcagtcttcaaatgggccaccaagacccgccagatcctagacaatgctgaattaccagattctgtgagcttttacaatatatgcgggacatcttatgaaactccatatgatgtatgctatggctcagaaagctccccgattggagatctgtcggaagtgtgtcacacagtgccggcatacacttacgtggatggagatggcacagttcccacagaatcggcacgggctgatgggttctctgcgaaagaaagagttggcgtcgaggctgaccaccgtggcctgctgtctgatgagaatgtattcaagcttctcaagaaatggctcggtgtgagcgaaaagtcagagtggcgttgcgtgtcaaatccaaagtggtagacctttgcacctaactgcgttgccctgtagatgtcatcgcaatctc

SEQ ID NO: 78536 - DNA, 663 bp, Triticum aestivum
  Clone ID: PAT_TA_78536
tctaggtggaagaaagccatctgatgttctgttcagtaaggaccgtcctagatggtacgatggaaggcgagaagtccatatacatccatcatctgttaatcacagcttgaaagctgttcaatatccatttttggtgtttctcgaaaaggttgagacaaccaaggtgttcttacgtgatactagcgtcgtttccccatactcacttcttttgtttggtggttccatggtaatccaacatcagacaggagtggttgttatagatggatggttgaggctgtctgctgctgcacagactgctgttttattcaagcaacttcggataactcttgatgctgttctaaaagaactgacaagaaaaccagagatggcaacttttgttgacaatgaagtggtcaggtccatcattcatttattgttagaagaagacaaggctcgataagcatgaattcatggtcattgaattatattgtagacaaaggtggaaatgtagcagaatcaaccgaaggacttcgggagaacattaaggacccagatttaagttgcatactaccaggccttggatcaatatcggttctcgccgttgtgcacgttccacagtctgcacagcattcttattgcacaatgtggctgactgctaatgtggaaactgcaaagcggaaatgg

SEQ ID NO: 78537 - DNA, 603 bp, Triticum aestivum
  Clone ID: PAT_TA_78537
gcttcaatggggctgatcttcgcaacgtctgcactgaagcgggtatggctgcaattcgtgctgaacgggactacgttgtccatgaggacttcatgaaggctgtcaggaagctgaacgacgccaagaagctggaatccagcgcccactacagtgcagacttcggcaaagagtaaggtgcaagattctgatcctgtattcgatcttctaccatgccgggagttctccgccatggtgcaaaagcaacagagaaatcggtttttcaccgtcaggcttctattctgcactgcaagctgaagccatttgtcatgtgtgcaatcaaagagccatgaatggttgtcaagcttatctctgggactggagaaacataccgagaacttgcaaattttataactgatgcttttgcctctgtttcactccgttttttgagtctcaccttgtgtcagtactactgtgtagtcttagttttgagcagttgcatgtacttttgacaccatgcttggtaaagaatagcaaaatggtatcttgattcagcttccagacccccatctggtgtgggaatgcatctcaattcctgtgaaattcgtgcaaaaaaaaaaaaaaaaa

SEQ ID NO: 78538 - DNA, 713 bp, Triticum aestivum
  Clone ID: PAT_TA_78538
ctggttgggaaaggtgcaaaggcattcttcagagataaggaaggaaggcggataagtgaagaagaaatgcgcaaggcaaaggaacctgagaagccaaaggaaatacatatagaatggggtaaagggttggttcagaaacgagaagctgaggctagattaaaagagattgaagctgagaagaagaaaccttttgctcgaacaagggatgaccctgagcttgacaatatgctaaaagaaagaatccgatggggtgatcctatggctcatctagtcaagcggaaagatccagaatttattttggaagacttgggagatgatgaaaagatgaaagaatctggtttcatagtaccccaaaatgtacctcctcacagctggctgaaacgtggagtggatgctcctccaaaccgctatggcataaaacccggtcgacattgggacggcgtggatcgcagtaatgggtttgagaaggacatgttcaagctgaagaatgagaagcaagcaatggagcaagaggcctatctttggtctgtctcagatatgtgagcccaaatgttgtctcttacgagaggaatactgtggtctaaaggaagaacgaagaaccaatgaagacctttcacacgattttctttttcttacaccaaatgacatctttagtgatgctgtgctggtagcttgaatatatattttttcccctggaaagctcgatgaagctg

SEQ ID NO: 78539 - DNA, 421 bp, Triticum aestivum
  Clone ID: PAT_TA_78539
tcacaggatggacaaccagctgaaaccagaacccaacactcccttcctagtatagtggcagcaaccgtaacatgcatccttacgactactagcaggcgttaacatatcaaagggtaagatagaaatgccggcttctattcactaacaaggaggcaggaaaagacctaaaagatcctctccacttgaagttgtaccagtgggatatgatatcgcctatccctttccgatcttttgttcaaaggagctttagttgcgaggatatggtaagcaataacctgatcatgctcctacatctttcaatgccccctatgagtgtgagtgatggacagagctgctaaagagtctggcatgctctcataatgattctttccggggctgtagtgcactaaccatacactttgtggtgggggctgcttttttg

SEQ ID NO: 78540 - DNA, 386 bp, Triticum aestivum
  Clone ID: PAT_TA_78540
gatcagatgctgcttgaggaagaggcctaaaggaagtatgtactgtgggctgctcaaggactaagggtcctgaaggaaggaaagaagtgtgaaatgataaggttgaggaataattggcggcatggaccaactgaccaagcccttgggtgtaggtgggcttgtagagggttttgcagttgggtaggatttgtagttgtcgggtggtgttgccctcctacagggaacatggtgcactgaaatgcagtagaacatgtggtattattgctaccttcagtttgaagtctttcttgttagaaacaaaatcctttgggattttgcttattcaaaataaaacatggcgatgaacgtgtttgtctcattggcgaaaaaaaaaaaaaaaaaaaaaa

SEQ ID NO: 78541 - DNA, 335 bp, Triticum aestivum
  Clone ID: PAT_TA_78541
gggaactcaactgtggtagagaacacggagagaggctggagagaactcatattccagcggatacgcggagtgtttggttttgggatctaaagaatctaaagaggcaacttggcatgaagttggatttcaaatttttatggggtcaggcctgaatgccatagcaatccaatgttttactcacccagtttttccatgtccttaaaacacaaaactctgcatatcatgggggtttaaaaacaactgttattcatcgcgttgtaacgatccttgctcccaatttctggtgttaaatgagtcaacgttgatctttgctgaaaaaaaaaaaaaaaaaaaaa

SEQ ID NO: 78542 - DNA, 699 bp, Triticum aestivum
  Clone ID: PAT_TA_78542
gcaagctcgttccctcaagtgaggcagcaggctccaaggacagaacctggttgtgaccatagaagatgattctgaaactacccctggacaagcaggggatgcagttgatgagcatgtggatatactactatctctgactctgggcaggtatcctaggcatggtcatcagagatcctccaacatcagcaccagccctgtgatacatataattgacacacctagcaatgcactccctgaacccgagaaggccgttccgaaggaaccaactttcaattgccctgtctgcatgaacgagctggtcgaaccgtcatcgaccatctgcggtcacattttttgcaagcagtgtatcaaggcctcaatccaggctcagaagaagtgccctacctgccggaggaagctgaccatgaacaacttccaccgcgtgtatctcccttctgcggagtaagccggtttccaccattctggaaatcagcgtccctcctcccaccctgactctcgccacattggcgttctgatgattgtatctgaaaatgtttgacaggcttgctagcataccgttttgctggagcagttttaacaggtgttgtactgttgttggatccgttaaaagaatacgattgtatgtcctgtggaaatgatccatgctattaaaggtctagattttgtggggaaaacattttcctttttttatgacaccta

SEQ ID NO: 78543 - DNA, 769 bp, Triticum aestivum
  Clone ID: PAT_TA_78543
taatttgttgccaccaatccaatcgtgctttgcatagtcaccgtaaccatctgtactgagtgaaaaaaggccagcctctctaaacagacatgtgtttgtattttttttctactattgtataatcgaccacttatgaattagagaatgtatgcctaggtccacggtggtcccatgttcaaattccgatttacagattatttaggccaatatgtttcatagcacagtgtctgttgttggctcaaagtaggtggaggctcaaaaaagagcttttctactttgcaaagctcgcatgagttcacattttcccattgtcctagtaattgattcttttcatctttagccttactatgtcatatgaagaaataattattgcaatagttcatacttcagtgacataaacacatactcttgcacaagcttaaattatatccacatgaaaatagtaaaacatgagtccaatccaaccaaaagatttcttaaaaaacaaatatgtgtataggttttagaaatttcaatggtaactgcccatggttgatcaaggtaaaaacttttggcagtggctagggtactaaggtaataaacatgctaattaggaaaaaaacaggggcaagaacataagaccaacctaagctttctggattcaaatccaagctttcaacatattgcacatgggcatttcttatcaacatctagagccaattacaagaaatacaagtttcttatctgctatcattcaacatgctaaggttttcattttgctaatgctatt

SEQ ID NO: 78544 - DNA, 315 bp, Triticum aestivum
  Clone ID: PAT_TA_78544
gacgaggggtttgttttgcactggccgtgtactactaggcacagacgttggcttgtacccatacaatattggtgtgcatttgtatgtatttggaaccattatataaactagcaaacttgtgtgtgttaaaaaggaaaaatgaatgctacggcccaagcaatgctattagccccgtcgcagggcccagcatgcagtcatgtctgcagacgggccacgttaggtgttaaggccttgtttagttccgtgtttttgtactactatttaataattattgtctaatcatagactaattagatttaaaaaaaaaaaaaaaaa

SEQ ID NO: 78545 - DNA, 441 bp, Triticum aestivum
  Clone ID: PAT_TA_78545
cgagaagcaggcaggcgatggtttccggctcaccgcagccaagcctgcagccatcaccctcgccgagcgccagccgatccccatccccacatgcagctgcagctgcacggtggccaagaagagccgtagcgaccggctggcatggagggtcgcagtggcaagcggcgacgccgacgccgaggctgacggtgccgaggcgagcgctggcgcgggccaggcaccgacggcgcgagcggggcggcgggcccggctgtcggcgaggcggcgggagcgcgtcccgctgcccgacggcgtctccggcgtcagtgtcggcgagttcctgcgccacccggacgccgtggagtccctcctcaacaccggcgcgctcgagagcttcgcgcccgcgggcaccgggcccggcacgatcacctgcgggcttcgccgcatcgggctccccggatt

SEQ ID NO: 78546 - DNA, 698 bp, Triticum aestivum
  Clone ID: PAT_TA_78546
gagagcttagccttccgtttttccatcatgaggttgtgaagcgtgctctcaccttcgctatggagaacatatcctcgcagccattaatccttaagttattgaaggaggctgctgcaggttgcttgatcagtcctaatcaaatctcaaagggtttttctcgactagctgagggtgttgatgacctgagtcttgatattccttctgctaaagctctttttgacaagctggtttcaacagctatggctgaaggatggcttgatgcttcttttggtaaatctgctgcccctgacgaagagatgcaaaatacaagtgctgtaaagatgaagcattttaaagaagaatctgcccacataattcatgagtattttctctcagacgatgtcccagaacttattcgaagccttgaagagctctctgctccagaattcaatcccattttcctcaagaagcttgtcacacttgctatggacagaaagagtagagagaaggagatggcctctgtactcctttcttcactgagattagaattgttttcgactgaagatatcatgaaggggttcataatgctcttgcagtcagcagaagacactgcccttgacattgtcgatgctccaagtgaacttgccctcttcctagctagggcagtgattgatgaagtattaattccgctgaatttggatgaaatcagcattaagctt

SEQ ID NO: 78547 - DNA, 743 bp, Triticum aestivum
  Clone ID: PAT_TA_78547
gactcctcactctctcaccgatcgagcagcagcagtggtagtagctagcagcgtcagcgtagcaaggggttgcgagaatggcctcgccttcagcgccggggccgaagctgcagaaggcgatggtggcggtggacgagagcgagttcagccaccacgcgctggagtgggcgctgcgcaacctcgcgccgaccatcgcgccgccgctgctcgtgctcaccgtgcagccgctcctccccctcggctacgtctccgccgcctccttcggctcccctctgggcacccccgttgtagccccggagctgatcaaggcgatgcaggagcagcagcagcagctctcgcaggcgctcctcgacaaggccaagcagatctgcgcgcagcatggggtggctgtagagacaatgatcaaagtaggagatcctaaggagatgatatgtcaagcagctgaggaatcaaaggttgatttactgatcgttgggagtcacagccgtggacctgtacaaaggttgtttcttggaagtgtcagcaattactgtatgcatcattcgaagtgcccagttcttgttgtgaagaagcaggagtaaataagctttccgaatctcaataaaaatctttgtgtattgtcgatgtgttatcctcaacaatgcaataaacaaagccgtattagatgatattcagataactgaataatgtattgtgtaaatagtcaagattatcttgccaataaatatccgcttcttgttgct

SEQ ID NO: 78548 - DNA, 425 bp, Triticum aestivum
  Clone ID: PAT_TA_78548
ttgactacaggaacacaaaaaaaaggtcaagctgctgtatttgattttaaatttcctttgtatgttgtgaatattgatcttgctacgatatacgttttggacacagattataataactttattgtattagctggtggtgtctctttgggtcccataggatatattaagtttgcttgggttaattcaagaacacaagatcttttacctgaatatcgtgaacgtgcttataaagctttagttaatagtggttttactacaaaggatatggtacgagtacctcaaggatgttaaaacaatcatatacattcaattacatgagacaacttgatgattcaaacgaaaaataaaatattattgtgaagaaaaataattgtaaaatattgaataaattttattcagaaaaattaaaaaaaaaaaaaaaaaaa

SEQ ID NO: 78549 - DNA, 607 bp, Triticum aestivum
  Clone ID: PAT_TA_78549
taccgcgtgtatcatcactcttaaagatcagggtatccatgctgtaaatcttggggatagtggcttcgtagtagtccgagatggccgcactgttctcaggtcaccctcacagcagcatgatttcaattttacttatcagcttgagagtggaggtggcagtgatcttcctagttccgcacaagtatttcactttccggttgccccgggtgatgttattgttgctggcacggatggactttttgacaatttatacaacaatgagataagtggtgttattgttgaagcactcagggttggacttgagcctcagattgcagcacaaaaaattgctgccctggctcgacaacgagctacagacaaaaataggcagtcaccattcgcatcagctgctcaagaagctgggtaccggtactatggtgggaagcttgatgacataacagttgtggtgtcatatgtgaagagtgcctgagccccatgatccgagtctttcttttattagaatgtacataaatctttgtcctgaactggcgcatgtatgcaccggggcatagaagtgtattctcaaggtgtgaaatcccctgatcctagaagcacttgggctatgttt

SEQ ID NO: 78550 - DNA, 347 bp, Triticum aestivum
  Clone ID: PAT_TA_78550
cctaaagcagtaactcctcagcaaaataaaggtttccaaggtgggaaaacaacaatggtccggtggtaagaacaagggacctcagaacaactacaacaaaaaccaaaactcgggtaaaaaaggtaccccaggtaaatttggtggatctccaggaaataaaggaaacaagaaaccttggcaaaataagaagtagacctaacaagtagccaattatttgttccaattacattgattatgttattaattatcatctcttctacctatcttcctattttctatgcctatttcaaacctctaatcaaaattgaataaatcctcttcgccattataaaaaaaaaaaaaaaaaa

SEQ ID NO: 78551 - DNA, 479 bp, Triticum aestivum
  Clone ID: PAT_TA_78551
gtggtgcttggttacagacaacagtggcagtaaagcaataaccttgcttctctaggttttctatgacatcagatatagtagtgaagttgaaattcttatcctgatcatacaagaaagaaaatccatacttgttgccctctagcacatctgttccagcatttgttcaatgatcacatgatctacagatgccatatgggagaacaaaataatggcagaagcaaagtattgatactaatcctacccgaaacttgtagatggctatggtgcagaattaactacctgctgttttgttgtagcctaggagtagttggcctacattgagctgagaggaaaggaagtagctatgaggtagccatttattctattaagcaaccgtcacattttcatagttcgggtgcatactctgtaatcacatacagtttaacaatgttatgtattgtgatcatgaggacttaccagaaaaaaaaaaaaaaaaaaaa

SEQ ID NO: 78552 - DNA, 608 bp, Triticum aestivum
  Clone ID: PAT_TA_78552
gaggcgttgcgctccgacgccgccgagccgccggtgccgtcctcggtgccgcggtccgtgccggtgcgcgtcgcctacgagctgcagcaggccggacaccgctacctcgacgtcagaacggagggcgagttcagtgctggccacccggaaggagctgtcaacatcccctacatgaacaaaaccggctcaggaatgacgaaaaacacgcactttcttgagcaagtgtcgaggatcttcggaaaggacgacgagatcatcgttggctgccagagcggcaagaggtctctgatggcggcgacagaactctgctctgctggtttcactgctgtcaccgacatcgctggtggattctcgacttggagggagaatgagctgcctaccaccatccactgatccgagcttgcctcagcagcatcatgcatgttgttggagctattagcccagtgttgtgtgaaagcctccaggattgtacatatgtctgatgtcttccatagttcgaataaaagtgctggaaaatggagcatgtagagtaaagaagagtagcagcacaaaaaatagggggttttacattatgcttcatctcatgtatagtcgtacattatctactc

SEQ ID NO: 78553 - DNA, 573 bp, Triticum aestivum
  Clone ID: PAT_TA_78553
gagaaatgtaaggaattggaatgggggagatataggaaagcaacagcatgcacttcccacatcttgtcttctttcaatagatggatgggcttcaacttatcaaaaagcttggtaatggttgtctggcctggctttaaataagccgttccctatgccctaacggcctaacctgttacccgtgtgttttctatattctcctcatctttgaactcacttttgggtattgcttttcttaatcttgtttgaaggccaaaaaggcaattgtcagtgcattgtaacttggaaggacttattttagttggtcaggagattccatttgttcctctttcatttcaaggttttgttttctcatttcattctcaggtcaacttttattgcctaatccatatctgctacttccgtcatatgattgcaggctagaaatcatcaacaaatgcttttccaaaaaaacagtagaagaaatcatagcctctcttgaacaagaggctccaaatgttgctgatgaatggattgcttctgcaatccagtccatgaggaaggcttctcctactagtatgaaaatatccttgagat

SEQ ID NO: 78554 - DNA, 605 bp, Triticum aestivum
  Clone ID: PAT_TA_78554
ggcatagatctagtagattttcaagatctgacagaggaaaataaatagaaaaggggtgtgtgtgtatcttgtctctgttggctaatctaatgtaacacatttcactgacacaggctctcaggttttctcagttgcacaaaatagatagattgtaatattcaggttatctttaggaaaggtttctaccgtaggatttgttggtccagttgaagcatatactgtcaagtcaaaggcttgttattttgtaagattttatttagcctttatcttatcttgctgctggcatatgtgttggagtcatcatttcacactgttgtgaagaaatccaagatagaggaggccaatgctaacctaagcatgttcgcttcttttatttgggagtttgcttgttatggttgcatcaagtgccgtgcggtgttcgtttgagaagttgcttgtgagttgcatcaggagcctatccgcttgatggaggggttactgttctgaatcaccaatcctcattaggtagcttatggagggcagaaacaagatttatcagatgtttgcttaataaacaatggactaaggtggattcacttcctctcaaaaaaaaaaaaaaaaaaaaa

SEQ ID NO: 78555 - DNA, 339 bp, Triticum aestivum
  Clone ID: PAT_TA_78555
catttctcccgagccccgccgtgagcctccactcgccgccgccgccgttcgcccgttccagcttcgtccatggcttccctcaccggatccgctctctcctttgcgaggcccgtcaaggcaatcagcattaagtcttcctctttctctggtttaaggaaggacaatgtagccttccgcctgcagccagtgccacaaagattcgcagtctgctgtcctgctaaaaaggagaccgtggatgaggtttgtaagattgtcaagaagcagcttgcacttgctgagggcactgatgtttgtggctcctctaagattcaagaacttggtgctgattcattggacact

SEQ ID NO: 78556 - DNA, 407 bp, Triticum aestivum
  Clone ID: PAT_TA_78556
cagcctggacgagttcgcggcgctgaacgcgacggtggccggcgacgcggcggcagtcgaggaggacctccgccacgcgttccgcgtcttctacgccgacggcaacggcaccatctccgccgccgagctcgcgcgcgtcctcaggggcctcggcgagtccgcctccgtcgcgcagtgccgccgcatgatcgagggcgtcgaccagaacggcgacggcctcatctcgttcgaggagttcaaggtcatgatggcgggcggcggctgcttcgctaagatcgcgtaggttccgttcccccctctctcgcgcccgtcgaatctgctgctccatccatccgtcgagctcgtcttcttcctctgctctgcttttttggggtccaaccctctctcccttcacagccgagcgtgtg

SEQ ID NO: 78557 - DNA, 506 bp, Triticum aestivum
  Clone ID: PAT_TA_78557
aggtgtagggctggggcgaggactctaggaggcgttaggtggccgaagaagaagttcgacatgtagtgctctaggccatggccctcacggggcggttcggtgcacgatgcagtccacggccatggcgataatattttcggccaaggaggccatcgcccccactttgtcgatgggcatgtgtatgggcacgcattccatggggcgagcagatctggccctagcgatgtcatctttggtccagcagcacgctccgtgcagtgagcagtttcgtgcacaaggaggggtctgcttgcttgtttctaggctctctatgacacggtgagcagcaggctaggcctgatccaacagaggatggtcgaaaggattcctctatttggtgtgaggtcaatggtggctcgtcataggacatggcttgctacgtttgcaactttcttcacttatgacagtggcgtactttggtattccatatagctgataggctaatgcaaaaagctagtttttcatat

SEQ ID NO: 78558 - DNA, 584 bp, Triticum aestivum
  Clone ID: PAT_TA_78558
ggtctgcacctgcattagccttgggagtgttgggctcgttctatcaatcgctgtcccagaaggtggcaacaactggttctggcttatgaccctaagccccttggcgggagtgtactactggacaaaagcgtcaaggaaagaagagatcaaggtcaagatgatcctatccgacgatgggagcttatctgagatccttgtgcagggtgatgacgtccaagttgagcagatgaggaaggagctcaagttcagcgagaaggggatgatatatgtgaagggcatctttgagacatgaccgggagtttgatatctgtgagtgaacagtcgagatgagtctatttgctgcaacggaaactgcagaactcaggtgaggaaatgcaaattggacgggcaaatctgtaccttggcttaaaggaaaagaagtgatcttcatacgggatttgattattgtaagtgttggcagtatgaggatagtttatgtgtgaacttgactttgtaaaaagttgatgagaaacaccttgttgagcatgaaaatactagcccttttacgggagaaaagaagtaactggaagtttggccgctgcaaa

SEQ ID NO: 78559 - DNA, 685 bp, Triticum aestivum
  unsure (1)..(685): unsure at all n locations
  Clone ID: PAT_TA_78559
cttcttcttctccgcttttttccccttcttctggatgcacctnggaaaagttgatccatttctcggcagctgccagtcctctattgacatcccggcggacccaaagcccccccaaggattggggatttctgcttcgtgttctgctcctgctgtaggcgttgttgattcgggtgatgagagatggccttcttggcgtgcttgtgccgatgtcctcaggacgaggacgacgacgacaaggaaggggaacagttcagaatcaatcgccaggtggcctcagtggactactcaaaatctcctgaaagctgcccattgaagactgagagagcggtgcatatggaaggagcccagctaattggtagacatgatgaagcaacaatcttcacgttgcgtcagcttgctgaggctaccaaaaatttcagtgaggactatcttttggggcgaggaggatttggttgtgtctataaagcaactcttagtaatggacaggttgttgcagtcaaacaacttgatctaaatgggttccaagggaacagagaattccttgtggaggttctcatgctcaacctcctgcatcaccgtaatctagtcaatttgcatggctactgtgttgatggtgatcagcgcttgcttgcttatgagtatatgccattgggatcactagaagaccatctacatgatcttgcac

SEQ ID NO: 78560 - DNA, 397 bp, Triticum aestivum
  Clone ID: PAT_TA_78560
ctaattgcctagctacaacattcttttgactgacagtgatttatttgtgcatcgactctttgcacatgccatgaaaacattggagaaacaattacacaccaaatccccttttgcggcgatatgggaacaccaagggatgggcaaagttaacagcttggccagccgtggggctctccgtatagcattcttttgattggaattttgagttgtccctactgaacatgtcgtcaaggtagcatacaagggatctgcccatatgaggaaggcgccaatgggccttggttttgtatcagttgatgccaactcaatcaggctacgaagctaggtagggatttaggtaccttgcgctcaaatgtgcaattattgtcagaggatgactggaaagatgtatgaaatg

SEQ ID NO: 78561 - DNA, 354 bp, Triticum aestivum
  Clone ID: PAT_TA_78561
ttaaagacggcccaccaccaacaggacgaagattttgtattaatagtgcttcaatgaattttcatccaatagatccagaaaaataataattattcacatgaaacattggttatatattgtttgcagagttacttactatatatttattaacacaaaatggattttagttaacataaacatgttaatatttattagtggaagtttccataattaaactaatactttattgtgtcaatgataatttactattaattatcacctaataagaaaatattgtgattaatgtaaaataattaatatttatttggaattgtataataaatgtgtttgtaaacaaaaaaaaaaaaaaaagaa

SEQ ID NO: 78562 - DNA, 363 bp, Triticum aestivum
  Clone ID: PAT_TA_78562
gaaaggggatggctggtggagaactggtggtagttcctgtagacaaaacaggatttgttcctgaggatgctactatagttggaaacacttgtctgtatggagctacaggtggtcaggtatttgtgagaggcaaggcaggagaaagatttgcagttagaaactctctatgtcaggcagtggttgagggcaccggagatcattgctgtgagtacatgactggtggttgcgtagttgtacttggcaaggctgggaggaatgttgcagctggaatgactggtggccttgcctacattctagatgaggatgatacacttctccccaaggttaacaaggaaatcgtctagatgcatatagtgaatgctc

SEQ ID NO: 78563 - DNA, 716 bp, Triticum aestivum
  Clone ID: PAT_TA_78563
gttcaacgccaagggcaccattgactgctacgagggggacatggaggtgctgcccgacgctggggcgcgcaggagggagatcgccttcaacatgatcgacggcgatttcaagctcttccaggggaaatggtctgtcgaagaggttgatggtagcattgttgaaggtggtggaaattcagaggagcaggaattccagacgacactgtcttacctgcttgagctggagcccaagctctgggttccagtgagactactggaaggaaggatatgtagtgagatcaagaacaaccttgtttgcatcagagaacaagcacagaggattcagagattacagcatgagtgatataggtagcgcctctgtgaaggtattgtgacaagttggttgattgattggcagtggtggccatggcgcctaaatgagagggaggaggaatgcaggtaaaatgaaggtgataccggtacatggtattgctgaaggatgtggtgtctgacatgctcactggtcaactgtacatgtgagtgagtgatgagttgatgacaatatgtagtaggaacatgcaggatcatcattcgtttggagtctcgagaagatttgaccttgtcccagaaaagggacgttgcgctttagcatttgtttttgcaacgtactctagtctagcaaaagcagaagatggatgttgacgctgcaactgtgtttcatgtaatcctcccctccc

SEQ ID NO: 78564 - DNA, 566 bp, Triticum aestivum
  Clone ID: PAT_TA_78564
tcatggagatgtaccgcaggatcacaggggtgacgtcaagtacccgcagtggttctcctctgatctgcggcggttcatgtccaagctcctcgatcccaacccaaacaccaggatcaccatcgagaagctggtcgagcacccgtggttcaagaaggggtacaagccggctgtcatgttggcacagccgcacggctccaacagcctcaaggatgttcaggttgccttcagcaccgccgacaatgaaggtggcagcaaggtggagcagccggcgggcagctccgtgaagccgtcgagcctgaacgcgttcgacatcatctcccactccaaaggatttgatctgtcaggcctgttcgcggtggaccaagagcagaaggccagcaactcacggttcatgacccagaagccggcgtcagcgatagtgtcaaagctggagcagattgctgagacagagagcttcatggtgaagaaacaggacggcctggtgaagctgcaggggtccaaagaagggaggaagggacagcttgcgatcgacgccgagatcttcgaggtgacaccggccttttatg

SEQ ID NO: 78565 - DNA, 250 bp, Triticum aestivum
  Clone ID: PAT_TA_78565
gctgcgctgatcccaacacgcgcgcgcattccgatgcgtgggcgtgttctgattcgacactcctttgtcttcgtttctttgttctcttccttaatttaacgaattcattgatgcaccaagtttaatttggtgccttgttatttgttcgtccctttagagagagggatcgacacttgtaccattgcttgccatttatttggatcaattcaacaattcgatttaaccaaaaaaaaaaaaaaaaaaaaaaaaa

SEQ ID NO: 78566 - DNA, 781 bp, Triticum aestivum
  Clone ID: PAT_TA_78566
gtcggacttcccttccggccaaggcaagccccggacattaaaccctatccttgtattttcataaagttatttatatcacttgagttaatatgatgcattaggtgaataggagttgagtgaatcctatttgctgcattatctaccttgatgatttccatattaaccttgatacctgctttatgaaaatgcttagtatgcttagccctgcttattagataggttttcaaatgagaaagcttgaagggttgttgtggaatacttttatggttaataatgtttaaacttgagaccggtcggtggacttgctttaagaatggagtcttaaagtagtgtctccaactgagtcgattaaggaccgtaccgttgattggcctgttgtgattgagacctttgagtacagcccacatgcggcggtaagccttacctatagctattccgatacttgagaacggctaaccgcgtactgggagtggaaagatggcgagagtagcgtgtaccaaccttacggatctgagatgaccgggaaacatctagattggctgtaggatggtggtgtactgtactctcgggtgacgttggacccgttcttgtatgggaggatctatagaaaaggttgacatatgcaagattaagttctacatatgtcgtgtggtactgaatccccagctgggtttaatcgattcgaatcgtcgtgtttcctcggatatggagcctcaatcctcaccccatcatcgtagtaataagtgaacctttggtataagaaagatatggtatgcttatg

SEQ ID NO: 78567 - DNA, 520 bp, Triticum aestivum
  Clone ID: PAT_TA_78567
ggtttaatcgcacagcctccacagctcgaaaccctcgccgccgatcggattcggagaaagagacgcgaaacaagatgttcctcggcgcggtcccgcgtcgcccgagcaaggaggctgcgtacaagcagctgcggtcgcacctcgtcatcatggcctcctgcgccgccgtcatccgcgccgccccctacatcctccacttcctcacccgcgacggcgatgtccaggagctcaagctcgagctctaggcccctcagttcccatgccacctccaaaggttctacaaaggcaatcgtcatttgagactactgcaaagtaatatgaagttagcgaccccagtgctacttaagtttctttgttctttcaaatttagtgacaatggtgtagtaactggcttgtgactgtgaccagtattgcattttgcctatctgtatggtctagacttgtctgcattggtggatctgcagagatgttatcattcaaccattctctgagctcagttgccaaaaaaaaaaaaaaaaaa

SEQ ID NO: 78568 - DNA, 651 bp, Triticum aestivum
  Clone ID: PAT_TA_78568
ggtaaaggtgtgaaaggagaggcttggggatagaatcacagcacttcaccagatagtatccccatttgtcaagactgacactgcctccgtcctacaggagactataggctatatcagattcctcctgagtcaaatcgaggctctcagcttcccttacctaggccatggcaacggggggaactccatgcaacagcacaatctgctgctaaaccatagcactggcaatgacatggtagaagttgaaggctcgaccaagcaggaggaggaggaggtcatcaatggcgttgatggcagcaggaaggatttacggagcagagggctgtgcctggtgccggtgtcgtgcacgtcccacctcgccgacgacaacggcgcctccgacttctgggccgtggccgcggcgccgcctcctccgccgccgccgctcgccggcatcatctggcgataggacgatccggatcggatcgattcattcatcaagccaagccagcatcgtcgtcgtcgtctcacagcagctgcatgcacacgcgtacctacgtttgggtttttctccacgccatgccgatcgatccatatccatcaagctaattaaagttgcatgcatgcatgccgtaaatatatacataccatgcaccaccattacactgtttcttt

SEQ ID NO: 78569 - DNA, 647 bp, Triticum aestivum
  Clone ID: PAT_TA_78569
caatgaaattgttttttctgggctaggatttctcccaagcatcaacgaggttcaggttggagtttactttcctttggattgggacaggataagggccgctcgggatcatgagactcagtacaagataattgaggaagaaaagcaggaagaaaggcgcaagagaggtgagctcaagaagaaaatccaggaacagctagctcagaatacaaacgaacccattgtgacggtggactgagtacgtctggaacagccacaggctgattcgatgatccgtacaaggctgaagacgatcagagcgggctgcctgggagcaacagccaggtgggtccaaatccaatatggtacctacgtgggtgcgtaccgtaccagtgcatgtgccgccattccctgatatatatcatatatgtgctatgcgcatgcatgttgttcatttctgttttccaaaggattggtggtgtacgtgtctgtgcctgcgcatgttgtaaacaagtactgtatttgaatacagcctcttctacctatttcttcttggtttctgtattataaattgaagatgcttttacgagacaagaatccatttatgtggcccattcaaatatactcaagtggccaaagtttatttccttttaaaaaaaaaaaaaaaaaaa

SEQ ID NO: 78570 - DNA, 774 bp, Triticum aestivum
  Clone ID: PAT_TA_78570
ttcttctgcgttttcatcttcccctgctcaacaaacctctggttatggatcatctttttaccaaagcttacctaatggtgtcaaagggagccaaaatagtcaaatccaacaacaacaaagtgatgctgaatcactaccaaatcaaacctcacaaccagcatttgcttcattttctgcatctgtaaaagggtctgctccagtagcaccacagactcaacaaaattttgatgatggttactcttcaggattccaagctccaattgcttcatcagcacctgttcaacagactcaatctgagcgaggatacagttctgtacctcaatcatcaggagtaaaaggtggtcaacaagttgcaagctcttacgaacaatctcctctgccaaatgtttcaggaactaaatcaagtttaaatcaaccaaaagtcccacttactattccaaattatcgaacaaaagcaggcagatctcaattaagctcaactaaatcatcaaagaccgcaccttctaatcaaaagtcaccaatctcatcttatccatctttccctatttcccaacaaacccaaccagaacagcagcaagataccaaaggcgctgttaaaccacaaccacaaccaaatacaaaaactgcactaaaaaatccatcaacatcttatttaccagctttgtcaccacccagtgcaactaaatcgacatattctgctccaccgcaatcaaaatcaccacaacagggatcatcttactttccgttaccagtaaattcacaacagcaacttca

SEQ ID NO: 78571 - DNA, 715 bp, Triticum aestivum
  Clone ID: PAT_TA_78571
ggccgccttctactcgaccaagtacctgaacctcccccaagttcagacggccatgcatgccaacgtcagcggtatcatagactacccatgggttttatgcagcgatcctttgtattacaactggacagacacacctgcttccatgctacccatctacaaggagctgattggagctggcctcaaggtctgggtcttcagtggtgacacagacactgcagtgccgctgagtgggaccaggcgctctcttgctgccctaggccttcctgtaaaaactagctggtacccctggtacatagtctcaaccgaggttggtggctggagtatggagtatgaaggcctgacctacgtaaccgtccgtggcgccggccatgaggttcccctgcaccgtccggagcaggcgttcttcttgtttaagcaattcttgaagggccaacccatgccggctgaggcaaaagatgccagcctcatactccttcccagtgagaagtaattaggctcccctctgactaagcaagcagggggcagcacaggttgcggaggctcgcgcagtcatgcttgacgacaacgatatccactactatatatcgctgaataatgctgcattatgctgttgatatgtacatgtacgtggagaataaataaagctggagcctgaaataatgctatgaaaaatgtatacaaggcttggcgatggccgatggatggattctttctt

SEQ ID NO: 78572 - DNA, 614 bp, Triticum aestivum
  Clone ID: PAT_TA_78572
gagagagagagagagagagagagagagagagagagagagagagagagagagctgcccgctgtgttcgtcgggggaaagctcctgggcgggctcgaccggctcatggccgtccacatctccggcgagctcgtgcccatcctcaagaaggccggtgccctctggctctgattttaatcttagtctatcgatcagcagcgtatttctcccttcctttttttttttcttttccctccaccttccagaaatgatggcgtcgtcgtgctttaatcctggccgttggatcgatcgagtatattgcatcacatcgcggcggatgcgttggcatagtaggactttgattttctttttctttatttacttttttaattaggagaagcaaaaaaaagagcgatgagaattctaatcgcaaaatttatctaggagtaatagctttgtctgctatcttggggcacgtgcgtgcgtgtgtgatgatgagggctcgcttcgcgtcttccatgcatccatccatccatcgtgtgaatacggaagacgagcgagagagacagagggacgtcctctgctgccgcatctgtacagtcgttttccgtttcggatttttaatgaggatgagctgt

SEQ ID NO: 78573 - DNA, 642 bp, Triticum aestivum
  Clone ID: PAT_TA_78573
tggaactgaagttgaggttgaaattattgccaccaaagacgatggtattgaccatgttcagtttagtatcaaagagaaacgttcaaatggacaaagaattgctgaacctttggtcgaagagtttgaatatttaaacttggataatcgaatcagtccaatcacattttgtaaagcatttccattccatctgatctttgatcgtaatcttcaagttaaacaggctggaacatcaatttcacgtgtcttacctgctcttcaactgaccaattgtcgagtcaatactgttctcgaaatggttcgacctcacatggaatttgcatttaaaaatattctctcccatatcaacactgttttcgttcttcgaataataactgacatgatttcaactcgtcctccagattgtcctcataaagcaacaaatgtaaaattacgattaaaaggccaaatgattcacattcctgagaacgatttagttttattcctttgttcaccttcagttgttaaccttgaagatctcaataatcaaggtttatatcttgatgatataccgcttcatgatgcaactcgtgaccttgtattactttcccaacaatttgaagctgaatacgaactgacccaaaacctcgaaatattgactgataa

SEQ ID NO: 78574 - DNA, 572 bp, Triticum aestivum
  Clone ID: PAT_TA_78574
ggaaaggaggttgctggggaaggtgaacgcgcaaaagagaaaggccaccgaggaggagaagacaattgctcaggaggtgaatgatgatagtgatgatgacagtggtgagactgaaagcagaactagtgcctttagcaagaagaggacggcgccttcggttactgccatgccattggggaagaaggccaggtgacaggtagtgtgttcatattcatgtctgtatctttcatcggaatattcacattctgctagattaattaccatgggtttgttataccctgtgtaattgctgaacgtaagggtggatggtttttctggatattgttggtcattccgaagttgaatagtgaatagccttgtaattttcagctactaaattggtttagatcatggaagagaccaagagaagtatatttataatttataagatggttttttctaaggctagaaatgcaaggtttcttatatctttttctttttgggagagagttgcaaggtttgttatgcctgtaatcagtgatacctccatgcttcaagcttcagattaatgaatgacctcatgctggtgcatt

SEQ ID NO: 78575 - DNA, 638 bp, Triticum aestivum
  Clone ID: PAT_TA_78575
tttttttttttttttttttttttcgattaagcaagtaactaaatccattaattcgaccttccaatggagaaaggttttaacgacataatccaggaagcagagcagctatatatatgtccatactcaacgttcataaaacatcagaaattaactgtaaaaccactagtatattgtacaactgacggtcagtaattatgtaaggtcaggtaatactgtatatactaatgccagaaccatgcaagctattgattcatatttacatgtaggcgttgcatccatagtcagatctccatgatcctcccaagctcgtcccaggtgctgccactgtcctgtaagcatgtcacatcgctccacccgagattcgatgtcgatggtggcaatggaggtcccactcccatgaatcctgatgacaccgtcatctcggttgatgacggcgatgaaccatggaaaccgcgtagcaggaagggctggtggtgctcagttgcagcataagccgcctcggatgagtggaagtaatggtgctgctgctgctggtggtagcggtagtagtcatagtagtactgcaactgttgctgctggtggtggtttcgcttgctgccttgatcctgcttctgctgctgctggcacctccggttgta

SEQ ID NO: 78576 - DNA, 360 bp, Triticum aestivum
  Clone ID: PAT_TA_78576
agaagttcctcaactaccaccggtaaactcagttttatgatttgccactggtaaacgcgttttcactgacatacatgtgttttctcaataatcaccttgtgctagatgtattcatctgtaacaggtcccatctcagaactgagagtgtattattggcatggatttcagattatggattcatggttgtaatagggagagaggcaaggttgtatcctagctggatttggaacttattgtagcatattcttatgattgccatttgtagattggcactcaaaaggatgtatgggcataacgagaagatgttgaaagatgaaattaattcttgtattgtgacatagcaaaaaaaaaaaaaaaaaa

SEQ ID NO: 78577 - DNA, 471 bp, Triticum aestivum
  Clone ID: PAT_TA_78577
agtaaatgttcctaattcttccttttttttcatcccctacaccatagagaaaccccactacaaattgggatggcaaagttccttattgaatccgccatggagagtacattgaatgtcagtatgtttctagctcaaaggatgtttggcctaggatgtcttttgggcaataatcctatatccagatgaaatgcaagtaccagctaaggtttctggatcagcatatggaaagaagagtagggatgtcctaaacactattcagagtattctgcgatttggaccaaggaaagacagattttgtaattgtaagaaatgaaatggagcagtattgtagcttgaagatttcttctgctttggtcttcaactaaacatcaagtttctttggggcgcggctacctatgcagatgtaattttatctgaaacagccacggcaacaatgttttgctaaactgattgtgccacctaaagtatata

SEQ ID NO: 78578 - DNA, 587 bp, Triticum aestivum
  Clone ID: PAT_TA_78578
gcgattcattgaagatgaggctcgctacttcttccagcagctcatttcaggagtaagctactgccattcaatgcaagtatgccaccgtgatctgaagctggagaacacacttctagatgggagtgatgctcctcgcttgaagatatgtgacttcggctattccaagtcatctgttcttcattcccagccgaagtccaccgttggaacacctgcttatattgcacctgaagttctgttgaaaaaagaatacgatggcaagattgctgatgtttggtcatgtggtgtaaccctctatgtaatggttgttggtgcatatccttttgaagacccagaagagcctaagaacttccgcaagacaattcagcgcatcttgaacgttcagtacgcaattccagacaacgtgaacatatctccagagtgcaggcatctaatttcgaggatttttgttggagatcctgctatgcgaataacaatccctgaaatccggaatcatagttggttcctgaagaaccttcctgctgatctgatggatgatgatagcatgagcaaccaatatgaggagcctgaccagcccatgcagaccatgg

SEQ ID NO: 78579 - DNA, 782 bp, Triticum aestivum
  Clone ID: PAT_TA_78579
cgaggctatgatcaaaattctgtatctattgcttaaggatatgatctaatgttcgttcacctgtgaggtagtgggcatgtcctgtttaccggtattatgcaatttttggagagtggcccatttgttagcatgcccttaagctccagattcatgaacaaatgatgatcgacacattactgaggcctctaagaagctctggcaactttctaaccatgtgccaattcatgtcagtgcattccccattatgttctgcacattctttttataacccgctttcttatgaacacatttccattttatcagaagtaaaattatgcttacattgtgtctggctcaaaattttgtaccttggtttcgtgcatgtggcctcaaggattgacacttttaactgctatactaactaaatcatacttcttatcatgcagtttgggatgctaatacaatatctttttgagaaattcccaaattggcaggagatagctagccatgccattgtcgaccttcaaggaagcttggtctggccactcatgtcccttaacgtctgagtaacatcatagagcacacatgggccgtagcatcagtttcgcagacttatacaaggatggagccatgccgtgagaagaggtgtctttgaagcagaggaaaagtgcttgtccatctgagaagaataggagagcggcaaaacacaagtgcaggagggatggaccacctcgatctgtactgcccaaatttggttttagcctgaacttgaactgcaggctatataattaagaattctggac

SEQ ID NO: 78580 - DNA, 737 bp, Triticum aestivum
  Clone ID: PAT_TA_78580
cacgaggctctctcttcttcttgggaggctgggagctaccagcacaacacaccaaggaagctgaggcgagaacgattgattactttgctggctgctcttagctactactacaactgttttgtcttaatcggttgattacatctcatatttcatcggtttagctcgctctgtgcgttgatttcttgatatcatggccaagaggcacctcttgttggtgacaacttgtttgtgggctctgtcatgtgccttgctgcttcatgcttcctctgatgggttcctgagagtcaacctcaacaagaagagattggacaaggaagatctcactgccgccaagttggcgcagcagggcaaccgtcttctgaagaccggcagttcagacagtgatcctgtccctctggtggactacctcaacacccagtactatggggtgattggcctcggctcaccgccgcagaacttcacggtgatatttgacactggaagctccaacctgtgggttccttcagcaaaatgctatttttcgatagcatgctacctccacagcagatacaactcgaaaaagtcgagctcttacaaagcagatggagaaacttgcaaaattacatacggttctggggcaatttctggattcttcagtaaggataatgtgttggttggagaccttgtagtgaaaaaccagaagttcattgaggcaacacgcgaaacaagcgttacctttatcatcggaaagtttgatg

SEQ ID NO: 78581 - DNA, 418 bp, Triticum aestivum
  Clone ID: PAT_TA_78581
cgtacaaccaggccgtcggtgtcgtcggcccgggacaggcgagtgccgccgttgccaagcacggcgtcaacgtcacccaggacgccgtgcccggtggccgcatcgtcaccgagttcgtggcaggcctggtggtaggccagtacgccgtcgctgaagcagcgccgccctcgccgcagcagcaggagcaggatggggcgggtcacaaggccgccggaaacgaaggtggtgcaggacacggcgacggaggagcgcccggtgggcgcgccggtgccacggcggcgaggcgggactaagatggataggccgaggcttcaattttatcatcgtgttcctctggtcttgcatatataacatgttcctgtgaatgagctctcgcgctactatgctatatatgcaggtagcagaccttgtgtacggt

SEQ ID NO: 78582 - DNA, 543 bp, Triticum aestivum
  Clone ID: PAT_TA_78582
cctgctccaactgctccacctccacctccagctcaaaaccaacctccaacacacttccctggccatgtttcacatccccaggttccatcaatgccacccgctctgccggctccttcagtgacaaccataccacaggaatcctattaccctccatcagctcagccgactgaggccacccaccagcagtaccaggctccaccagctccgcagcagcctcaggcgccacagccagcaccaccgcagcattaccaaaccttgcctcagtatgctcaatattctcaacctttcccatctgcaagtgtcaaccccacagctgcgcttccaccaccagtgccccagcagcctgaagaaccagcaccttatggcccaccttctcagggctatccaccaaatgtccgcgcaccacccccttatatgccacccccaagtggacctgccgctccattctatggaccgaaccctggcatgtttgatgtgtctgctgccaggcctaattctgggccaccgccgccctacaatgctggatacaaaccaccggctgca

SEQ ID NO: 78583 - DNA, 669 bp, Triticum aestivum
  Clone ID: PAT_TA_78583
gctgtacgcagagaggcttgtggctacttcaatggtttccaaaatcttaggcaaatgctcttttacctgtcccagagcatccatacgagccaacaaatgttgataatgaccaaggtttgtcatggcagcgacgccttttagtcgagatattcgtgcagataatgatttgtggatgcatccttggattttggtgagaccatcattatttgtctccaactctgtcattagcttgtttttctcattggcagctttacctagctgttcatttaactctcttgtgtttgacctttctgcttctaataacctgttgacatggtcaatctggtcctctagaacttgaagaataaaaaaatacattgtaagaaacattatgttctgatgcttgatgaaacatgaagagttggttcaaactttatacctacatttcaatgttcgacctgtgtgctccttttcaacatcatagtgaaattattcttcagattgctaaactccgaattcttctcggccatctcctgttttagggctctattttctcggagtgcttctctctgagcagcctcagtttcttgtgaccgcttggattcaaaggctgctgttgttggtggatgtttcccccgggctgcagttgtttttgcagctttctggcctccttttcttgcttgaaagttt

SEQ ID NO: 78584 - DNA, 422 bp, Triticum aestivum
  Clone ID: PAT_TA_78584
cggatcgccgcccgccgccgccacgatgtcgtcgatgctgtccgcgttctcgcagtggttcgtgaacccgcgccgcaacccgctcgcccgcctccacatgcaggcgatctcctcgcgcctccggaaatacggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggcgcaacagacaccattcagaggctatttgagtgacatgatggatctggtgaagaaggagagattatagcgtgaagaactgggagcccttccccttcaccagaggacccttccctgaagtcttatcttgatag

SEQ ID NO: 78585 - DNA, 660 bp, Triticum aestivum
  Clone ID: PAT_TA_78585
ccagtcctaggagcaagataggactgacaatcgctatcaagatctcgatccccagtttcttctccttctcatgcaagatctgcgagcagaagcacatcccgttctcggtctcctgtgagatccgattgaacttgggagcccttgaagcagtgagcagctccagggagaagaaaggaacttaagaacatgccgtgccaaaagatacttgacaacatgagaacactaatggtccgagtgattatgttgttgccgctgctcctccacatttgggaggtctcctcttatttagacggagcatttaataattatattacattatattgctaaagagagagttattatgcgtagcataccggtgtagactgaaattgtttgtcctcggtgttcttggctcctggaactcggttttatcatttgattacaagactctggttttatcattgcacccatatagcaaaacctataggtgtagtaggagtatgctgtatgcgtctatgttcaattggtcgcatgtaaacctggatacgcacagttgtttggttccatggtgtcttgttacaatgttccaaaatttgagattctttggaacaatgttttttttttgacaacatccagattttattagccacagcaagcagctgttaagatagttacattggt

SEQ ID NO: 78586 - DNA, 482 bp, Triticum aestivum
  Clone ID: PAT_TA_78586
gtccgcctttgagtcgactgtcaaggaatgaatggtatttgtatcgacagggtcttgagctgggagctggaatgcttgagtcggtagcagggtatgtaatgagataagtgtggttttctgctacttgtcaaagatagcaatgggagaccatgatgaattcaggacatctgaaattttgctgctctcagatgacccaaccaatttaaaaatttccaattgggctccgagggaccaaggatgttgcgactcaggtaatgctttcaatgtctagggatcaagctggcatgtttgtcggttcctcgagctatatctggttactttgagctctagctgtgatgggagtggcctttgttaatggtactaaacttgaaatgactccagtccagtgtcatggtggttgtgtaaagtatgtgttagctcaggtggattagatctctagctcttgatctaatgtaatatttccccaactccggggcctttgt

SEQ ID NO: 78587 - DNA, 358 bp, Triticum aestivum
  Clone ID: PAT_TA_78587
gtgacgcttccgctcgcgcatctcgggcgccagcgccaccatccgcaagcccaactccgacccccacgcgccgtggtgtcggcgccgccgctcctgccgcgtctgtgtggcgcgcggggctacagctacaggcgcatggcgcggcgcatcccgatggcgaggcccgacgggtactccagctccgacggcgaggcggaggatcccgacgcgcgcgaggccggggagatcacggagcccgtcggcggcgcgggcgcggagggcgacgacgactctgagggcagcgaggtggaggggatcatgctggacttgagctccttccccggctccggcgacaaggagggcacagaagagggaggga

SEQ ID NO: 78588 - DNA, 479 bp, Triticum aestivum
  Clone ID: PAT_TA_78588
atttgaaaggaggctatctatagtgaaggatggagtaaaaccaagagcagataaaccaaaaagaaggccaacaacatcaacacacaccggaaggtctagtgtacctgataaatcccaacgttcccgaagtatgtcattcagtcctgatcgtgtaagagtcagaggaaggtcgcctgctttcaatgcgttggctgctaacttcgagaacccaaatgctcgaaacctatcaactcctccaccagttgttaggaaacaagttccgaagcctgtatctcctgattcttcaaagccaactccaaggacagcttcaattgctgcaatttcttctacttttgagcggcctaaagcaactctaataccaaagtcaataaaatcgagccctgatgcaagcaagccccaaattgaagcgagcaaacctaaactatagacaaatgccaaggaaattaaccctacaaaagataggcaaattgcaacttcta

SEQ ID NO: 78589 - DNA, 433 bp, Triticum aestivum
  Clone ID: PAT_TA_78589
gccgggatcgagaacctgctgcgcctggagaaccgcgccgagccgtggctcgtggtgctgtacgcgccctggtgccccttctgccaggccatggaggcctcctacgtggagctggccgagaagctggcgggctccggcgtcaaggtggccaagttccgcgccgacggcgagcagaagccgttcgcgcaggccgagctgcagctgcagagcttccccaccgtgctcctgttcccgagccgcacccccaggcccatcaagtacccgtcggagaagagggacgtcgactcgctcctcgccttcgtcaacagcctccggtgaggccgccagtgagcgagaaccatcgttctctgtcagtatgtacttgtaccgtgttatggtggcgtccatcttacgtgctgtatgtatagactatacagggagatgggagggaatt

SEQ ID NO: 78590 - DNA, 545 bp, Triticum aestivum
  Clone ID: PAT_TA_78590
cttccagccatccgatgatttccctgaattcaagctcccagatgtgccagcaccactggcagagaatctgaatgggaagcatgagcccaagtcccccaaagccgctccccgttcaccaaaagctgctactcatcccacctttgccacttctgtaaagaagcccattggtgcaaagaaggttggagccaagactggagggcttggtgttcgaaagcttactacaaagccaaatgaaagcctgtatgagcagaaaccagaagagccaaaacctgctgtacctgccttggctgcttcaactacagcaaaaggtggtccatccttacattcacgttttgaatacgtggagaatgtgccatcagctgatttgagaactggcggatctggatctcgtgtgactggccatgtagccccaccaaaatcatcagacttctttcaagagtatgggatgggtaatgggttccaaaaaaaatctagcaatgcctccaaaactcagattgaggaaactgatgaagcaaggaaaaagttctctaatgctaaggcaattt

SEQ ID NO: 78591 - DNA, 246 bp, Triticum aestivum
  Clone ID: PAT_TA_78591
caaatccaccgcgatgggactgaaggttgggtggtggtggcgtgctccactgtggtgcgggctcggcaaccatggcactaggcaagccaagaaggccggagcatgctgatgtgtggggatttggactctagcaataaccctcctcaacctgacagacttggttgcttcaaaagtgcttccacagttgcttgcaagcacttggggctgcctggagatttccctctcccggacaacctccttcctccg

SEQ ID NO: 78592 - DNA, 274 bp, Triticum aestivum
  Clone ID: PAT_TA_78592
aaatcactaagctctcgcagtgtcactagccactagtgtgaggttacaaaccaaagtttttttttcgttgtgtcatggcaaaggcgcaggcggcggcgaggatcatgacagaggtggcgccgccgcagctggtgtcggtgatgcggcggaggaagcaggtggcgaggaacctcgacactatcgccgaggacgacagggagctgatgcaccaggcgccctacgccggcgacggccaccaccacggcgtcaagaagcaggccgcagcgaccagctc

SEQ ID NO: 78593 - DNA, 572 bp, Triticum aestivum
  Clone ID: PAT_TA_78593
ctacctcctgcttccacaaggcgaaaccctagcacccgagtccctccctccccagctcccctactcccacaaaccatggcggcggcggatgtggcgtacgcgccgccgatgaagtcgggcaaggccgggttcgaggcgggcctgatggatccgcagcacaggatccgcatcacgctctcctccaggagcgtcaagaacctcgagaaagtctgcggcgatctggtgaagggtgccaagggcaaggatctgaagatcaagggccccgtgcggatgcctaccaaggtgctccacatcaccaccaggaagtctccctgtggcgaaggtaccaacacctgggatcgctttgagatgaggattcacaagagggtgattgatctcatcagtacaccagacgtggtcaagcagatcacctcgatcaccattgaaccaggtgtggaggttgaggtgactatcagcgacgcataatgtggtagtctgcaccttatcatataatgatgaacaggatgttttcagtttctagtgagagaacttggtgtaacataggaattccctcctgatcgataagctttttg

SEQ ID NO: 78594 - DNA, 426 bp, Triticum aestivum
  Clone ID: PAT_TA_78594
tttctttataccatcttttcatcctattttgagatcaatagctctctgtgtcaaaaaacctgtctgttaggattttttttagggggatcacgatgcactttagctgatacgagaaactgaacagaggatttctgcatcatggatgtttatatggcacttctctcggtgccttaatttctttgctttgtttgttctcatatcttttcttttgctgttgctctaccatctgcgctagactgcaagatgaagaaaatcagtgattatatatatggacagaatgcttcttttgctcttactcagattttatgttatagcattgtatagctgatacaataaagttagaacagacatattttatggcacatgtgtttgggatttttttacgcttacgcctgatgtgttttatatgattggctctgaactcct

SEQ ID NO: 78595 - DNA, 496 bp, Triticum aestivum
  Clone ID: PAT_TA_78595
actcgatctgtacacgctgtgggataattgcttgttgacaaggaagatcaaatcctgatggtggaagaatggcaccccctgtgcttcagctaacaatctgattagtttcctagatgcttgattattgattttatgtgtgatcattttattttgtttttgtatcagggttgcatagagtataaaagctttgtccccctatgcttgcactgagagactcttccgtagctgtcatcgcatacggtgttgcaagtatgttctctattatctccatgtgattgcacgggtagcatatgtattctcactaactgctcttacactaacaatgatgaatcagactagcagagagagtttccaagcaaatttgatggcacatgtccacgaattgtgatttttaatagtttgcattataaatgctcatcttggcctgcctcctttttcccttaaatttatttacatggtgcggcagccaggatcctaaacagataaaaataggact

SEQ ID NO: 78596 - DNA, 457 bp, Triticum aestivum
  Clone ID: PAT_TA_78596
ggtggcagtggaggattcggtgactcagggtttggtcgttcaagtggtggtgggtctggttttggtcgttctggtggatttggtgaatctggttcaggccggtttggtggtggttttggtagttctggctcaggtagtttcggtggctttggtgacaagaactcacgatagactcttagaagtaatcacaggtataaaattatggatgtcctgagccaggttcatcttggtaatgcgtatcgcagtagaggttgagattgtcttggacccaatccaagaaccctcagggcaaaagtctgggtttgcagtatcaaggtcatctggatatggatccttgggaaggcagaaagaaataatcacgagccttattgttttctgtttgcattttgatcctgcaagttctagctctagataatacctgtaaaatatgcacaggggttctgctgatgatgttctt

SEQ ID NO: 78597 - DNA, 387 bp, Triticum aestivum
  Clone ID: PAT_TA_78597
ccgccatcgtgggctgcctctgctccctcgccggcaacaaggacctgggcattcccatcgacatgaagcgcgtcctggcgctccccggcgcgtgcggcgcgtccaacgccgccttcagcaagtgcaacatttccgcgctttccccagcaggagcacctgcaccatcatccaccgctgggggatcgtcgagtggcggggcggccgcatcaccacccaaagccgcggcagccagttctccaatgacggcgaccgctctggtggctgccgtggcggctcccctgctcgcctacttctacctcttctgaggatctctgttgcctgcctcgcatgctatgccgccgtacaggctgtggctgagcgactatgtattatgacgattaatttacc

SEQ ID NO: 78598 - DNA, 427 bp, Triticum aestivum
  Clone ID: PAT_TA_78598
cttggaaatgcacagaggacgatgactgcatcaacttccttgtgaaagaatggagagatagagagacgggctatcagctggtaaatttttgtgggtgtttgcatatgtgcctgtttcaaattacaaggttttttttttgttgagaatggtgtggtagtcaacaaaccaaataaaaatgtacatattgttttgaaacaaaaccttgtgttcaatcacaaggtgcacatggatttgtttgacctacttttgtacatggatcaaacatggaggctcgtacttgagctaatgagtccatgagcagagtggtagatcgtttcagtttctgattgccaatctttctctgctaagtatttattttttgtgttaattgtaaatttatgactcatggcgtcaacttgcttgaattgaagtctgtggtttttgagtc

SEQ ID NO: 78599 - DNA, 632 bp, Triticum aestivum
  Clone ID: PAT_TA_78599
gttgatctgaacttgagcatatctcaaccggcatctcagagccccaaaagagataagagctgcctaggcctgcagctccaccatggatcatttgagggctccgaatcgaaaaaaaacaaagattgatactccctctgagctgtcgggccaccctcatcggttccctcttatgactgagcatccaccggcctggcctgctcaatctcaccccttcttcacaaatcatgagagtacatcatcgagagaccttaacaggaggcctgaggggggtgctcctagctgggcatggaaggtgacagcagctcctcctcacaccctgccattgccgctgttctcttcgtcatcgtcatccgctgcagcatcatcaggattctccaataccgccacgacagctgccccatcggcctccctccggttcgatgcaccgccatcgtcgtcatcgagccatcatcatcgccgctgagaatcaagaagccacactgtaaatctgctgggaagctggcatttttcccccctctgggcgttgcaactttttcggttttgcgccggctggggtggtttcttgtagtggatcgattggattcttcataactgtatttgcacactgtcatactgccccaaaaaaaaaaaaa

SEQ ID NO: 78600 - DNA, 476 bp, Triticum aestivum
  Clone ID: PAT_TA_78600
actacaattttggttttgaccactatgagatgtcacggaggaaagtaggcttttcaggtctaattaatctgcttgtggggcacacaggcccatttgccagcggagattggattctacctgaccttacaatccaaggatccatgaaactaaactctagacttaggacctttcccaatacattctacttcagttatgctacaaagaaaacaagaaaattatttggaattacagtgccttcaagggttcttggagtgcaccccatgctctttctgagagtcctccagatgtgtatgtggcgggaccctcaaagtgcacctctgccttacaaaggatacagggatgaagattgggaagacaatgatggggctttcaacacaatctctatgacacacccccgcattcccattgagcatccacaccgtgctggaaaagaacgattctgactgccatcctttgcaacctgggatatgctatta

SEQ ID NO: 78601 - DNA, 592 bp, Triticum aestivum
  Clone ID: PAT_TA_78601
gattgggttgggcagccatggaagagctaaaatggggggatgataaccataagtggattcgacctggacacctcttcacctgtggtcctggttcttacaaaataccctctgtaaatgatatacctctaaatttcaaggtttctctattaaagggggttccaaatccaaaggctattcattcttccaaagccgtgggagagccaccatttttcctcggctccgctgtcttatttgcgataaaggatgcgatctttgcggcaagggctgaggaggggcacttggagtggttcccactcgacaacccggcgacaccagaaagaataagaatggcgtgtgtggattccattacaaagaaatttgccggcatagattaccgacccaagcttagtgtatagcggctgctgggctgattatacggaagaataaattgtgaatagaagcccacgcttgtaaagtttcatgctcttgtgctagaaataatggagggacggtttagggttactgaacatcgatcagtgcctgaaaatatagggggaaaacaatatactactcctgtatgtatattgtaactgttcggatttcccacagatgg

SEQ ID NO: 78602 - DNA, 319 bp, Triticum aestivum
  Clone ID: PAT_TA_78602
tgggcagggaggaggaaaatgaacagtgtctggacgttgctcgtctggatgcccgtgccgccgtgctcgttaaccatgtcagctatgtcctctcgtctctgtccggtgtttttcgcctgtgcccacgcccctgtacaccctggaccctccccctctcctctctatcttggctctagcttgcagagccattttccttctcccaaatctagctcatatggacacggcggtgccctttgcgatgcatggtggatggcgaaatgccaaataacattgagaccttccggcaaggaaaatggctcttttcttaactacaattttt

SEQ ID NO: 78603 - DNA, 613 bp, Triticum aestivum
  Clone ID: PAT_TA_78603
gcgccggcttccaccgtcgccacgctcaaggagaccatcatcgcccagtggcccaaagataaggaaaaaggtcctaggactgtgaacgatcttaagcttattaatgctgggaagatactagagaacaacaaaaccctatcagaatgcaaaagcccgatttgcgacttctctgggatgacaacgatgcatgttgtcgtccgtgcaccaacttcaagcaaacagtctgataaaagagcagcaaagaaagcgaaagatttcaggtgcggttgtgccattatgtgacagcattgtgaatagtagcaaagagaatgtggctatgtcagtttcctccacccttttctgctcttgctagagtgttgtattatgttcaaggcgctttctccttttattttgttttgaagtatcacgagaaaacttcagcagctgttaagtgccctttaatcatgagtttgcatcaagcacaaaatttgatggcagctggctgctatttgcccttaatcttgagttatgccaagcacacactttgaaggcagtcattagtgtctagactacgatgtctgtcttatccaattgcccatggtttcacgttctcttctatatttattatgctact

SEQ ID NO: 78604 - DNA, 358 bp, Triticum aestivum
  Clone ID: PAT_TA_78604
aggtcggagaaggggaagaagatggtgcgggtggcgacctacttcgcgatgaccttcggggcgttcctcttctggcagtccatggacagggtccacgtctggatcgcccttcaccaggacgaaaagaaagagaggatggaaagggagctggagataaagagaatgcaggcagagttaatggcccaagctaaagagaatgaatcatgattatcatttggccaattgtttcaggcaattcctttgtcatatttcctctgctgtatttccaagtgatatcttgactgatgtatgctcgacacttctaataaagcgagagatgctataactttgttgaaaaaaaaaaaaaaaaaaaaaaaaa

SEQ ID NO: 78605 - DNA, 467 bp, Triticum aestivum
  Clone ID: PAT_TA_78605
tcatggtggcatatcgatgctggcgaaaccgactgcctacatcggcaaaacaatcaaggtggatggttttgatggcaagctagatggctgcaacatcaaggaagccattctcaggtccaccgggttgtgcataaacagcagctcatggacaggaataccggatcactgtcggttcagctttgctctggagagcagcgaattcgagcgtgcaatgggctgcatagttcgcttcaaggagttggttcttggaagcaaggcttttcatcagatcaatggtaactaaatgaaatttcccatcgtcgtggaaactgaatcctgaagaaatgtagccactacatacatattattatccattgttagcctgtcctgttcggggctgattgaacatttttgtgcttacaaaaagaataatgagcacaggaaggctggtatgaatgtaatagcaaactggaattaaggctgaacga

SEQ ID NO: 78606 - DNA, 481 bp, Triticum aestivum
  Clone ID: PAT_TA_78606
tgaggacgaagcttgtcaaaagttggcttcctgtcctaaacgtctgcaggaacatggttcagcctatgcagtggggatacaagtcaccaaattgccaagagctagaggagacatttcttcagatcatctccaccttgcctgtcccagatgctcaggagttgctgcaacagtgcctcgggttctcgactcgcaacgtcgacgactgcccgcacttgatcgcagccttcaagacatggttcaggcgtgctggccgggctcctcaaggtgcagaaaattgagatgagcgctgcagctagtgtctgccaacagtgggtgctgtcttgtgcgaaatctcacatctagttcaatgtaattcctaacgctgtttctgtacattgttgtactacctaccctatctattgccatgtaaggtatatgatatgtacgtaacaacatttttctgttcgagtgaaacatgttacccaagtgcagatgaatgatg

SEQ ID NO: 78607 - DNA, 655 bp, Triticum aestivum
  Clone ID: PAT_TA_78607
cctctgctgggaaaacaagatgccacttgccaggacagccatgtacgccaaagggattcagatatattgtgctcccacagctgatgcgtccccaacttgggtggcttccatgacgcatatcgccctcgaagggggatgctttgtggtgtcggcgaaccagttctgtcgcaggaaggactacccaccccctccagagtatacattcggtggcctcgacgaagagccatccccggagactgttgtgtgtcctggaggaagtgtcatcgtttcaccgtccgggacagtgttggcaggccccaacttcgagggcgagggcctcgttacagctgacctcgaccttggagagattgttcgagccaagtttgatttcgacgtggtggggcactactcgcgacgtgaggtgctgagtttggtggtgaagactgatccaaagtctgctgtctctttcactgcttcagccgatggagagagggctcccgctgggaagaagggcgacgactctgtgtacaaataatggccacgtatctgtaatctttccttatacgccaattgcaagtttgccactactacatcgcaactattgcgggcttttcctgtacgtctctgaataataaactgtttatgtacagtacagtggatgtatattatatcccta

SEQ ID NO: 78608 - DNA, 327 bp, Triticum aestivum
  Clone ID: PAT_TA_78608
ctaaaccaaagaaaaaggctgcatccactggtcaagctgagacacatgctcctgtgggtggtccaatttcatatcaacaacacctctcctcgacgagcatgtcagggccatcaccatctggtggaaccaattctgcagggtatggtgttgaccaatcagcaacacatccatctcaactccagagttcatccaccaatgtccagtctgccattgtccagccaccatatgatgacacattttcgttcttaccacctaacatgctgacagggtctgcaaatgatgccatggatctggaactgggtcagttgcatcaagtaatttctcaag

SEQ ID NO: 78609 - DNA, 402 bp, Triticum aestivum
  Clone ID: PAT_TA_78609
ccatcaatgaggcaggctaacccacatacccctcaaaattcaagtttgcaagtcaaacagcaggccatgcttcacaagcaatcaaagcccttgagttctgattctggacctgggagaccattaagggcagctcctcagcagaagccctttgttgagatgaaatctagactggctcgagagcaggttgctgttgaaagaaaacctgcagcgagccatgtggataaatcgaggcttcctgcacaaccttcagcaggagtcaagctagagtcggcaaagccaaagatctatgatggcttggaaagcaatactaggctggaagcaccaaagaggaggctccaggagcgctaccaggaagctgaaaatgccaaaaggcagcgcaccatacaaggaatggagctgggc

SEQ ID NO: 78610 - DNA, 458 bp, Triticum aestivum
  Clone ID: PAT_TA_78610
accatcatatgcacatgcacaggagcaaccttcatatggacacgcacagctaccatcctcgtatggattagcgcaagcatcatttccatttgccccagcgcaaggggtgtcaccctatgggtcaggtgcacagcctccgcagtatggagctgggcaagcagcaactaatcctggcagtgcttaccaagcacctcatggacgtaaataaatcagcaaaagtagtctactgatggattgttattggcaaaagagacaatgcgctgctttgtacaccagagctcagtttcctttccacagcgaccaaatcttgtcgattaactgatatgaggtgattcctgaatatagtctggacaagtaatgctctgcaagatgggaatgcttctgtaaagcgtaaacttgtcgtcggaggtataactgcctttttttataccttcaagcctccaggttaggcaacccat

SEQ ID NO: 78611 - DNA, 598 bp, Triticum aestivum
  Clone ID: PAT_TA_78611
ccaaagcacccatcagcaaccgctgctcctgggtttgatggaacagtgcccgcgcaatacaaagaagggaatcaatttgtatctcttcagcagagcgagaacgctgcgatgtggatgcatggtgccagttcgcgaacaatgccacctcttgcagcaaatgccttgtatggctatcaagggcagcagggtcaccagggcggccttcggcaggggcagctgccttcacagtttggtgctccacttgcaccgacacagcccggcctgggccatgagcaccggaaccctagtgacggcaacttaagctctgctgccgctgccgctgccgctcaggctaaccaaatgtggccaaatagttactgacccagcctttgaaactcttttgagtgtgtggtcctgttgtggtgcgtgctacgtcagagatgccatgcaatgcttttggcctgattcaggcgcctgaatagcaactgtgtatatgagttgctatgtagacattttggagaggcagaggagatgtatgtttgatcatcatgttctactacccttagcattttctaggatggcctaaaactgtagctctatttatttatattctgataga

SEQ ID NO: 78612 - DNA, 263 bp, Triticum aestivum
  Clone ID: PAT_TA_78612
ttctgcttccgctacataaatgacttcatcttcaagatgaaagcctacagccacgtcgatcggatcagattcaagtacttcctaaacccgaagaggattcagcacgtgatttgcgaaggggctgatcttttcgacatgctccctgaagaatacacattccaagagatcattgccaagctggggcctattccaagaacattctctgctgttcatctccctgcctatctgctggagcacaatgatcggtacacatatctccttcc

SEQ ID NO: 78613 - DNA, 630 bp, Triticum aestivum
  Clone ID: PAT_TA_78613
ggatgctgtcctaaaaggggaaaaacaacctaaaagcaagagaaggaccacaaggaccaaagaccacaaggcttattccatcagattaacctgtaccttcactgttgcagtgaatttcccttgtctataattttggttggagttggagatggtccatgggatatgatgaaggaatttgacgacaacatacctgctaggtcttttgacaatttccagtttgtcaacttcacttcaataatgtcaaagaaaaccagtcagagcaagaaggaaacagaatttgccctttcggcactcatggaaattcctttgcagtacaaggcaacattagagcttggaattttagggcgtcggttcgcgaagtcacctgagcgagttccactgccccctccctttgcaagctataatacaatctcgagagcagcaccatctcgagcaaatagcttccggagtatgccttctcatcctagggatgaggcacctgtagattcagcaatcacagcatcagttacatccccaccaagcgtggatgctagagcagcagaacctcaactctgcccagtttgcctctccaaaccccgggacatggcttttggttgcggacaccagacatgtgctgaatgtggaccgcaa

SEQ ID NO: 78614 - DNA, 213 bp, Triticum aestivum
  Clone ID: PAT_TA_78614
gcggaaggggtaaaggatgcatgtagatgaaagaaagttcgtcttcggtgttattattatgctgttcttgaacgtgtttgatttttaatctccttttttttatataattttcctacgggaatgggaggaaaagaggtggacgaagaatagtgtaataataatggtggtggtggtggttgagggcccaaaacgatgaacaaatgggttgggttg

SEQ ID NO: 78615 - DNA, 622 bp, Triticum aestivum
  Clone ID: PAT_TA_78615
atggcggctgatcaccttgtcgtggccatgcttctcctgctggctttgtcgccgccggccgttgctgacgacacggcggtgctcggccggaaaggcggcgtcgtggaagggcaggcggcggggccggggaggtacgccgtgatattggacgccggcagcaccggcacacgggtgcacgtcttcaggttcgacaacaagctggacctcctcaaggtcggcgacaacatcgagctcttcgctaaggtggatcctgggctgagctcctacgctggacgtcctcaggatgccgcaaactccatattgcctctgcttgacaaggccaacaccgttgttcctgccagacttatgaacaaaactccccttaaacttggggcaactgccggactcagacttattggagatgaaaaggcgaaccagattcttgaagcggttagggatgtagtccacaccaagagcaaatatcagtataacccgaactggatcaacgttcttgagggatcccaggaagggtcatacacatgggttgctctgaattatctcctggataaattgggaggagactactctaaaaccgtaggggtggttgatcttggaggtggatccgtacaaatggcatacgcca

SEQ ID NO: 78616 - DNA, 472 bp, Triticum aestivum
  Clone ID: PAT_TA_78616
ttttttttttttttttttttttgtttgcttctgaccttttgtctgcatttttgtttctgaactcttgcagtgaagtcctaaggggctctacaaactctgaaaactccatctcatcaagcgcattgaggacatcatcagcgctgatggtctgcctctttgattccttgcacatatcattggccgtggccgagagatagtggatgaagatgcgagcgctctcggcgaacgccgccatggcgtccttgttgacgatgacctcggctccttccccgccggcgacgtgggagagcttgtccttgacaaggcggcgcacgatggccttgggcagctcgcccacctccgcctcagtcaacgcggacgcaggtgccgccggcgccagaacgggctcctcttgcgcggcgaccgccggctgcggctccccctccttggacttggtggccttccgggggatcctccctcctctcctgagcgc

SEQ ID NO: 78617 - DNA, 274 bp, Triticum aestivum
  Clone ID: PAT_TA_78617
acatctgatccccaagttccagaatactgcgagatgctgaagtcggaagactggccagtctgtgcttgcattaactatgactgtaatccgatgaatgcatctgaagaagcgcacaatcttgaaacctcacagctggtctgggagaagacgctcgagatgattggccttccgccagatgccctgaagaaactcatcgccggataaacagatcaatgccgttatggacaacaggaggcataataggatatcccacagatccagaccataccacttt

SEQ ID NO: 78618 - DNA, 544 bp, Triticum aestivum
  Clone ID: PAT_TA_78618
gcggggacgattttgagaagaaggccgatcagaagctctccggatggggcctcttcggcaacaagtacgaggaagccgccgacctcctcgacagggccggcaacttcttcaaactcgcgaagaactggagcagagcagcttcggtatacaaaaagattgcagattgtcatttgcagggagatagcaagcatgaggctgcctctgcttatgttgaggcagcaaactgctacaaaaagttctcaccacaagatgctgcacaagcacttaacaatgccgttaatcttttcctggaaatcggtagactgaacatggctgcaagatacagcaaggatatcggtgatatctatcagcaagaacaagatttagagaatgctgcagtctacctgaatcgagctgctgatctttttgatagtgagggacagtcctctcaggcaaacagcatgacacagaaaattgcagaaatatatgctcagctggaaaagtaccagaaagcaaccgagctctttgaagaaattgctcgtaaatcaataaacaataaccttct

SEQ ID NO: 78619 - DNA, 565 bp, Triticum aestivum
  Clone ID: PAT_TA_78619
aattgctactcttgaccacaggaattggagcagcatgtagtttatactgtctcctggttttctctctcgagactgctgtcagttatgcttttggggttggtttcagttgcttgtatcttcaacttctgtgtcgacatgctgataacctatcaaaggaagatattccagaagtttttcttaggaagaaagtgaagaaaattggcattacaagtgaagatttgaagaatacaatagagaagacattgggtggtgcaggagtagctctttcatccccaaggcttgtgattcctgccgtgatttttggattgtcagctttatcagatcacttccaaaatagcttcagttttgaggttcttccagggatgatgggtttccttgcatacaaggctgcagctttggttcaagtctacagagataacgaggacctccgcttgatactccctgaggaagagggcgctgacagtgacagcacttgatgtatacaaattagagattatgttaacccagttgtcgataaatacagaacagaccactttacagagtcacacttctgaattttgaataa

SEQ ID NO: 78620 - DNA, 610 bp, Triticum aestivum
  Clone ID: PAT_TA_78620
gtaaacatgctacatcatgatgttgcaatgtttgttacctggctatccgccccctcttgtctctcgttttaacatatacatattgttctcatttgccctctgtagacttcattatctgcttgtaaaatttgctcctggtgtcctttgtcaggttttccaccacattctttgccttgtttgtgctgtgtatgctatgctttctggggaaggacagttatacgcatacatgtttctcatctctgagactaccaccccaggaatcaacctacgatggttccttgatgttgctggaaagaaaaattccaaagcttacattgtcaacggagttgcaatgttcattacttggctgatggtcaggatagttctgttcatctacttggtttatcacatccttacaaattatgatcaggttaagcagatggacacttttgcttgtgttttgatatctgttgcccccaccatactattcactatgaatgtaatatggttttccaagatcgtaaaaggtctcaagaagacacttgccaaaaggcatgctgaataggggaatgtgcatacatgtacatccacgaccatctattccatctgtacattcacttacagctatgta

SEQ ID NO: 78621 - DNA, 414 bp, Triticum aestivum
  Clone ID: PAT_TA_78621
cgatgaacagatctcggataagaccgagaacttgaacactgtgctgctcagagtaaggagaccctgcagacctaatatgtaagcaacaagaactcactggccacatcgaacagctgagaaaaatccttcaggatggcgtgggtgcagatatgaaatgaaagccaacatacaaaactcgaagtaaattagtgcttgccgaaggtgaagaaagccaaaagggacaagaaacgaacccatcgttgtaatgtaataaagaagaaatatgcactagttttctgtgatgagtctttaacccctatgagctgttaaaaaactcagttgtgaatgtcatagtattattctcgcaacgcctgtctgcggctgtctggacgtcctctcagaagtcctgtaccatggtaaataaatgttactcat

SEQ ID NO: 78622 - DNA, 633 bp, Triticum aestivum
  Clone ID: PAT_TA_78622
cttggatcgaggagaacctatttccatgtcaatggatgcaaatctgcaaagctgtatggcaatgccagctctgtagatgaaagacaccgccacagatacgaggtgaaccctgatatggtcccggactttgagagggccgggcttcaatttgtgggcaaagatgaaagtggaaaacgcatggggataattgagcttccctctcacaagttcttcatcggtgcacaattccatcctgaattcaagtcgagaccaggaaagccatctccgcttttcttagggctgatagccgcggcatctggacagctagaacctttgcttcaacgcagcaatctgacaacaaaagcatgtcctatcagtaaaatcccgaaactgaaattatacccaactggacctgtgaatccattgaacagcttgtttgtactctgatcaactgagaaggctaagattcagcaagccctagctccagcgacacatggttccgacattttaacgaggaacgtcctccagtccgttgcagcaaactagctatagggtggtgaggtctagtgtgatgttgcttttttgttttgaggcctggaattaaaggggggaagtgttttggtagcgttagtacagcctggaatctcaactatt

SEQ ID NO: 78623 - DNA, 485 bp, Triticum aestivum
  Clone ID: PAT_TA_78623
tgagtcgtacaatgaggagcaggagatgctccagcagcagatatcatctgcacggagtaaccttggcgctgtgcagattgaccatgacctccgtgtcaagatatccaaggtgtgctctgagctgaatgttgatggactcagaggcgacattgtgactaacagggctgccaaggctctggctgcgttgaaaggaagggacagcgtcactgtggaggatattgctactgtcattccaaactgcttgaggcatcggctccggaaggatccgcttgaatccattgactcgggtttgcttgtcattgagaagttttatgaagtctttagctagattgttcttgaggtaaacgttccttagtcacaaattttggcaggaaccctcttgttctgctgttctagtaatatctggagcttgaatttggtatcaattttgtgcacctagcatcatgataatgtagaatccattccctaaaaaaaaaaaaaaaaaa

SEQ ID NO: 78624 - DNA, 733 bp, Triticum aestivum
  Clone ID: PAT_TA_78624
gggccagttcagaaatccgtctttgattccatcccaggcacaccagttcagaaatccgtctttgattactcagtccctagcacgccaatgcagaactcaagctttgattattctgtcccaagcacgccgatgcaaaagtcactctttgattccattcctggtacaccggttcagagatcagtatttgattctgttccgagtacgccaatgcagagatcggtttttgattctgttccgagcacaccgacacagaaaccattctttgactcttttccaagcactccaatgcagagatcactgtttgattctgggccaagtagagcagaatctcctactgccagcagcatgtatggcaaagagcagaagggattctttgattcttcggtcccgagtaccccaatgtacaactcaagctacacgccaaggtacagcgaagcaggagacgattcatttgacaccatgtctcaatacagttcatttggcatgcacgagaacaattccttcggacagcgtgacagcttctcgagatttgattccttcacgagcaatgctgacaacggtggcaatgacacctttgcaaggtttgattctttccgcagcacttcagatcagggtgggggcaacagcttcatgaggtatgattccatgaacagcagcagcgaccatgatagaggcgacccatttgcgaggtttgattcaatgaagagcagtgactacaacagccggggctact

SEQ ID NO: 78625 - DNA, 635 bp, Triticum aestivum
  Clone ID: PAT_TA_78625
tagcagtccagaagtgcggcagcagtttgcgcaagttggcatgactcccgaggaagtggtatcgaaaataatggcaaacccagatgtagctgttgcattccaaaatccaaaaatacagacagccatcatggactgctcgcagaaccctctaaacattgtaaaataccaaaacgacaaggaggtcatggacgttttcatgaagatatcacaaatcttcccacaaattaacggctagccgaacttcatcgcgggattgcggttctgatttttgacggcccatcatccatctcctgtctggaggactgctgcggtttccacgtgtcaagaaagggaacacctgttgggtcatgacgctccagatagatccctcactgtgtcaaggtcctttgagttgcctatgtacgtcgtatgatgtagcggccttggtttagctatgagtatgaccctacttcataaagtcagtctagcgagcatagcagggtcaaaggcttttatttacatttgtatcggcaggcagtcagtgcgctgctttgacgttgcatggttttatctcgtaggatgtggaagccgcagcagaggtggttcctatcagatccattttgctatatataattgctatcaatgtgtaacatatt

SEQ ID NO: 78626 - DNA, 567 bp, Triticum aestivum
  Clone ID: PAT_TA_78626
tcgacccagcgtcctcgccgccgtccgacgtcgggaggccacgccgccgccattgttgtccaacgttgttgctgtcccctccgtcgagatcttctcgtgccaccctacgtcgagtcccatgtgccgagatctccgtctgccaggtcacgggagccaggagcgcgggcttgtactccgcgcgacgcagccaaggagtgtgccagctcctccggccaggcgccaggccacgggagctgggagcgcgggctcctactctgcgcgacgctgcgaaggagctctggcggattgcacggcgtctgcctcctcctgtccggcttggatttggaattaggtgtgaccgagtcgaagctggtttagggaagaggccagacaaaaatatgtctatagatatagatatagatatagatatagatatagatatagatatagatatagatatagatatagatatagatatagatatagatatagatatagatatatagagaaataataagttactacatacacaaatcgtcatgaaacaaaaacacaaactaagaaattagagaatattatgtttgtttt

SEQ ID NO: 78627 - DNA, 398 bp, Triticum aestivum
  Clone ID: PAT_TA_78627
tgtggaaagctgaatctgacgcaactaagaaatagacgaagtgatacccaggaaattgtgtaccttatgaggccacattgagataaaccaccacttcgggtgataccgcttgcttggtactgtatgtttttttttactggtaccacattagctgtcaaattctctcgtaattcgtaaaccagagctccttctgaatgagcgcagttgtacacaatacatatgaagaggccctccctgagatgctccaaacacagcaatgggatgtcaaaatagctattctgaatgctttggttgtcccggggttgagtgcctttcttttatgaaaatagcgaatggtttatgatggtatgaagctaaactctagtatttttgagcaaaaaaaaaaaaaaaaaaaaaaa

SEQ ID NO: 78628 - DNA, 586 bp, Triticum aestivum
  Clone ID: PAT_TA_78628
gacgaggcagaccctaggtggcggcggtggtatcccgttcgcggtggcggcggcacatccatagctgccgacggcagcatcccgttcgcggcggcggcggcacatccgtagctaccgacggcggcatcccgttcgcggcggcggcggcgcatccgtagctgccgacggcggcaacccgttcgcggcggcggcggcgcatccttggttctctgggaagagctatcggtttgcctttctccccttcgcggcggcgcctcatccattcctctcgacaccgcctttttccccttgtccaaatcgtcgcgggacttcgatgcatgcgtgcgtgttcggccatggatgagtgaagcttacaatttcgggaaagtacaagaagatgtttgagatggatatgaagtacaagcacacaatttgttctggacgtttgataaatttgtcatgctcttgtccgttcctgtagtattggaggcattttataatggagtcattggactgtaatcaatcttgatgtgttttcctgtaatattacgttttcaagctgtgttttggtattggttacttctggaattgaagagatgagtttaat

SEQ ID NO: 78629 - DNA, 673 bp, Triticum aestivum
  Clone ID: PAT_TA_78629
ccgaggcagaggaggttgtggtggaggatgaggaggatgacgatgaggacgacgatgatgatgacaaggatgatgatgaactcgatggacaagaagaggatgccagtggcaagtcaaagcaaagcaggagtgagaagaagagccgcaaggccatgctgaagcttggcatgaagtccatcactggtgtcagccgtgtcactgtgaagaaaagcaagaatatactgtttgtcatctccaagccagatgtgttcaagagcccgaattcggacacctacgtcatattcggtgaggccaagatcgaggacctcagctcccagctgcagagccaggctgcagagcagttcaaggctccagacttgagccagatgatctcgagcccagagacatctggcccgggccaggaagacaatgaggaggaggtcgacgaaactggtgttgaggccaaggacattgagctggtgatgacccaagcaactgtttcgaggtccaaggctgtcaaggccctcaaggcttctaatggggacattgtcactgccattatggatctgacaaattagagtgctatatctctgctgaaccaattttcctttctgagtgctatgcaatgcgactggagtgttgtctgtggaccatgtgcttcgatgatgatgttatcatgattgcttccgtcaag

SEQ ID NO: 78630 - DNA, 719 bp, Triticum aestivum
  Clone ID: PAT_TA_78630
tctggaattacagacagtccaccattttccagtatgaggagtaatggtgatcaagcaactgttcctttggaagaagatgagttgggaacatctgaggctggtacctgtggtgttgtcggttacgtatggacaagcgttgatactgggatcgtggaagaatggagacaatcaattgccccgattcctaaagaaaaacttgaagagctgcggcatgctgcgtctgatgatgatgggtcagaagatgaatccaataatcggactctaccagataaagatgattcgtcagacagtgtggttgatgatgatgatcatatttctaagtttgagaaagaggtggaagagacatttcagcgagccctgggtggcggcgttaatcgagataatttgatactagagattaatggcctaaggttagcctacagccttcaacatgcagattgtgctggagctgtgttctattctgtcatgaagagtgcattagtggctgcacaatctactaatgatactcttctaaagacaactgctgatgcacttggcaagtggaaggatcttttgcgcaattacaccaagacagttgatgaggagatggagatacttttaaagtttgaggaaatgtgtcaagagaccacaaaagagttttctccgctgtttccaacgatcttgccatacctctatgacagagaggttgtaagtgaagatgcaattttgagatgggcgga

SEQ ID NO: 78631 - DNA, 375 bp, Triticum aestivum
  Clone ID: PAT_TA_78631
tatttgctgcaacctccatttcaagccggtttgctcagcggctcatatagcctgttttctcatctttttctctgttttagattgtgtagcagttgggctagttgcttcctgctgtaaatccgaattttgatgtagtgaaggaagtgctagctgtttgttgagcacgagcgaaaagaactgctcttgctcagcatttacaagagaaattgttttgcagatgcacgtccagtcttctctgtaattaccatttcttgcgcaatcagtgtcttccgtgtgacatttgttcatcagtgttttgaagcggcaccttccatcgaagggacgcctcaattagtgttagtaattagcagttagtccaaaaaaaaaaaaaaaaaa

SEQ ID NO: 78632 - DNA, 659 bp, Triticum aestivum
  Clone ID: PAT_TA_78632
gcacgagggagagagataggagatcttccaagaaggaccattccagttccaggagtcacaggcaccaccaccaccgatcatctggtgatgactcagggtctgagtctgaggagaggggcaggtcaagacataagaaacatcatagatcaagcgatgaggatgcaacatcagattccaacaaccataagcaccgtaggagtcgctccctggaggagtcatccgatgatgcagctgccggtgaatatgaaaaggtgagaaatggtaaaaggcctcacaagaccggacaccatcgtcaccaccaccgccaccaccatcaccatcatgatcaccgtagctcttctgaacctaatgacaagaagcggcaagatggccagaaagcccttgaaggtggcaacgttgattaaactccagcggcactagttgaattggtttttggcgcgtgaaaagaattttagttgtcttatcttttatgttggtcactctttattccaacgttgtggattctgacgttgtactgatacaaagtcggttcggtgattgtgacttttatgtctcgtcgtttcttcgtttcatctgtgttggctaatttgaacttcagtcggtggttcgaattgttctattgactgctcaaaaaatgagaactaaagatgctttctgct

SEQ ID NO: 78633 - DNA, 694 bp, Triticum aestivum
  Clone ID: PAT_TA_78633
ggcggaaacttggcatctcttgtgtacccctcattttcaaagtagagccaaggccggccccaggaagggtttccgtgctcaatgatggctccatagtgttggaggttggtggaattgaaatcgggcaaggtctatggacaaaagtacagcagatgactgcctttgctctaggaaaattatggcctgatggaggtgaaagtcttcttgagagagtgcgtgttctacaggccgacaccttgaacttaatacaaggtggacttactgctggcagcacttcttctgaatctagttgtgcagccacccttcaggcatgcaatatgctgtttgatagattaaagccagtcttggataggctgcagcagcaatcagaaaatgtctcatgggatactttgatttctcaggcctctaaagataatgttaatttatctgcaagtgcgtactgggtacctggccaagtttctaataagtaccttaactatggagctggtataagtgaggtggagattgatcttcttacaggagcaattactttaataaggggcgatcttgtgtatgactgtgggaagagcttgaaccctgcagtagacttaggacagattgaaggttcctttatacagggaattggttttttcgtatatgaagagtatattacgaacagtgatggcctgatgattagcaacagcacatgggacta

SEQ ID NO: 78634 - DNA, 633 bp, Triticum aestivum
  Clone ID: PAT_TA_78634
caaaacaagaaattggcagcaatgctatgtccagatacacaggtatctttgtctactgcacaaccgaattaataacaaattgttgatatattttttttccgagaaaaaggctcttgatatactttctttgacatcattgtttatgtgttttcataggaaaaaaaactgttgatatagaacaaattgttaatagtttctgaaagcattgtgctttgataataaacaagatatcctatttattttagtcacacatctaatttcattgatgttaacttaacattacaccgactcttttcaccaggtacactagatgcgataataaagatggtccgctacgaaggactgcatggattttacaaaggaatgggtacaaagattatacagagtgtctttgctgcctcggttctattcatggttaaagaggaattggttaagttagcagtgcttttagttgcaaggagtaggactatgcttattactacatccaagaaacaataggtgtatgtccatgaccaatatttttttggggagaaaagccccccatttttttttgcctcaacttgtaatatataggatctcattatacatatcctgttcatgatcaatatgaaattctttactagttactagaga

SEQ ID NO: 78635 - DNA, 636 bp, Triticum aestivum
  Clone ID: PAT_TA_78635
gcatgcaggcactaaacattgggatgactgggatattgttggttttcctggggcagagctattaagcaccagtgaaaaaaatctatgctgtcagaacagattgctacccaaccattacctgaaaatgcaggaggttttgatgcaggaaatattcaagggtagtgtcgccaagaaggaagatgcccatgtattatttaaggttgaccctgccaaagtagataacgtttatgatatggtgacgaaaaagttgggtaccaatgaggaggccccgactgtttagccatgtttttgagttcctcaatcagcgcgtggtttctgatttgcagcatgactactgagacagctaaaatggaggctatacttgaattaaattggctgtagttgaaatttgtgtgaggtgtctgaagaagcacaataaggcattccagccaaattgtaaaattatcgccccgattggaatgtgtagcatgagtttaccataccattactctccattttaagaggatggtttgccctcgttcgaagtgtaacgtgtaacgtgttgcagagccactaaaagggccttgacagtatagtgcctgaaatgatgtatgtaaacattgccacctttttcataaaaaaaaaaaaaaaaaaaaa

SEQ ID NO: 78636 - DNA, 509 bp, Triticum aestivum
  Clone ID: PAT_TA_78636
tgagaagattgaactgcttgtcgacaagactgaaaacctgagatctcaggcacaagatttcagacagcagggtacaaaggtgcggcgaaagatgtggttacaaaacatgaagatcaagctgatcgtcctgggcatcatcatcgcgctcatcctcatcatcatcctgtccgtgtgccatggcttcaagtgcaagtgagggtgttggcttcctagtcctccacattcaccttgccccccataataccgcctattcctggtgaaaaaaaaagaccatatgtttttttttgttctgttagtcatgagtcctgccccgattcttgggtgttcgagtgtccctgatgtcgcgcttgattggtgtcggatagtgactgggtttatgggtcggagtcccgtgtatttttggacgctattcatgtatagcctgtatgctaccctcttttcgctctgctatatgagtagtaggtgttactacgtttgttcccccactttataaaaaaaaaaaaaaaaaa

SEQ ID NO: 78637 - DNA, 665 bp, Triticum aestivum
  Clone ID: PAT_TA_78637
gcacgaggctgaattgcaggccaattccagttgagtttctccacagaccacagatatggcttccggcaggatagctctgctctgccttcttggcttgctgctggtagcagcctcaccggctgccattgctgccaaagatgacaaaatcttctaccagattactttcatgtggccgggagcgtactgcgcgcagacgaaggccggatgctgcatgccgaagaccgacgtcgcgccggcgtccgacttctacgtcgccggcttcacggtctacaacgccaccaccaactcttccctgtccagctgcagcaacactccattcgacatgaaccaaattggggatgccacgaggctgatgcagtactggaacaacatcaggtgccccagcaagagcggccagaagggctggaagaacgcgtgggagacgtccggcgtctgctccgacctcaccgagagcgcctacttcgacaccgccctcgccctccgcgacaagatcaaccccctgtctcgcctcgtcagcaacggtattaagccggactttgggctgtacagcgtgaagaagatcaaggaggtgatcgaggaggggatcggcgcgccggcgctgatccagtgcagcaagggcccgttcaacaagttccagctataccagatatacgtctgcgtcgcgg

SEQ ID NO: 78638 - DNA, 732 bp, Triticum aestivum
  Clone ID: PAT_TA_78638
gcacgagggcctgcattacagcaaagcactccactaatctacccaccagcaacacaaacaacacaccaagcagcacttactagtaataataactatgacaacaacgtgatgaacaacagcaacttgccgattgctgcagtagacgcagtgatagcaggctcggataacagcggtgtgaagaagaggaataagagagtgatggccgtggacggcgccgccgctgaatcgtgcttcgatgatggcagcagcgacagtttcagtagcaagaaactgaagctgccaagtgattcgaggatcgccggccatttcggcaccacagcaagcagctactactactgcaacaaccagctgcagcttgtggacagcgcgatgagtagtggctttcatcagtacagcagcctgttgctgagcagcagcaatccgttcttgaaccagcagcagcagctgctactcaacagccacatcgggatgcagtagaaatgctgaagaagggacggatctgaagaacctctcgcctgtagaaaatcttcgacagacagactgaaggattattattggacggattggattggatcagagcaaattgattggagttttcccttccctctttgcattgctttatttcattttcatgtaaaattaattaagattgtaaattaggtctggctggggtgtactggaaattcatgtggccatccatcagtgagtgaatgaacgatgacccacgccgcc

SEQ ID NO: 78639 - DNA, 603 bp, Triticum aestivum
  Clone ID: PAT_TA_78639
agtggaagtgatctcaagaacctgtgcacgacggcagcatatcgccctgtgagggagctaatccagagggaaagaaagaaggagctggagaagatgaagcgtgaaaaaggaaaaactccatcggatcttccagagaagaaagaaaaggaggagaccatcattctaaggccgctgaacatgacagatctgaaggaagcgaagaaccaggtggctgcaagtttcgctgcggaaggcgccataatgagcgagctgaggcaatggaacgagttgtatggtgaaggaggctccagaaagaagcagcaattgacatacttcctctgagcaacatgaacatcacacgcaaaaaatgtatggacataatttgcaaaagtagagtagagcacaaaatagccatgaggaaaataggccgaacatgtataagaacataagaaacggggagtgttaggggacaagagttcaggccgtaaaatccagtttctggtgtaggacaaggaagaacaatttttatctccacctaaattccagtttgcctgtgctggttgttgtattacactctaataatgaatctgcagtgcagattgctctaaaaaaaaaaaaaaaaaa

SEQ ID NO: 78640 - DNA, 425 bp, Triticum aestivum
  Clone ID: PAT_TA_78640
tgcaacgagtgggcagtgtaaataggcatgtgataagaaatggagataaattgcactggttgattccatggtagcagcatcttgggggtgtacgtataagatggcagctagtcggcctcgtagttttcttctaggagaagcagtgaggggaaaaaaaatatacagaagccaacctcgtgtagtagaaccctaccctacctggctggtgatctgctatgcggcagcgaaagggcaagcaagcacaaccatgccaaactcctgtactagctgcgttcctcatcagcataacctgaatgaagcagcgacatcgctaggttgcgatgtagcagcaattttttttcctggcgatatgatctgactgtaaatttgtaaatgtttatcgactacgagatgttcgtattttccataaaaaaaaaaaaaaaaaa

SEQ ID NO: 78641 - DNA, 726 bp, Triticum aestivum
  Clone ID: PAT_TA_78641
gttggaactgttgattttcaaaggacatggacttctcgtgtgaggataaatatcacactgcagaataattaaaagaagcatgtcacacaatagagatacaaaagaagtgtggcatatcctgttttgcattgaacttgttttagtattgttaaattgttagatttcaggaagtagttttttatttctctccagcatttctgtatttcaggaaacctattaaattatttgtttgggtggcataaccaaagatattttttagtccatagaaaagttttggatttgtgagaaaaaaaacatattcggtaactttgaaaaccattggcatgttgcaaggttttctttagcctcagcggcccatgttgtccaaaatcaagaattgggagcaactattccatatcagatatctacaacagtagagaagatggtacttgatgtttgaatctctaataccaatggtagagaggatcttgctaactggtgcatctcaagtccactagacatctaaaaaagcatcagctaattggaagctctaaggccaccatctgaagatagtagagcttgaaaacctgaagtccactagacatccagataaagcaccagccaattggaagctctaaggccaccatctgagagatagtcgagcttgaaaacctgaagccttcttgttgcctaggcatgtgctcctgtttggagatgtatttctctatgcatatctttctggctact

SEQ ID NO: 78642 - DNA, 288 bp, Triticum aestivum
  Clone ID: PAT_TA_78642
cataagagacgaaacgtctgtgcgctatgtgcccctcactagcaaggaatctcaattgcacgcaagatgattgcccgccctatcatgtcaaaacaaatgttatcttcaccatgtcagatgaggcattcaatcgattcgctaccattgtaaatattatatttttatattaatcctactgcctctgtaatgcgctggcttggaaataatgtaaatgatggcacatcatgaaacgtttgtttctgttcagctgccaaaaaaaaaaaaaaaaaaaaaaaaaaaaaaaaaaaa

SEQ ID NO: 78643 - DNA, 479 bp, Triticum aestivum
  Clone ID: PAT_TA_78643
tcttccattcttcctgcttcgaacatttgggggagaggggagagagagagagagagagagcggcggaggcgatggcgagcggagggaagggactcaacgcgactggggagtttttccggcggagggacgagtggaggaggcacccgatggtggggaatcagctgcgccacgccacaccggggctcggcatcgctatcgtcgccttcgggatctacctcgtcggcgaggccgcctacaaccgcctctcccgcccctccggcgaccaccactagatcgccggccgggatccgtgactccaaggtcaagtagctggagccaactctaccaagcactggtgttgatctttttacagtttgagctcataaggtcagccatgaccatgttgtaatctgtgaccaggtagacttgcccatttggtccaactattgtcttgaaaccctatgttaatacttggtatctggaaaaaaaaaaaaaaaaaa

SEQ ID NO: 78644 - DNA, 307 bp, Triticum aestivum
  Clone ID: PAT_TA_78644
attgcaacggttgttgtgagatacatactgaaccagacatctgttgcaggttccatggttggtgtgagattgggactctctgaacacatcaaagacaccaacgccatattctcacttgaattggatgaagaggacatgaacagcattactgaagtatcgaagaagggcagaaatttgatggatattattggggattgtggtgacgagtaccgagcttagttgttcatgctgctgctgggctcgtatagacctatacccgtgcccaattttccacagctctaaaattttggctattttgcgcaaagtc

SEQ ID NO: 78645 - DNA, 415 bp, Triticum aestivum
  Clone ID: PAT_TA_78645
ctgtggcctgccggtggttcggactccgacgagcccctgcagaccgtcgtcgtcgtcttcgacgcaggagagccattgccattcttactgccattgccaatgatctttgtgctgttctgttctgttgtcagaattttttttcatgcccagtttatgggggttaagctagcttctccattgtaccgttctgatgtgcggatgatgcgatgcaaagcatagtttgttgaagagatgacaaggcagattttagcttgaaaacctggaggtgagaaaaaaaaatcctgatgtgtgtgtgtgtgtgattgcagatgactgaaagccaccactagtagacttcattttaggttgtacaaatttgacagcgaaaaacatattgctccagcaaaggggcttttaaaaaaaaaaaaaaaaaaaa

SEQ ID NO: 78646 - DNA, 270 bp, Triticum aestivum
  Clone ID: PAT_TA_78646
tgggagcccgccgagaacgtggacgccgagctcgtgcaggagttcgagctgcggcagtcggggtctgcaggtggtgactgatggcggcagcactgcgccaccgccgtcggaggcgatcgcttgaagttgattgtgttttattcctccgggtgttccttgtaatgttcgattcaaagcagtggccgggcagcatattaggatgaaacctttttgtgagtactgtatcatatttcgaccggaaaaaaaaaaaaaaaaaaaaaaaaaaaaaaa

SEQ ID NO: 78647 - DNA, 385 bp, Triticum aestivum
  Clone ID: PAT_TA_78647
ggagagattcaagaactgtggagtcaactgggagttaaaataataccagtcttatcacgaccagatgacagttggaatggtgaacgagggcacgttcaggatgctttcttcaaaaacaagaacatagtaaatccatcttctacgggagccgtactttgtggacagaatgaaatgcaggaggaaatcacctcagcccttgtagcagatggtgtctcacgagacaaaatcttaacgaactactgaaagcaatctccggtctccccctgatgtattctacgaccagttattcctagacctggctgtaatgttccagtgttatttatatctatatctaataataaagaggcaaaatttatgccactaaaaaaaaaaaaaaaaaaaaaaa

SEQ ID NO: 78648 - DNA, 476 bp, Triticum aestivum
  Clone ID: PAT_TA_78648
gcacgaggcggcgcttgcagcgacgagggctgcagctactacgccgacgacgccggcgtcctcttcgccgaccacggccaccaccaccaccaccaacacgcggacgacgacgaggaggacggccagcagatcagctgctggtggatgtggaactagattgctcgcgcgcgcgcgcgcgcgcgtcgtcgtgcattcaattctcgtgttaaaaaaatcgttctctttttcatttttccgcttctttgtctgtaatgttgagtttcgatcggctatgagaaggaaggaggtgtatgcatgtgcatggtatggtagggtaacacatcggtgaatcaaatctgtcatggtgatgtacgagaattgaagaacatgggggtagcaataagtgcatggaggcaagtactcttttcaatggcacataccaaatcatgtcgtcgaattgagatttttattagtcttgaaaaaaaaaaaaaaaaaaa

SEQ ID NO: 78649 - DNA, 767 bp, Triticum aestivum
  Clone ID: PAT_TA_78649
gcacgagggagagagatagagagagagagagagagaattaagttagctttgttgtgacctcaaaggaaagaaaaagtattctacttgtacattactacattgcatggaaaaaattgcagaatgggtgccctagccaggctttgtgtattcaagcagcatatgtggtgatctgtagatgtttaccaatgtccaatacagaacttcttccacttctaactcgccttcagctcttgctgcatatattccttcacagatgtcgagtagcctgtcacaagatggaaggttctcatatggtattctcattctcaagtctgagcactgcagcctaataaatcttgcaacagcaagaacaaaagtaatgtataaactccatatgctaaatttactgagtgtttcgccaataatgccctgaggtgtctcctcagaaacaactatggccatgggaccattcagcccttgacagcctgccaaatctgacgggtttgtatcatagaatgaccaccaagaaggagtgccattatttaatagcaattcaccacttactgaatctatcgctgcttctaatcgccggacttcacctgatccagtaactcgaaaataccttgggtaagcatcaattatactgaagctgtttgcagttccattaagcacttgtttaacagcatctacacttgggctatgttcaataggggattcatatcgcactaattcctttgtaactcctaggttaaactctgtgccacagccaaagcatcctcaacatatga

SEQ ID NO: 78650 - DNA, 345 bp, Triticum aestivum
  Clone ID: PAT_TA_78650
aggcgcaggtgccccggtgagaatctctcgatgcgaaccatggggctggtcctgggggcgctgctccaatgcttcgactggaccaggattggggatgcagaagttgacatggcaacagccactggcaccatcatgtctaaggctgtcccactggaagctctgtgcaagccacgagcgaacatgtctgctgttcttcagaaaatctagagtgaaattgtgaacatttgtaggtacaaataaacgatagtacataactacgtaatgctagtataatctgtatagcagtttcatctttatacagtacttcttggggtttatccatcgaaaaaaaaaaaaaaaaaaaaa

SEQ ID NO: 78651 - DNA, 785 bp, Triticum aestivum
  Clone ID: PAT_TA_78651
actatcaagtattaacttctattggagattctttagtgctgtttgcacttcatccacaagctgcctcagtttggtacagcaatcgccagtattagagaattcaatgtcccctacaagagacattgggatatcagatagctctaatggagccaaagaaggaccttattttgaatcccacacggtggtgtctgctaaaaggttaaaaactgtgaatgggcatgcactagcatacttaaaatgtggcccttccagtcaggtaccagtggcagtttctgcggtgatggtggagcatccacaaggccagcgtggacgttgtcgacgccttcaactcccagatcagtgtgccctagcgcgtcttcaagaactggttgagcaacaataggcacctagccaagattccacccttggccctgctgttgcaccatcaagaccacccggccaccactgtgtagggactgatgactgaagaagacaagtctcctaaagctgaagttgctatatctgctgatggtggcaaggaagacaacaatgaagtttctgaagtagtagtgattccaccttcggccctgccgtcgcaccacaaagaccacatggctaccacagtgcaggaatcaatgaccacagtgcagagatcgatgactgaagaagacagttgtcatgatcatgactgaagaagacagttttgttttaagcagttgggatgtacggtggcgacctcgctcaagcagctccagcccgacgttcgactgagatgataggaggaatatccgatccccaactcctct

SEQ ID NO: 78652 - DNA, 612 bp, Triticum aestivum
  Clone ID: PAT_TA_78652
ctccgcctgcagtgccgtccctctcgtctcgtctctattctcaggcgccacgcaaaacggactccgcgcttttccctctccggatccggctccggcgaagcagcgggagccacagccaccgatgctccgggccgcgacggtgcaggcgcgtctcctcctcctatcgcgctcctacgtagggcaggcaaaggcagcttctagctggcctctcgtccgcaggaagccttcgcgtcttggatctgtacgccctttctatcagatggacactagagggcaagacgaaaataaaattttgactgcaagagggtgccatagctcccctgagagtcaagaattagcaatgaaaagctgtgttccatgcaactctaaggatttacatcccatgtcagaagattctgctaaaaagttgcttgaacaggtgaatggttgggaactcattactgaaggtggtgttctgaaattacatagagcatggaaggtgaagaactttgttaaaggacttgagttctttcaacttgttgctgctatcgctgaggaagaaggtcaccatccagatcttcatcttgttggttggaataacgtgaaaattgatgtttggactcattctgtcag

SEQ ID NO: 78653 - DNA, 199 bp, Triticum aestivum
  Clone ID: PAT_TA_78653
tagtcctgtgtggagcctgggcgcagcctctgccagtataagtgctctacgtgttatacattttttatgttcatgaaacgttggtccactgagaaaatatatcttcaggtgccaagggatcggtttgggaaaaaaaaaaatcttacggcaatctaccttttgctctaaaaaaaaaaaaaaaaaaaaaaaaaaaaaaaaa

SEQ ID NO: 78654 - DNA, 705 bp, Triticum aestivum
  Clone ID: PAT_TA_78654
acacggcttgtcaaatggtgacacttcaacaggaaaagatgtatccttgaaaaatttgccccatccaagatctgaggttgatgatggggctgaaaatcatgcaagtcagatgcttccctcatttgagttttccacagtttcgcctccatcaatcatcacagaaggttcaagtggagggccttggagaaagagaattacagatttagatggaaccgagagcgatatcccatggtggattgtggactgtgttgagcataatcgatttccaaaagagaatacaaagtgtggattctacttgcatcctgctgaagggtcacctgcaccgaacataacacaagggaaacttagtgctccacggatattgcggattcacaaagtagctaactatgtggtcgagaaacttgatagaccactggatggcaatgctgacagcacatttggaatgggattgacttctggccaatcacaattttcagcgctagatagttcttcacggcttggactaaaaccatggcaaaaattgaaaccttctgtagagatattgtgtaacagccaggttttggcacccgaaatgagcttggccacagtgcgggcttatgtctggaagaagccagaggatttgattcttaactacaaagtggtccagtcaagatgattgcaacttgaaacgaatgttcaccctaggagctgaggaaatcagtgcgg

SEQ ID NO: 78655 - DNA, 481 bp, Triticum aestivum
  Clone ID: PAT_TA_78655
atcacaactgcagagtcagctgaacttggcacccacagctctttgaatgggaactcccgagcactggccactgtgacagcaataattgatgggacggggtctgtcggagctgccatcggaccgttgctaacaggatacatctcatccaagagctggagtgctgtgatcacaatgttgatggcagcagctctccttgctgggctcctcttgacaaagcttgtatgtgccgaactaaaaggaaaaacaccttccaacgcgagcaaggatgtcgccgatgcacaaggtacctactcagatgaagtgtaaatccaaagctgattgcgccatggaagcagttccagtgaatgcctactaagaagttgaccggttgctgcttcccactgcctttcatggtggctagcagtctgaagactgaaaagggaaagagatttggctgctgagtgacttgctcaaatgccacttcagatgattttttgtgtct

SEQ ID NO: 78656 - DNA, 423 bp, Triticum aestivum
  Clone ID: PAT_TA_78656
gcacgagggtccattataacttaggattaacgagaaggtgcggcggctcattagcaaaagaagttttttggagacggcgagacgtaggtacgcagtaccaataagatcaccacacgattagcatcatcagcatcgatcaccaacgttccgacgctcgagttccagaatccagacgacgacagttctagatgtcgactaggcagttgactagcaaaggcaaagccttatgtccttgtgtcctttttgtaatttgtgaatcttgattctaaatcaatttacatctaaattgtataggtcctaggttttttctttgttcaattttgtctagtactccctctccccaaaaagagtgacattttttacttttagaaatcatgtttgaccgttcgtcttattcaaaaatttaaaaaaaaaaaaaaaaaa

SEQ ID NO: 78657 - DNA, 712 bp, Triticum aestivum
  Clone ID: PAT_TA_78657
ctcgagtactacatagcctgatagatgagctagtcgaacgggggattgagatacatgtgactctctaccacctggatttccctcaaattcttgaagatgagtaccatggctggctcagcccaagggtcattgacgatttcacggcgtacgcggacgtgtgcttcagggagttcggcgaccgggtgaggcactggaccaccatggacgagcccaacgtgctgtccatcgccgcctacgacagcggcgccttcccgccgtgccgctgctcgccgccgttcggggccaactgcaccgccggcaactccaccgtggagccgtacgtcgtcgcccacaactccatcttggctcatgcctcggttactaggctgtacagggacaagtaccaggctacacagaagggattcgttggcatgaacatctacagcttctggaactaccctttctcctccagctctgcagacatagcagcaactcagagagccttggatttcatggtcggttggatactggaccccttggtttatggggactaccctgaaatcatgaagaagaaggctggttccaggattccatccttcaccgaagaacaatctgagctgatccgtgggagtgctgatttcattggaataaatcattacacgtcggtgtacatcagcgatgcatcgaatggcgaaacggtgggccctcgagactacagtgctgatatggcagc

SEQ ID NO: 78658 - DNA, 422 bp, Triticum aestivum
  Clone ID: PAT_TA_78658
ccttttcggtggcaagaagagatacggtactagaagaccccaccacatccatgctgctggaaaaatccttagatattcccttcaacagctcgaaaagctcggtgtcgtctccagagataagaagtgcgctgaaaagaagttcgctagagttatcaccgccaacggccagaaggaactcgacgttattgccaacaacctcggaaaggaaatctacaagagaaaataaatgtgctgaatttctaagtagtgatgatcactctacaggaaacaagcaagcacagagctatccacataaaaaacacgagtgacgtatttttacaatgactatctgtatagttgtaagagaaatcaaaactaacaaaagaatgtgctcgtttatctagattagatgcccttctcttataaaaaaaaaaaaaaaaaaa

SEQ ID NO: 78659 - DNA, 350 bp, Triticum aestivum
  Clone ID: PAT_TA_78659
ccctcggcaagatgtccaaggacgaggccgacgtctccggggacctctccgggctcaccgacaaggagctcggcgtcctcgccgactgggagaccaagttccaggccaagtaccccgtcgtcgcccgcctcgccgacgcctgaactcggcagtctcaggctcaaccacccctaatcagccgcgaggagcagctctctgctgcggccaagtgtcagtgtaaactctgtcctgcctcttgcagtgttgttcactgttgtgcttgcttgtttgttgctacccaataatctgtgaatggaaggatgtatgtggctgtgaattaaaaaaaaaaaaaaaaaaaaaaaaaaaaaaaa

SEQ ID NO: 78660 - DNA, 626 bp, Triticum aestivum
  Clone ID: PAT_TA_78660
gagggtttgctttagcttgcaaatgcaacagagccaaccatactagacaagctttgcgctgctctaaacatcaacaaaagaagtgtcgacagggatctcgatgtttaccggaacatactctccaaattggtccaggctaaggaacttctcaaggaatacgtggaaagggaaaagaagaagagagaggaaagatcagagaccccaaaatcgaatgaagctgttacgaaatttgacgggagtctcaattccatgaggcattaactcaagccttcataaggggagtgagtgctaccgtggataacagattttaacagagttctggatcacgttgagaaactatcaaggtcacctttcactgcacggacactttggctgctctcgtgtggttttgtattctgccgtataaaaggatccagattgttcttactactgagcattatattttttttgtaattctccttttcagtgttcaaatgtatcgttttccttttctttgacaatatatgaagaggtatgtggggatcaatgttactcacaagatgaaaaatatattgttcagttatctcttcatgatgaaaatgaaatcggtcacaacttctttctttggaaaaaaaaaaaaaaaaaaa

SEQ ID NO: 78661 - DNA, 717 bp, Triticum aestivum
  Clone ID: PAT_TA_78661
ccgccgcccagaactcacgcgaacgcgcccgcgcacctcccctcctccaatcctcttcctccttccagatgctgagggtttccccgtccccggccgccgccaaccagctcgctggtgcggccgtagcccccgctcccgctcccgttcccgtcagggtggccgcgccgcgcggcggcgtctcgccgtccgctgcagctgcgtgcagggccgccgggaaggggaaggaggtgctcagcggggtcgtgttccagccgttcgaggagatcaagggggagctcgcgctcgtaccccagacgcccgacaagtcactcgcccgacacaagttcgtggacgagtgcgaggccgccctcaacgaacagatcaatgtggagtacaacgcctcgtatgcgtaccactccctcttcgcttacttcgaccgtgacaacgttgctctcaaaggatttgccaagttctttaaggaatcgagcgacgaggagagggagcatgctgagaagctcatggagtaccagaacaaacgtggaggcagggtgaggctccaatccattgtgacgcccttgactgaatttgaccaccctgagaaaggcgatgctttgtacgctatggagcttgctctggctctggaaaagctggttaatgagaagctgcacaacctgcatggtgtagcaacaaggtgcaatgatccgcacctgacagacttatcgagagcgagttccttga

SEQ ID NO: 78662 - DNA, 523 bp, Triticum aestivum
  unsure (1)..(523): unsure at all n locations
  Clone ID: PAT_TA_78662
gagggttaaaattagtttgaatgaaaaaggaggtttatctgcaactgtatcttatacaagtattttttctggaaataaagaaaaatggagtttttctgcatatccaattcaaggatctcgttcacaatttaatattgcttttccaccaaatgctcttcaaagaaaaactattggaattattttagatactgattatgttaacttttatgttcttgaaatgcttcaaactactgaagacggaaaaacattgcaatatgcttggattgtaactaaaacacctacagttgatgatcaaattcttatgcgtgctaatagagctttagcatttgctggtattaatccagcatcattggaacgtattccacaatatggctgttaatcataattgatcaaactatgactttaaatatattttgaatgataaatctttctctttatacgaatgcacatcatttaatattaataaataatcaattgcatataaatacnaaaaaaaaaaaaaaaaaaaaaaaaaaaaaaaaaa

SEQ ID NO: 78663 - DNA, 651 bp, Triticum aestivum
  Clone ID: PAT_TA_78663
gcacgaggaccctcttgaaataatgattgaggtcttaaaagcacttcaagaattaaacgtcagctggaagaagaatgggcactacaatatgaaatgcagatggctcccagggtttcctgaagtccatgacatgttagatgccagcaacagctttcttggtgactctaccatcatggataatgatgatgcaaatgggaggctacctgctgtgatcaagtttgaattccagctttacaagacgaaggaagacaagtacctcctcgatatgcagagagttactggacctcaactcctcttccttgacttttgtgcggccttccttaccaagcttagggtattatagtgctctgtttctcttcggattggtgaaaaaactaaacatagggctctaccatgtgcagtttttcactgaggtgatgaataaacgaaagcatgtaaataggaacctttttctcgtctttggacagcaaacatgtttgagtgactggtcttgtgttaagcgcctgaatgttgcctgttaacttatcctagatgtatacttaggtttagtatattgctgtctgcatggacattgctgtttctgcaatcagtggcaccgcagatggcgatgcagcagtgcaagctattatggatttttttttttttttgcaa

SEQ ID NO: 78664 - DNA, 599 bp, Triticum aestivum
  Clone ID: PAT_TA_78664
ctaccatcctctaatctctctctagcatccagccgaaaacaagctgataatgtttcgacgcaccaagaccaccatggctcctcctactgatggtgaggtgaggattcagaaagttgacaagattgatctcgtctacaacatcctctccaagccaaaactgtataacccaactgcggcaaccgggaagtatcctactactggtcatcatgaagtcacaggctggaagaagattgagaaccccagcaggcctaggaatgtagtttctgtagaagacatcaacaagaggtctgaaaggtacattacagagatgaagaaacgatttcttggctaggtagcacctgagcctgtgatgacaaggtgaagatctgatagtattggtgtcgtccatatggaattggtttggttatatgtatatttgatattaccctgtgggatggaatatatatgtgagagatgctttagatataaatgcttttatgcatgatgtatgcatgccatgtatatgatatagagagcataatgttgagtaataagcttagtatcaatatgcatgatgcctaccgatggtcgtcagttttcacaaaaaaaaaaaaaaaaaa

SEQ ID NO: 78665 - DNA, 290 bp, Triticum aestivum
  Clone ID: PAT_TA_78665
gcacgagggcaccgagtaatcttctgccactgcagaagagatgcggcccaacgagctggatggcccagacaaccccccgaagtaggcgtaagtggcacaccgtgctgtggagctctaaccggtggatgatagacaaaaaggatagtgagtggtgtatataagaaaagggattctattcgacaatctcttatagggtttgttccttccttctttctagtgttcagagccgtcgcaacctgtaatacatggcatgttggttcaaaagaaaaaaaaaaaaaaaaaaaaaaaaa

SEQ ID NO: 78666 - DNA, 687 bp, Triticum aestivum
  Clone ID: PAT_TA_78666
tcccagagagggtcgccgccgtcgtgttcctcaccgcggccatgccgcccgtcggccgccccatgtccgccaccaccgaggagtttctactaattgtacgcagcacgtgaactatgttggggcggagttcttccttgactcgatggagctggagcagcagaacgctgacatcccggggaaccctgtaatcttcgggcccaattttatggcccaaatactttaccatctaagcccacaagaggatttgaccttaggactatcgctgatccggccgacgaacaagttcaccggcgacgcgctcatgagggaccctgggctcctgacgaaggagaggtacgggtcgacgaggcgcgtcttcgtcgtcgtggaggacgaccgcgggatccccgtggagttccagcgccgcatgatcgcggagaaccccggcgtcgaggtggtggacttcgccggcgccgaccacatggccatgatctccagcccggccaagctcgccgagttgcttgttaggatcgccgacaaagcacacgaaccatgagtccatgactcggactaggagtggggacagccaaatcactgatcaatagggcagaaatattatgtcaaccaatgaggcaaagagaatgagggaaggaaaaaagaattaatgaatgttacactgtttgtttgaaaaaaaaaaaaaaaaaaaaa

SEQ ID NO: 78667 - DNA, 715 bp, Triticum aestivum
  Clone ID: PAT_TA_78667
gggcgtacgtgctaagctgcagcacaacccaaagccatatatctccgataatggcgaactcaccgacgctgacaatgctggtgttcctagctattgggctatctctcgtcctctccgcagccggcgtgtctgtggagagcgtggtcaccgaggcgttcttcaacgggatcaagaaccaggccccgaacggctgcgccggtaagagcttctacacacggcaatcgttcctgaacgccgcccgctcctactcgggcttcgccaatgaccgcaccaacgacgactccaagcgcgagatcgctgccttcttcgcgcatgtcacacacgagactggacatatgtgctacatcaatgagataaatggggcaaacatggactattgtgacaagagcaacaaacagtggccgtgccagccgggcaagaagtactacggacgcgggccgctgcagatctcatggaacttcaactacgggccggcgggaaagaacatcgggttcgacgggctaagggacccagacaaggtggcgcaggacccgacaatctctttcaagacggccctctggttctggatgaacaacgtgcaccaggtgatgtcgcaggggtttggcgccaccatccgggccatcaacggtgcgctcgagtgcaacggcaagaaccccggtgccgtcaacgcaagggtaaactactacaaggactactgccgccagttcggcgtcag

SEQ ID NO: 78668 - DNA, 493 bp, Triticum aestivum
  Clone ID: PAT_TA_78668
ctcgctgattgctgcgtctgcgcggcattacttgctgcagccgatcattgccgaccacacgacgttggagagcctggacctgacagacgccgatgggcagggagtgctcaccatggacaagtggcagctgcaagaactgcgggtgaagccggtatcggcatctgggggctcacacaggacgctgatgccagcgcttagcatgcggctgtggtacgcgcctcacattgagctgcccgggggtttggtgctgaatggagcaacattggtagccattaaaccgaccgaggaggcaacaagggacacggttgggactgggattgctgggtctgcaggtggatgctgggtttcagatgcctttgaggagccgtatcggacagccgtggggatgctcctgaagcggaggacatatagccttgagatgaactcgttctaagctgatggcaatttggaagttctatccgtgaggatgttaatttattgcaagttgcaactc

SEQ ID NO: 78669 - DNA, 561 bp, Triticum aestivum
  Clone ID: PAT_TA_78669
gcacgaggagacagacttagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggctacagcccaatctacacgccggaggaatggtctgaatctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctctgtaatctacgtagctacctcctgtgaatgtatgtcatcaacgatgcaaagtaattgattcgaacagatggtttatgtatgtaaa

SEQ ID NO: 78670 - DNA, 253 bp, Triticum aestivum
  Clone ID: PAT_TA_78670
actagtctcgagttttttttttttttttttttacgcaaataatgcatcattatacttattagggttgaccctctctaccatctattacacccatcatagcatcgtctcttcatatacaacacaaacatttgcatgtcaagtgttacaagaacattattattatttttgttccatgatacaatgtgccgcaacagtctcttgtcttcaagctctgttctaggatccctgagctgctgcagcttgcttagcttca

SEQ ID NO: 78671 - DNA, 353 bp, Triticum aestivum
  Clone ID: PAT_TA_78671
ggcacgaggcggggggctgctgatcggcgacatgatgtcggacgcgtcggcgtacgatgccggctacgacgccgggttcgacgacggcggtggcttcgatggcggctttgatttctagagcactctgatgatgacaccgagcatctcaagggcagaggtctttcgttttggatttgcgtttgtggtttgtttgtttcgttttgtacgcaatctaattgtcaggatcaaatcaaattatgcatcttatatatctgatgatatatatatggtattgtaaatactcctatgatgctgaaagcgtgacattatgaattgcacgcagttttcttttattcaaaaaaaaaaaaaaaaaa

SEQ ID NO: 78672 - DNA, 493 bp, Triticum aestivum
  Clone ID: PAT_TA_78672
gaggctgcaacattcaaactggaacgatttgaggctggtacaattgatttcaagggcacagactttgaatacacaccctttggggcaggtcggaggatgtgccccggcatggcatttgcgcaggcaagcatggagctcgtgctcgcagcactcctgtaccattttgactggaagctgcctgatgggatgctgccaagtgaattggacatgacagaggagatgagcatcaccgcccgaaggaaacatgatctttacttgcagccagttgtcagtgtgccgccacatgcagtataatctacttgctattttaccctagatatatgctttacacatctagttgcatgtgtgccgttgtctgaattaaaaaataagtagatgaaacacactgtttttgtttggtgaaattttgaagttctctatgtaaagatgcatattattggtttagaacctcacagtacaatgatatgttcaaatcaaaaaaaaaaaaaaaaaa

SEQ ID NO: 78673 - DNA, 461 bp, Triticum aestivum
  Clone ID: PAT_TA_78673
atggtacctgacatgatcaccgttccctgcaaaccggtacatggcaacactcacaccaccaattgaaggatatatcgaaaaagtgcgggaagcggccaagaagcactctgtgaaggagaaacttcgctgagaattcaagggaggaaactgtctccacataaggggaatggatattgaacctaatgtacaagaacagctttggcacaaactacacttgccaaatttggtgatctagtcagatatcccaatttgcagagcagtcatgatctagtgaaatctattttgccaatttttatgcagaactctacaggattggcgtttctttgaagttgtcactagactgtcatttcacccttttttttttgctggtttaggatgtttgttgttgacagacttctgtaataaagggttaacagtgagaccgtgaaaaaaaaaaaaaaaaaaaaaaaaaaaaaaaaaaa

SEQ ID NO: 78674 - DNA, 534 bp, Triticum aestivum
  Clone ID: PAT_TA_78674
gcacgagggccagtcgtagagccacaggttccgcggcccctgcgtgcgccgggaaaactgcgccaacgtctgcaggaccgagggcttccccgacggcaagtgccgcggcttccgccgccgctgcttctgcctcacgcactgccgcaactgattcgatcgatcggccgggggagcatgcatgcatgcctgcccggcggcgagtgcatgcggcgggcccgtcgttttcgatctctgttgccgtgtcgtcgcgcgttgatcgcgagaaccgtccatgaataataagaagaagtgtgtttgtgtggtttgtttttggacctttttgtcagctggtgtcacaagttatatttgtcgtttgttgagtcgtggatcgatcggtctatagtagtgtgtgccgcctctgcgtgctgctagctgctgtttcctctgttcttcccctcaatgtttcggtttctccatatcaatgcgttgagatctactcctaatataagagaaaatttcaagttccctatctccatcaaaaaaaaaaaaaaaaaa

SEQ ID NO: 78675 - DNA, 350 bp, Triticum aestivum
  Clone ID: PAT_TA_78675
gtgcttctgagaggaaaccagctatatatgatcgttggcgatcgacatcttgtgtatctttgtgttagtgttgctgttaatggtcaattggtcatgcagtcctgtatcatgtgattcgtagtcgatcagctttaatttctggtgcggttgcattgtatctacatatctcttttgttcagcagtcgctgatccattcgtttttctatgactatcattgatgacgtttcctgtacatatgcctattagttctacacgttgttattccacctctataccgtacccctgttgaattatatacatagtttatatactgtattcctttgaggaaaaaaaaaaaaaaaaaaaaaaaa

SEQ ID NO: 78676 - DNA, 337 bp, Triticum aestivum
  Clone ID: PAT_TA_78676
gcacgagggttgatatatgatcttgatagatgcgttgacacatgccttgcttcacaatttttcgtccacaagggaggtgtagggtatgtatatgtttggctatattgctccactcagtgcattaaatttccgcaagtcatggtgggcttggtccgttttatgtttgctagacctggcctggatgaatagaatctgtaaacatatctgtacaactatgtgcttatgggacattgctgttgttaccatgaatgttacaattgttcggttgaaatgacaaaaaggtataaagaggagataaaaaaaaaaaaaaaaaaaaaaaaaaaaaaaaaaaaaaaaa

SEQ ID NO: 78677 - DNA, 607 bp, Triticum aestivum
  Clone ID: PAT_TA_78677
acggcggcggcggcggcaggatggctgattcgacggcgaggacggtgaaggacgtgaaccctcatgagttcgtcaaggcctactccgcccacctcaagcgctccggcaagatggagctccctgagtgggttgacatcgtgaagactgcgaggttcaaggagctccctccttatgatccggactggtactacacgagggctgcctcgattgcaaggaagatctacctgaggcagggtattggtgtaggtggcttccagaagatctatggtggccgccagaggaacggctcacgccccccgcacttctgcaagagcagcggcgctatctcacgcaacatccttcagcagctgcagaagatgggcatcattgatgtcgacccgaagggtggaagactcatcacctcccagggaaggcgtgatctggaccaagtggccggaagagttgatgttaccatcgcctgaacagattcattgatcctcaacccttaatgcctgtcatgtttggtggttgagttggctacagtttgtttgcagttttgaattagaacatgccctatctttgttggctcagagaattggaagttggatgcatctagttatgatattgc

SEQ ID NO: 78678 - DNA, 673 bp, Triticum aestivum
  Clone ID: PAT_TA_78678
gtccgggtcctctgctcccgtcgtaacgccgctcgctccaatctcctcctcctcctcctcgaaggtgggcatacaagttacgataaagcctgaattccgcattgacccacctcctcaattgccaccacagatggtagaaattcctcgcagcaccttcaactttgattttgagtatgagagaaggattcttgctgaggcagagaaggagaaccccaactggactaaattcgtggtagaaagacaggcaccacctcctgtggcacagcaggctagaccagcatcttcaggggatccagttgtcgacaggtatgtctcaatggggcttgggcgtgaagctgtctcatttgcagtgttgaattatggagataatccaacgaaggtgaaggagttcgtgaaatcctacaacatcctccacgagatgggcttcacatcgccaaacgtccccgagctgctagccatccacgacaacgaccccgacaaagtaatccagcgcctgctctcctcgccatcctgatccccgaacaaaacgcctcgcatttgtataccgcatccatgtacagccctgccctacgctggcaaccatcacagatgatgtcctcttttttcaaaagaaaaaaaatgatgtggtcttctatttcgatatacgtgttagctgccgctagctctgtgaacc

SEQ ID NO: 78679 - DNA, 695 bp, Triticum aestivum
  Clone ID: PAT_TA_78679
cgaggtagatagtaaatttgcttcttggtggattatttattggtgagcgctaggggtacattttagattggattctttgtcattccacagtttagcttaagcgtgctgacaattctcagttaagttgtcgtaacattcaaggttcagctgacatgcacactacaacatatatttagcttaaattaccccctatctgttgctatcatgggctcatggctgcacaaccaccacagtacacattatataaatgatggtcagtatacttgctttgtctacagttgatatgaatttgtctgccttttagtatgtatctgtaaaatttttgtttcatgtttgtttttctgcttaccagggaaggggaagatacaatgtttacttccttatgattgttgcccaaatttctctactgtaaacactacacagcagaaggtgatccatagcttccggcgcctggtcatagatgatgcagtctttagtgctctgcaacccatgacaatgtctcctagcagtagtacaacaacgtccatgcatcaccagccaaaagaattttttgactcatgggaggacatcttttccagatttgcttggcttcaggcggatttgatgaaccatagaacattgcgacataggccgaggctgcacaatactgctggtcgtcggacaagcaccgcgaggtcaagataccggtaatctca

SEQ ID NO: 78680 - DNA, 694 bp, Triticum aestivum
  Clone ID: PAT_TA_78680
gcacgcgagcgagcggcacgagaatggctagggttccggcgaggcgacggcgagcgccatggcggggattcggtggccgccggaggacccggagatcttcccttctcgcatggtcagcggcggggcctggatccccgtcgcgcccccgggagagatggcgtcggacgacgaccggtcggtggccgcggactcgtggtcgatcaagagcgactacggcagcaccctcgacgacgatcagcgctacgcagacaccgccgaggtcctcctcgcctcctcctccgcctcctccgcggccgcgccctccgcgtcggttgccgtccacccctcctccgacttcagcttcgacaaggatgtccctgactccagtgacgttgagcctcggttgctggggttgcagaattttcaggatggtgcttatgctgaggatcttgcaaatttccatgaacgcagccacgctgatgactggtttggcactgagatcatggatatccgtgtaggttggaccaaaaatttgtgctcaagcagggatttacccagctgcagcgtacttgacattgggactgggagtggcagactcttgcagcagcttgcgaagcaggggttttctgatctgactgggattgactacagtgaaggcgcgattgagcttgctcggaacctagcaattcgtgatgggtttgagcacattaatttc

SEQ ID NO: 78681 - DNA, 617 bp, Triticum aestivum
  Clone ID: PAT_TA_78681
accacatctctcccatgctctcggtgtcctgccctctgccccgcctggatctcgctccctgcagcggcggcgcatcgcggctgcaatcggcagaacactcagcgttccgctcgcagtagcctgctttgctgcatggctggcggcggcgccccatggtcctctcagccggtgatgctccgaggtgttttgctgcaaccattgtgagaatagaagaacccaaaaccacaacactgatacttgcaataggtaggcaggttggcatggtacaatcaaggatatcgaccagagagtgattgacaagtttgatcagagccattctgcaagccctatgcagtgtacctgatggtgtcgacaagttaaaagtgttcattgaagatgtgtttagttttaaacctattatagataagactataagctcactgtaagtgaaatttaagcagtgagctttaggtgttagtgatctaagctttcggttacaagtggtggatgtatgacttctgatcacatgaggtagaggtagggaagttgatgctcatgcacaattcatgtatgcgagcttctaatgtatgttgtacttgtatgatgttgaatttgatcaaccatatattgggctagct

SEQ ID NO: 78682 - DNA, 698 bp, Triticum aestivum
  Clone ID: PAT_TA_78682
gtagactgtaggatggccacgctctcttcctgcagccgcctgagcaccggcggtggcgccgtccagcgccgtccccggtggccggcaagcgctgcgaccatcacctgccaccggagctcctcctcctcctcgtcggccagggtagtccgcacaggcgccgccgcggcgcctgccgcggccacggcgcccgccgtgccgcagaccaacgagtgctcgcttccgacatgggcggagttcgagctgggcaaggcgccggtctactggaagaccatgaacggtcttcctccatcggctggagagggcctgatccttttctacaacccggcagcgaccaagatgacccccaacgctcagtttggcatcgcgtttaatggtggttttaaccagccgatcatgtgcggtggtgagccgaggcagatgacgctgcaagagaggggatcagctgatcctcccatatacaccatcaggatacgtgtgccgcagcatgccatgaccctcgtcttctccttcacaaacggggtggattgggatggaccgtacaccctcaagttcagggtccccaagccatggctcaacaagcccttgagcttcttcaacgagggtctagcagacgaactgaacagagaaggggcatgcgacagagccatcttcccagacgaaaacgttgtcatcacaagctgcgagatgggcagctacta

SEQ ID NO: 78683 - DNA, 516 bp, Triticum aestivum
  Clone ID: PAT_TA_78683
cgtgggcggccgcacgctggaagccgtgctgtccaacatgcgcaaccatgggcggatcccgacctgcgggatgatctcgcagtacaacctggaggagccagagggcgtgcacaacctgttccagatcgtcgctaagcgcctgcgcatggagggcttcatagtcatggactactacggccagtaccacaagttcgagcaggagatggccgggtacctcaaggagggaaagataacctatgttgaggacattgctgatgggctagagaaggctccggcggcgctcatcgggctcttcaccggccgcaacgtcggcaagcaactggtcgccgtcgctcgggagtgagtatgtcggtgagggcgtgatatgtgtctacccggagagttgagaataatgccatagcgttggagttcgatgtgctgggaactgatggtttgtagacgactgtagtgcttgtagttttatgctgcttgtgtgaaaagttttagattttctacaaaaaaaaaaaaaaaaaaaaa

SEQ ID NO: 78684 - DNA, 665 bp, Triticum aestivum
  Clone ID: PAT_TA_78684
acgagggcatttattacattatcaaatgcagatggagttgatgtcctcgttttttttgcgagtggcctcaagttcatttcacagtgatataataaactattcacattttttccatttcacggtgacataatcaaatattgacattttgtttccaaagggctcttcacctgagatttgaaagaagaactgggcctttctttctgtgattttgtaggcacgcgggaggacaaggcgatagtggcggcttacaggcagaaagaatgggtcagtttccttgcttcctgtagtgaaagaaatagaagtcatggattacataaaagaccacctgagctaactcatatgattggagaataatgatagtggttgatttgtcaaaacaccattctattttttcaaaggctcatctacagttgtcaattctatatcttgcattctttcagctctcagtcatggagatgcagttcttttcagttatcatcattctatcccatgtgttttccacattgacagtgttggctctgttgcactggaaagacagtgttatttggtcttccttgatggttaaaaaaaaatctcttttctctagacggttaccattccagcaaggtataaagttttgcctcacattttgctgctccaatgtaggctccaatggacacacttat

SEQ ID NO: 78685 - DNA, 229 bp, Triticum aestivum
  Clone ID: PAT_TA_78685
tgggggaggtactggttgagagatagagactattttgtgttcataatattcattactcttttagcttctttcggtcgtcggcccctttcgtagtttttgcctttcactgttgctccgaagatttttccctgcctttcgttcatagactggtgtacgttgtaacccaacagtatgtcaaatgcaagtcatcttacgcagcaattttacatcaaaaaaaaaaaaaaaaaaa

SEQ ID NO: 78686 - DNA, 697 bp, Triticum aestivum
  Clone ID: PAT_TA_78686
gcacgaggcttggggttgggagcgccgctgccgcccctggttttgcaggccctcaggcatcatcacacgtgcaaaacgtgttctgacacgcgatcctccctcaagcccataaagaacaaacatgaactccaagcctcatttattgattctttttaagaaccggatgtgcaaaaaaaaatgagcatccacgtccctggctctattaattaagtacagatcagtgttttttaggagtatcacagccagcctccaagtggcatttgtgagcacgtgtatgaaatcgtaggactcgttgttacaacagagaaaaaaaagagacgtgcagacatgtgatcaaaaagctcgaaaggggctggaggaagcgggcgagaaatgaggtcgaggaggggcagggcacgttcccgtcccggtcgtgcggccgtgccgtgtgggctctgtgctctgtagattccgagtcgcggcggcaaaccggaaccagaaccaccggtgtgctctccttggtttctactccagctgctacaactacaactggtggtcttgtcaaaaaaactacaactggtgtggcctttttgtttatcgtgtggctgtaaaccgaagccatcggcatcagggtcagggggggcaccagcctcgcctgtcagcgtcgtgcttagttgaccggagcagatttttttggtttgggattaaccacttcctg

SEQ ID NO: 78687 - DNA, 608 bp, Triticum aestivum
  Clone ID: PAT_TA_78687
gcacgaggcgtccctcttgccccctgagccgccgcgtccgccatggcccagcccgccttcctctcctccctccgctcccgcctccgctccccgcagccgcaggcgccggcgctcccccacctccaggccccccgccgcggcttccacgtcgagctcggcgcacgcgagaaagcgcttttggaggaggatactgctctgaagaggtttaaatcatataagaacagtgtgaaacaggtctcaaaggttgggaatattcttaccggcgttgtcctttttgcctgcgcctatgagatcgttgcacttgcaaatagttaaaaatgaaggaatggacactcatgtgatcactcaaatccaccagaaagtgattcatcagcataaactgtcattttgtcagcactagttctgcacctcctgttttgatggtaccatataaaataaaacaaactaggttaaccttctttggcaagatctttgtgctctcttggcctagtgtgacatgtaaacagatgtatgcgatgaatgatcatcgcctttgttttcttttccttgacttagcacgctcaaagctcaataaaatggtttatctcggtttgcttgctgatggcttt

SEQ ID NO: 78688 - DNA, 762 bp, Triticum aestivum
  Clone ID: PAT_TA_78688
gcacgagggtctccgttaagcccgctatggacctcatcatgcgctgcgtcggcgcctccagcaccgacttcttccccgacgagagcatggagaacacgctcgtgccgcatgaatgggtgaaccaccgccactcgtactggtccagcggcggcaaggacaaccccgacgcccccgagagcttgacctacaggctctcctctgacctctgcgtgattgatgagatcagggtgcgcccctacaaagctgcttttcagcatggccatcctatttactcttccaaggcggtgaggatccggctgggtcattccaagcttgatcctggaacagagactttcgtgtcagctgagaatgagaacctgacagcaatcgctgatgaaaactacacgtggacatacacgtcgccagagttccctatgcttcaggaaaatgtgttgcaaaccttcaagcttccacgccctgccctttgcattggtggtatagtgaagattgaacttctggggagattacagaaacaatctacagatgataagtattacatatgtgtctgccatgtccaagtgatggggcgctcactttcaccagatttaatgatagacatctccgatcctgctgattactcaaacctcaagtatttgccgggtgccggtaacttgcgcccagaagacctactgagcagtgacgccaaggaggactcatcggactggcgctcgcttgtttctaggtacaggcagatgaggcaattggcgatgatgtatatgctgc

SEQ ID NO: 78689 - DNA, 710 bp, Triticum aestivum
  Clone ID: PAT_TA_78689
gaggggaaagccttagctaatgcattggctacagctccatcgatgtggactcttgggaatgctggcatgggtgcattgcaggtttgcattcatctgtccttcctacctatccaaaatgaaaaaaaaaagcataaaagactgtttggtacttcatatctgaatttctattggctgaatatctgagggcttagttggtttctctcccaggcttgctattgagcaaagaagtcataatttagtttgggcaaagagccaaaggctcccacaaacaatctgacaagggtagactaggcaacaaatcatggctcttaatatggagagtgcaggctatattccacaactaaatgtccacatgcttaacaaatttcatatttcaaccatccatgttcaaatccatacaaagctaaagacatttctgtttgattctcacttcattatcggacaatgtgacacaaagcatatttctaccgaagttgtttgataaggttgttgcaatttctctcctttcgattgcagagattggctcaagatcccaattatgctgtagctagggctgcatcaagcgccattgatgaactcaagaagcagtgggaacttgaagaaggtgacagtctgaggtttgtaatgaatcagaatttggcttctgaggatactgatggtgacgacaattcagcagcagatgacgacacatgaggtgtaaacaagttgaa

SEQ ID NO: 78690 - DNA, 597 bp, Triticum aestivum
  Clone ID: PAT_TA_78690
gcacgagggctagctgttgccctgttgccgtctactagcggactgctcgcggcagcagagtgcacggcagcatcaggcatcggcgacggcgagagcgttggcagcaaagcctatttgcctgtctggctgtctgtctccaagcttgaagcccacccagttggtgttgtccgggacatcatcacgcacgcgcagagctgacactggaacgactgaacatggctggagatccgggggacgcgccggaggtgggggaaggtggcatacgctctgtgctcaccatgggctcgctcgtcgatccctccgggaacgaggttcagtttccagagatcgacggcaagatgatcggcctctacttcgcggcgaactggtacccgaaatgcgaggctttcaccccggtgctggccgcggcctacgagcagctcaaggagcgcggcgccggcttcgaggtcgtgctggtgtcgtgcgacgaggaccggccgtcgttcgagcggttccaccgaaccatgccgtggcccgccgtgccgttcggcgacctccgctgcaagaagcgcctcagcgagaggttccaggtggagggcatcccgcgcctggtggtgc

SEQ ID NO: 78691 - DNA, 263 bp, Triticum aestivum
  Clone ID: PAT_TA_78691
gctctctgcccttctttcctggcggcgaacgccgccgcccgtggctaggttttcgtcgggcccttcgccggcgacgagcatccaccaggtgaccccgctcccctcccctcccctcccctcccctccctgtccctcacgctctgtgaaaccgagcaccccaagccctagtggggacgactgagctgagctgagcctgcagtagcgagagttgtcgaggcactatgttgttcttctcctacttcaaggagctcatggggaaggag

SEQ ID NO: 78692 - DNA, 526 bp, Triticum aestivum
  Clone ID: PAT_TA_78692
gaaggtccgggtggaggcgtacttctgggacgtgtccaagccggtggagatggaggagattgatagcatggagaagctcgacgacgcgctcaggtggtccgtcgagaacaaccagcccatcatcatcgactggatggctagctggtgtcggaaatgcatctacctgatgcccagaatggagaagatagcaggagaatatcctggagtgaggttttacttcattgatgtcaataaagttccacaagcggtggtgaaaagagggaatgtaactaaaatgcccactattcagctatggaaggatggggagtggaaagcagaagtaataggaggccacaaagcttggcttgtgatggatgaggttagagaaatgatccagcagaacaagtgactaacacccaagttatgcaatgggtattgtacttcgtttaatgtaaatagagacatcagacgatctcttcatatactaagctgaaatcaaatcaataaaaccatatttcagctcaaaaaaaaaaaaaaaaaaaaaaaa

SEQ ID NO: 78693 - DNA, 668 bp, Triticum aestivum
  Clone ID: PAT_TA_78693
ttttttttttttttttttttacactgagaaacagatcagagatggatcctaccttatctcatgcacacaaaccatttccaaaattcaaataagaaagacattcaactgttgacaaaatggtatttcgattctacataactctcagcttcccacagaaaggaaccgaaagtaactgcctccaagaccagatgattcagctctgtaaatgtgattgttaccattctaccatcctttgcattgaccgaaccatcgtccaataccttgatgtctggccgtccaaacaatgcctgagtttgcttctcaatcagtgagacggcttccttcgatctgatagtagcatatctttgcaatgtatcagcatccagtttcgagacataagacttcaacttgttaggatttgatccttcgtcgtccaaacttatctcctccccatcaggtgtaatctgtaccaaggactccatatcccagaatggattaggttgtaggttttcaaatactatctgctgcttggggtttggtgggagagtcttcatagttttctcaagttggaatcgctcatccaccctcttcaggaagtaaccatacatgatggatgctgcatacagctttccaagattcaagttgctgatttcaacaacagtatccggcggggctgctatcttttctcc

SEQ ID NO: 78694 - DNA, 464 bp, Triticum aestivum
  Clone ID: PAT_TA_78694
gcacgagggcgggtgttgcgcgttcgcggcgggggagaaggattgccggcaagggctgctggtgtatggcggcaactcgccgaccaacgaccggctcgacgacatctacttcttcgcgcccgttcttgaagctgcggccgcaagctagcgcgcgcgtctggcaaactggcagtggtgaaatgtgtagcagtgcaatctgcagggcttgtatgtatgtatgtatgtatgttgtggtgaattgtgagtttgtgacgcatcatctttgcggacgtctagttttcttgctgttttcctttggtcggtttgtgggttttatgttgcgtgattgtattgaaacgggcgactgacagtaacgttatagacgtagagtgtacacacgcattgaaaggggaggcgagtgcatgtacgtatatacgtattgtgaaacccaatgaaaataaattaataaaaaaaaaaaaaaaaaa

SEQ ID NO: 78695 - DNA, 405 bp, Triticum aestivum
  Clone ID: PAT_TA_78695
cgaattcactggaggtgtcgtcttggttagccacgactcacggttattatctcgtgtttgtgaggatgagcaaaggagtgagatatgggttgtggaggatgggactgtgaatacatatgacggcacatttgaggattacaaggatgaactcatggaagaaataaagaatgaagttgaagaataatgctgctccaagttagttgtgctttgctggtcttttatagaacaggctgttttcttgaactaaaattgcatgtactattagtgagttttctttactctggtttgcagagtattcatatggttacaactctggaacaatatgagacatgcttgttttatgttatacaagagaacctgagaatatggtattatttgcttgtatgttttgttctgactaaaaaa

SEQ ID NO: 78696 - DNA, 691 bp, Triticum aestivum
  Clone ID: PAT_TA_78696
acccgatggcgcccaaggccgagaagaagccagcggagaagaagccggccgccgaggagaaggcggagaaggctcccgcaggaaagaagcccaaggccgagaagcgcctgcccgcctccaagtcctccggtaaggagggcggcgagaagaaggggaagaagaaggccaagaagagcgtggagacctacaaaatctacatcttcaaggtgctgaagcaggtgcaccccgacatcggcatctcctccaaggccatgtccatcatgaactccttcatcaatgacatcttcgagaagctcgccggcgaggccgccaagctcgcgcggtacaacaagaagcccaccatcacctcccgcgagatccaaacctccgtgcgcctcgtcctccccggagagctcgccaagcacgccgtctccgagggaaccaaggccgtcaccaagttcaccagcaactgagcgacctgcagcgtccacggatttgttaggtctccctttctaggagggttcttcgttgtgtcctctcctcctccctccccctatgtatgtgctcagaaatcgttgatgttctcctcgggaacaaagactaatagctagcttccctgctttataaatcgtgccggattgtaatgcctctcttagatttgctgcccccgttgtggaatatagttgtatcggtgccttctccgcttgctaaa

SEQ ID NO: 78697 - DNA, 617 bp, Triticum aestivum
  Clone ID: PAT_TA_78697
tcgcatctggaagtgcgtgcgtttggatagacagagagaagacccacagatcgaagcggcagcacaacagaaagccgtttaactactgtagcactgtaatccgctaagcaagcgaatcgagctcagagccctaacgagcgtcaatggcggccgagcccgagcccaggatcctagagctctccaacggcaagatcactgcgaggatctccaactggggcgccaccatcacctccctcctcgtccccgacgcccaagggagtatcgcggatgtggtgctcggattcgatgacctggacccgtacgtgaaaggcatgtcaccttattttggctgcatagttggccgagttgcaaataggatcaaggatggaaagtttagactcaacgaagttgagtattcattgcctgtcaacaatggacctaacagccttcatggtgggttgaggggatttgataaggttgtgtgggatgtcgtagaccacaaggatggtgaatgcccatcaataacttttcagtatcacagcaaggatggtgaagaaggctatccaggggatgtaaccattagggcaacatactcacttcctgaagctgctactctaagacttgacatggaagctaca

SEQ ID NO: 78698 - DNA, 718 bp, Triticum aestivum
  Clone ID: PAT_TA_78698
accacaacttcctgtctaaggaagagtgtgaatacctaattggattggccaagcctcacatggtcaaatcaacagttgtcgacagcactactggtaaaagcaaggacagcagggtccggacaagttcaggcatgtttcttcaaagaggaagagacaaggttattcgagcaattgaaaagaggatagcagactataccttcatacctgcagatcatggtgagggactccaagtgctgcattatgaagttgggcagaagtatgagcctcactttgattattttcttgatgagttcaacaccaagaatggtggtcagaggatggctactcttctgatgtatctatcagatgttgaagaaggaggtgagactattttccctgatgcaaatgtgaacgccagttctttaccatggtacaatgagctttcagagtgtgccaaaagaggcctttctgtcaaaccaaagatgggagatgcacttcttttctggagcatgaaaccagatgccactctggacccactaagtttgcatggggggtgtcctgtgattagaggaaataaatggtcctcaaccaagtggatgcatatccatgagtacaaagcttgaggcttggagagtcgaacatacaaaagatggacctctatgcatgtgacttggggctctctacgggattgacactcattaccccaactatagaggaatggtgtagtgtctgggggctg

SEQ ID NO: 78699 - DNA, 380 bp, Triticum aestivum
  unsure (1)..(380): unsure at all n locations
  Clone ID: PAT_TA_78699
ctggtggtggaacgccgctggcctagtgcaacgccagcctgccggcggcgggggcactcgcctcctacctgcagggctcgctcgccgggatgctcggcggcgtcttccgcctcgccccggccggtttctccttccgcatgaactgacgacgacgaccgtgcataattcactgggttgcaatatatgcatcagtcagtattatatctatctaaaagaacaaaactaaaaacttccatgtttatgctggcgacggaccacagttacaaaatacagtaccgtacctcaaaataaatgagcatggataagtatatagtatgatggaaatggaacaatatataagtctgctcttcnaaaaaaaaaaaaaaaaaaaaaaaaaaaaa

SEQ ID NO: 78700 - DNA, 586 bp, Triticum aestivum
  Clone ID: PAT_TA_78700
gcacgaggcatcactttaagaacaagaagtgcttcgtctgcctcaaaccgacgctgggcatcttcaacgctgcacaggagatccgcaagaagatggcacaagacaagaagcaacaggagtaggagagctcaaaacactttagctggtgttgtacaacgatgattggtgttgataactaaagtccggtattttcgccatcagaaaaatgagaagaaaaggtagatcaggacccagttttgaacgattacatgaaggacattcagatccagaccctagtccctacccccagctagtccatcttgctgtcgtgttcatgtctcgtcgcctgccagttggttcctggcgatgggcaaaagctccaaaggtacagtgctagactgctactgtgttgtttgttgcagggcaccagaagatcttacctattatacagtagcaatcgtgtcgtgcagcctggctttgagaattcccggtaggctttgcggcgggcgtgctggcctttgtgcctctgattcccctcttactccatctgcttttgctgacagattaaggcctcttttagtttctattttttttaaagattttctat

SEQ ID NO: 78701 - DNA, 746 bp, Triticum aestivum
  Clone ID: PAT_TA_78701
gcacgagggttttctgctttgatattgagttaggcatacctgcttaggaattggaaactggtattcagcaacaatttacagaatactatgctcatgtttttgaaaagtggcttgagttttcaaaagagaaaagcatgtatggtttggggtttccagaacaattgagtaaacatgaactaggaagatatcccttcgaaagcaaaccttggatggaaggaaacatacagttcccctaagaaaaccacttcaaatcttcttcctgagggagggaataagctcaatcatcgaatattttttaaatttttgtcatgagctttcctcttgttcaaaacaaaaatctctgtctccagttaggtgctacactccttttcgatcatgtgagtccatgacatgctacctttcttcttctttggagtctttatttcgacacatcgattcatcctttcgtttagcatctgtcctagcctatcatgatccaaacagaggaagggtccatcggctgtcattttcaaggcccctactaggctataaatcgatgacagcgaggtccaacccacaaggccacaagtcaccttacactgtagtgcctttggctcatgtgatcaaatgggaaatgtcaatttggtggttgctggtcattttcatgtgacatttgccttcatctagatgtgatgttgtccttcattcacatcgcttctattggaacaattatcctctcgactttcagtttcagtagagctaatgat

SEQ ID NO: 78702 - DNA, 696 bp, Triticum aestivum
  Clone ID: PAT_TA_78702
gttccacatcaacttctgggctcgctcccgcaagagcaaaaagatcaagcgcttctttgctgaggtgcactacaagcctcccagcagcagcagctctgtctgctcttacctgccatttccagtcccaggagctgagaggccacccagcagcagctccgtctcctcggatctgctacttccactcccaattcctgtcgttgaagcatgcaccatcattgaagagcctcttgggcagtacaggaagagctgcgcgttttgtcgtggtcacttagacattttacaccccatgggtcgtaaatttgtttgtggaaacgacaaggaccggtttgagcaacaactcttgccgtgcgggtctatagggcttgagatgccattcacttgccgcctgggtccggcctctgtcaacagtagtcatggggaaaaagaagactagggggaataatgaagtggccccttggacgcccttttgctcgcatcgtttgtgccaatcaagtctggtgataacagaaattgaattgtcttgtactaccttcgtcctcaaaatataagaaaaactaaatgggacatatcctactattatgaacctggataaaaatgattctactcagattcaatagtttcttatattttcaacggagggagggagtaaaacgttagcagtcctcttatcttgtgcagaatatgattgtacactgt

SEQ ID NO: 78703 - DNA, 300 bp, Triticum aestivum
  unsure (1)..(300): unsure at all n locations
  Clone ID: PAT_TA_78703
catcggcgacatcatcatcccgagaaccatctacccttgagcttggcacgaaccggtgcgtgcgtccgggcgtacgtgaaggctatggggggtttttatgtgcgtgcatactgtgtgtgattggttgattattgcgcgcgcgtgcgcacgcagtggtcggccggcaggcagctgctggttggccttgtaatgtaaagcttaagtagagggtgctctcttgtgaatccgtccatcttaatttttgtatcaaacacgaaatcaaactggtcttagttaaactcnaaaaaaaaaaaaaaaaaa

SEQ ID NO: 78704 - DNA, 772 bp, Triticum aestivum
  Clone ID: PAT_TA_78704
cttgagggtgctgcagtccaagttcgacagccaaagtcgctccttcgcacctgataaggaaatagcagaagctctgaaggagtgtcccattgggcaggaaatgaacttgaagcaagttctgaagctgtgcatgcccttcatcaaggataagaaagacgaggcaaaggaggttggtccgcaggcgctggacttgaagcttccgttcagtgagatggatgttctccaggagaacttggagctgatcaagaggcagcttggccttgagcaagtcgaggtgctctcggcgtccaacgaagctgctcgtgctaaagctggtgagcatgcttcgctgctggaggaaaagccaccatcacctggtgtccccatcgccatcttcctcagcaaacagagctgaaagactgcttgcaccgttgctaatagtctgagcatatggcccttttcttgttcattttgccgcacatttaagagtcgaatgttaaagattgagctcttacagtagcattttgttttggtgaaaccagcttcgtgtctgtcaacagagtatgctgtccttcggttttgtgaaaccagtttcgtttttctgtcaacagcgaatgttatgcttttggtctggggaaaccagtttcgttaatgtcaacacagtatgttaatgcgatgcggctttacatcgttctgttctggtgtattcatttctgtgattagattatgtgcagaaatagacgtgaaagctcatgatgattacatgctgagtatcaaaaaaaaaaaaaaaact

SEQ ID NO: 78705 - DNA, 642 bp, Triticum aestivum
  Clone ID: PAT_TA_78705
tctccaccaaatccgccgcatcccgagctccgtttgcaaaattagttgaggggaaatattcctgttatcctcctctatcctttcccccaagaatcggactttatcccgaagaaatcaacgcggaatcgaattcgtttttgagtttatctctccatctaaccctctgtttttccggctcaaatcctctcggttggagtccgatctcttcaatccaagcctataaatagcatcccctagtcgccctatttcttttgcgccatctcccgagctctctcgtgcctcgtagtgccgccgccgcgccacccaaaccgccgccgtcgcccgcctgcgaacagccgcctcgcgccgctgcttgcatcgtcgccgccgcctcacgtcgccgccgttaggtgcgcacggtggagtagaagctcggccgccccctccccgccgtcgccggtcggcggagacccgccgccgccgtcgaccgaatcgccgccgccgcacaagctcgccgccggccgtcgttcgtcgtcgtccgtcgttgttctttgcaccgtttccgacgttccggaggagagcgtttccgttgaggaaggttccgaagcgtttgcggaagcccaagaagaggagtatctcagtgaaggtgatgatctggaggat

SEQ ID NO: 78706 - DNA, 713 bp, Triticum aestivum
  Clone ID: PAT_TA_78706
aggttcttgtgaatgcaagccgagggcccgtgatcgatgaagtcgccctggtggagcacctcaaggctaaccccatgtttcgtgttggcctcgacgtctttgaggatgagccttacatgaaacctggtctcgctgacatgaagaatgccgtcgttgtgccgcacattgcatcagcctccaagtggacccgtgagggaatggcaacactgactgctctcaacgttcttggtaagatcaagggttaccctgtgtggggaaaccccaatcaggtggagcccttcttggacgagaattcgacgccaccgcgtgcctgcccaagcatcgttaatgccaaacagcttggcctgccatcggcaaagctttaggagccaacgctgacgctgccttggctagtatctactacacgtgtcgtcgtctccagcagcacatacactccatgcgtatggttggcattcatcttcagagcagctagctcatctagaatggatggtgtactgtgcagagggtgctccggactagagagctagaatggatgtactgtgcagtcaggcctcatatataatggattactacatatatagatagatgcagcttgggttccggtataacaataaaaacaatgcaagcacatacggctgtatgtgacttgatgcatgcgtgcatctggatccagcgtacgccgctgatgcatatattatgtgaattaatataat

SEQ ID NO: 78707 - DNA, 624 bp, Triticum aestivum
  Clone ID: PAT_TA_78707
gaggctggattgctaggtgccggtgccagcaatggggaatcgccatctgcccagcgctggtccgtaggagtgcctaggggcgagggtggtgacgacggcgagaccctaccagcgctgatccggaggaatgcctagaggcggcgttggcaacgacgacgagaccctgctagcgctgatccagaggagtgcctgggggcggcgacggcggcggcgagaccttgccagcactgatccggaggagtgcctggggcggcggcggcggcagcgtaccaggagcagcggcatcgtggatcttgtgaaccatccttcatcgtctgccacatcctgcgtaccagcaacacagcaacatgggttcgctgtaatcccaggattaccatggagctgtaaggatctgatggaaatttgatttaacgcacaagacctgtccagacagtgtacatatatattgcaattgttgtggttttgcacaaaggagattgcagcaggttttgatgtggctgcctagcagaaactggtcaatggtgagtgcttgattactgaactctgattcagtttattttttgcgaaccatgtgtgcagcaattgttgtggttttgcacaaaggagattgcagcaggttttgat

SEQ ID NO: 78708 - DNA, 695 bp, Triticum aestivum
  unsure (1)..(695): unsure at all n locations
  Clone ID: PAT_TA_78708
cgaggcaagatcaggttccagcagatacacgaggcgtaccaagtgctgtcggatgacaagaggagggcgctgtacgacgccggcatgtacgacccgctcgacgacgaccaggaggacgttgagggattccacgacttcgttcaggagatggtctcgctcatggccaccgtggggagagaggagccagtgtacagcttggccgatctgcagtccatgctggacgggatgatcaaggatttcaccgcgccaccacaacctgagcccagtgtcttctacaccggtggggcatcgggcaaaccgagcagcaaagagcagagtactgcttcgtcacgcatgcatccccaggggttcggtgacgcggcgtgcttcagccggacggctttctcacgatgatggtgataaataaattgtcgagcttttatccataataatccggccgcaatgggttttctagctcgtggaaatggagggagagtaggaactaggacccgtcagagccaacgtccgccatgggcagactctgtctgatttgcaattgctttgcattgtggggggtgaaagaaggtgaggtgggaagattgcangacaaggccacaaaggggtagtcgcgtaggatcgccactcataagaagggatttttgtttcgttttgtttggttttcgtctcctgcctgccatggtagagatgagttgtgc

SEQ ID NO: 78709 - DNA, 446 bp, Triticum aestivum
  Clone ID: PAT_TA_78709
gaggttaaaagtgaaatactgaggatgatgaagctgctgattgaccggaacatctggatcagacttctttttccgaatttctgtttcctgatgttgtggcaatttatgtcaccaatgaactgaagctcactgcaaacaattaattcaggcaattattctgctccattgtacctgaagcaaccgaagttgtgaatatttttcgaggatattctccatcatgctctgccgcttcatttgtacctggaacttatagttatttgtccatgaaccgaatatatcctcttgattaaatgtacgaatggcatttttttttctttgctagtatccgtaacattcctggaaatgtggctgtacgacagcccgatacaggctgtaagcttgttggctcaactatttggttttgtgattttgattgtttgctaccaaaaaaaaaaaaaaaaaaaaaa

SEQ ID NO: 78710 - DNA, 276 bp, Triticum aestivum
  Clone ID: PAT_TA_78710
ggacgaggcttcactggtcgctgcccgacgggatgaagccctcggagctggacatgagcgacgtcttcgggctcaccgcgccgcgcgccacaaggctctacgccgtgccgacgccccggctcaactgccccctgtactgaaagctgaaactgatgacggcgtatgcatgtgtgtttggactctggactttggggaatggggtgtggggagtttagagggctttctctgtcgtcttttttttaatctgtttattataaaaaaaaaaaaaaaaaaaaa

SEQ ID NO: 78711 - DNA, 676 bp, Triticum aestivum
  Clone ID: PAT_TA_78711
gaggtctggttctaccgacggcgttcacgctctacggtcccatgctccccgccgggtgcgcgcgtgacgccgacggccacatcgactgccatccgcgcgccgcgcaggagcgcgccgagcagctcgccaacttccagttctttggactcgtcttcctcgccttctgttatgtgcttgggtgctacgctgtcgctgcggcgaggtacggccacccggagctcgccgcgatgcacgacaagcacgtcgccgcgatggagggcctcggcgacgccggcggcggtgaccgccaggaggagtgcgcgatctagtggccgatggacattggtgttgctctggactctggttcttggatttgatacagctgtataggaaaattcagagtacatcatgagatcagaggtagcttggccattcagagttttcagactttcagaatcagggtagggagtgtacattttgggatcaattcaggcaaaattaccaaagctttttctcttgttatttatacatttatacaaggtttcacgagttgcttaacttatgatgtaactgttactgatttttgatgagggagatgtaaactgagaggaatacttgttagcgcagtggtgttcttgacaattgtggtgtagatgacccaataatgtctgttttaattacagaaaccaaattgtgc

SEQ ID NO: 78712 - DNA, 746 bp, Triticum aestivum
  Clone ID: PAT_TA_78712
ggcacgaggctcatataaagaaatcaagtacaaatgaagaagcacatctctgcccactatttgatgactgaagacaggtagcactatggtagctgctacaactgcggggatgtttcttgtgtgttttgagtccctctgcccctgttttcgctcaaaaaggaaggatggaagcgaagaccatgttcttgcagaacattccaattccttgaattcttctgaaatgaggtcgatttctgatagaattcctgcaagcccgcttcgagtacctgcaagtccatctagattttcattgtcttcttcgccaccaagtagaaacgagcctttaaacctcagtcttgagcatgttgttaaactgacacataacttcgcgccggccttaatgattggcgaaggttactttggaaaggtctacagagtggagctgcgagatgggcgtgtcgtagctattaaaagagcaaagaaggaaaattttgtctctttacgtgctgaattcagcaacgaagtcacattactaaaaaatattgaacataagaacttggtccgattgcttggttgtattgacaaagccaatgaacgcattctcataacagagtacgtatcgaatggcactcttagggagcatttggatggtcaacatggcctagttttggggtttaatcagcggcttgaaattgctatagatgttgcccatggattaacttatctgcatctctatgcagagaggccaataatacacaggggatgtg

SEQ ID NO: 78713 - DNA, 756 bp, Triticum aestivum
  Clone ID: PAT_TA_78713
tgagggagttccacagttttgctaggcctttgctaagcccaaggggagcagcaagtaatgttgaggagcgactcattaacgatacagttaacttccagaacatgtggagcagtgaacaagaaattcgaagcagatgcaaactactttcaaagcaggttgcagatgatggaagggtgtttagtatctggaggcctctctgccctagtgggtatgtctcaatcggagatattgctcatgttggcattcatccaccacatgttgctgctgtctacaaaaatgtgggtggaaatttcgctctgccacttggctatgacctggtttggagaaactgtggtgaggattacaggaatcctgtatcaatatggtttccacggccacctgaaggatacgtagctctcggatgcgtggctgtatctgcttttgaggagccccctctcgactctgccttctgtgttagtgagagatttgcggaagatgcagtatacgaggagcaaattgtatgggcttcgtcagatgcctacccatggggatgctatgtttaccaagttcagagcaagtcactgcaattcatggcgatgcggcggccaaaagaagagtgtgagctaaaacctaagaaggtatcagagtcttatgcccagcaagcattggagaggtcctgagatgagaggcaaacatgccatgcattagtgtagacactagacacatgtaaagtgatgtacataacataggtgcgtatacatgcgtgtaagaaaggag

SEQ ID NO: 78714 - DNA, 191 bp, Triticum aestivum
  Clone ID: PAT_TA_78714
tttttttttttttttttggtttttttcagtatcctcgaatcaatatcctcaatatttttattagctcccatgatccagtaccatagcatatataacaactaatacaaattaaggaaccaatgaagttacatagcatatatagtggcttgaatatataattagccgcaactggaaaaaggggaaataaaaag

SEQ ID NO: 78715 - DNA, 650 bp, Triticum aestivum
  Clone ID: PAT_TA_78715
cttcccctccttctccagatatacttatcagagcagcacagacaacaattctccagatatggcaagcaaaaggattcagaaggaactcatggatctgcagaaggacccaccgacatcatgcagtgcagggcctgctggagaggatctattccactggcaggccacaatcatgggccctagcgacagcccctatgcaggaggggttttctttgttaatatccattttcctcctgactacccctttaagcctccaaaagtgaacttccaaacaaaagtttatcacccaaacatcaactctaatgggagcatttgccttgatatcctcaaggagcaatggagccctgcactgaccatatcaaaagtcctcctctccatcagctcgctcctcactgaccccaacccggacgacccccttgtccctgagatcgcgcacatgtacaagaaccagaggcagcgctatgaggaaactgcgcgggcctggacccagaagtacgcaatgggctgattctgtctcaccgaacaatattgccactgcaaaggtcgtcaggacattgtaagaattaagttggctgatttcctgtggtggccactgcaaagatcatcacaccgtcttaagagcccagatggctgtgtaaattatattagcttct

SEQ ID NO: 78716 - DNA, 523 bp, Triticum aestivum
  Clone ID: PAT_TA_78716
cctgatgtttgcaaggacccagaaaacgcagatttaataatgaggcgagtgatcgatgcctatcagatgttatctggcaaccaagaaatgatggttgaaaggaataatgttgacccatttgatgaacctgagtgtgaagcccgtgacatatttgtcaatgaacttctatgcattggcactggatgcccatattcttgtgttaaaagggcacctcatgtgttttcattttcagatgatattggtacagctcgtgcaatatctcaaggtaatggagaagatgaccttgttcagcttgctgttgggcagtgtccaagaaagtgcatatactatgtgacaccatgccaacgcactattttggaggatgttcttgctagtgtgttgatgccgccttacgatatcgctgaagcagcagttctggattccctcctttcgaaagcgaagtttgagaataacaggtacaggaagcccaaaagaggagcaaaatcatcctccgattatgttgattggatgtgatctgatcctg

SEQ ID NO: 78717 - DNA, 601 bp, Triticum aestivum
  Clone ID: PAT_TA_78717
gaagttgcccacagcagactgatgctggagagttatgtatttcgagtagctctatcccactacctgtgtgggatttccatggacacactgttgttaaggttgcctgtggtaatgagcatgtagtagctgcagttagtgttggcgagacctatactgaaggtgaccttgtttgttatgcttggggaaataacaaccatggtcagttgggtctaggtgacaaggaaagtagatctcgtcctgtgcttatctcagcatttagcgaaggatcttcttgggaggtgtatgaaattgcatgcggggcttcccacactgcagtcctcgcaaataagaagtcttctgaccagatagaatctcggtgctggacatttggccttggtgacaaggggcagcttggccatggaaccacagccaccatttgctcaccacaacctgtcgatggactaccaaccggatccttccttatttctcttgactgtggattgttccacacaaccatagtctcctctgatggagaggtgtggtgctggggaatggagagaggtcttggactgtgcccagatgctagcttttcgggagttgatgaaggggatgctttatatcc

SEQ ID NO: 78718 - DNA, 530 bp, Triticum aestivum
  Clone ID: PAT_TA_78718
tgtgcgcagccagggcaggggatgggacgctgcagtgaagagcggcggcagcagcaaggaccgggagcgggacgggctggcgagcctgaacatcagccagtgcacggcgctgaccccgccggcggtgcaggcggtgtgcgactcgttcccggcgctgcacacgtgcccggagcggcactcactcatcatcagcgggtgcctcagcctcacctccgtgcactgcgcctgcgcgctgcaccctcaccgagccgggcgcgtcatcctctccaaccacgcctactgatcgcattgtggagcactggacctgtggtgctgggatgtgtgcgtaggccgctgaaccgcgcgcgacggggctgttgtgtgaggtgcttttgtggtgtgttgtttgggcgtgtactagggtctctactctctagggagctgtattgaattgaaccgtgtagaagcaactgggttaagtttgttgtctgtaaaaacatggactgtatttgtggccttggcttttgagaaaaaaaaaaaaaaaaaaaaaa

SEQ ID NO: 78719 - DNA, 672 bp, Triticum aestivum
  Clone ID: PAT_TA_78719
cgatttgctactccccattgaggacgccctgaagctcccctggtgtcgatcgagtccggcgacgaagccgatgagatctagcctactttctttatcctcctctaaagctgttgcgccagtctttgatcagcatacacgaaaacatgcgtagagattaaacagcttgtacataccaaagactacacgactacaagagaggaagccgggggaagccacggttgtgcctggctggccggtgcctacattcgcctccacctggtgcaggcaggcaggcatcgtgtgtgtccatgtgtcgatcgtcctgtccgtggtggttcgcgccggcggctccttgttgcggccatgtagagggtgtcctgccggcgcatggtcgccagcacgtcgacgccggcctcatcgctctcgaggtcaagaaaaagaaggaaagcgcaagattgtggaggcgagcgcatggattgtagaaggatgtggttggagtggcaaacctccatttgggggcacccactcggatgaggaaggcgatcacgtaccgcagcgacggagaagcctattgacggcggtggctgagcttcatctaattgttggagagaattcctgtggcgcgtgatctaatttacaaattatttaataatacaaattaattagaaattgttatttagtttactcctttgg

SEQ ID NO: 78720 - DNA, 328 bp, Triticum aestivum
  Clone ID: PAT_TA_78720
ggacacagcaaggagcagccgaggacgtcgtcgtagctgcccagtagaggcagcagctaattaaaggatggtgcttgcatatatgcatgcacaccgtaccgcctacgcaagtattgttgttacatatgtgtgaaaataatacggctagctatcgatgcatgcacgcactcgcagtgtgattgagcttgctagctagctaatgtgattgtgcgggtgaaatttatgtatcgtatatgtaaagagcagcttgttgcatattactaataaatctgttttacattataagaaaaaaaaaaaaaaaaaaaccaacaaaacacataaaaaaaaa

SEQ ID NO: 78721 - DNA, 466 bp, Triticum aestivum
  Clone ID: PAT_TA_78721
tccatatgtattggaagggattgagtttatacaggcccttgccccttggtgctgtccaggtttcttgggtggggggacggtggcgtctttcttggcgttgtattcctccatggaggcgtcacctttgtgggtctcattccagtcacctttccaccttgccatcggtgcatccacggtggcggtggtgcttttggttgtcctggcgacagtgggtttgtgtgggagagaagtggatccttattctctctcgccctccccctctgcactccttggcgagctggtatccgggtgtccatgttgtcctatgtggcttggcattgttggaaacatgtggggcgcttgcggctccttcgttttggcctaacggcggacggtcatgcagtgtggcgcccagttcagtgctaggctgctttcctgcggatggagtgtggtggatggtgcaactgcccgcatgtgacatgctgtt

SEQ ID NO: 78722 - DNA, 740 bp, Triticum aestivum
  Clone ID: PAT_TA_78722
agacaggcccataatatccacaaataggaaactcaacaaaacatgtgtgaaaacgaatcttatcataaacataaagttatcatggaaacaaataaaatgagcacagctcttgattactaacacagaagtaccagtctcttgttagccaagagattaaaaccacacaacctagcagcattgtactaatacaacatcaaaatttaagatagacgtttagctctgttcctctgcctcagcagcttccctctccgcatcagctgccgccatcagctcatcaaatttatccgtcttgcccagcactatttcgatcttggctttctgaatagggcgggcccttgtatcatccttgacatcaactgtggatgtcatgatcttcttttcaacagcgagcccattatttttcagaatttcagcaacagtaaccacagtggcaatggccatgccaagggccgagagctccacctcctcgtgctgctgcatgtacctcttggcgaggttgacgtaaaagaatagcggcttcttggtgttggagacctggatcctgttcttcttgtgcggctccgtaatcgccagattgttcactccctccgtcacctcctccatctccgcaaccacagaaaccctaaccctaactcggcacgaaaacgccgccgcctggaggaggctactgacttggggtagtacaaggcgcggcgcagaaatcgcacgggcagcacaggcgaaagctacagcgaatcggc

SEQ ID NO: 78723 - DNA, 307 bp, Triticum aestivum
  Clone ID: PAT_TA_78723
cccaggcatagcttcttctagctatgagcgccctagaacccttgcttcgtggatcagtgacgtcgtcgccgtcgtcccgagagtgtcccagtacctaagtcagtcataggaaaccaacttgctgctgctaatgttcttcggtctttcacagacccatgcaccatttccttgttttttttctcatccccacttatatgttaattatgtatggattcgtctataactgcctttctcgggcattggaagaagaatgaataacattggtattaaaaaaaaaaaaaaaaaaaaaaaaaaaaaaaaaaaaaaa

SEQ ID NO: 78724 - DNA, 586 bp, Triticum aestivum
  Clone ID: PAT_TA_78724
gtgggttcagatcaggcccaaatcgcgagccgcgatcgcacgcctagcgcgatggcgcacccgatgtacggctccggcccgctccgatccaggaacgcggcaaactcggacgaaatccagctgcggatcgacccggtgcacggggacctcgacgaggagatcgatgggctgcactccagggtccgcatgctcaaaggggtggcccaggagataaattctgaagccaagttccagaatgattttcttcatgaactgcaaatgacccttgcaaaagctcaggctggagtgaagaacaacatgcggaggttgaacaagagcatcatccagcagggctcaaaccatgttctccatgttgtcctctttgcactgttttgcttcttcgttgtctacctcttgtcaaagttctctagaagatagttcccgtcttcgatgggaaaatctaggataccatgacttgtatgtagtctaaagaagaaaaatgctattgtacttctggctggccttgtatcctcagtctttttgtcgaaattcgaaacaaaccagaaaaggaaacacaaagattagtctaaaaaaaaaaaaaaaaaaa

SEQ ID NO: 78725 - DNA, 435 bp, Triticum aestivum
  Clone ID: PAT_TA_78725
gcggtgtccgggacatggacgtcacttgtacaaatcttcagttcttccaacctgtaagagtcgacagtttgattagcaccatgtcttgctaatgcattggtaagcatcgacattctgatatggatcatgccttgctgatgcaatgggagcgctcaaatggttgcacattggttcttgtggattgagagcttgagacccaattcagctgccgtgttgatttgggcatgctttgcatctcttaaaagtatgggataacatacacaaattgttgggagctttctgaaatcttacatggttttggtcagatagagccatgtaggttccagctgtaccaggcagcagatccatgtgtaaagcccagaacgaggaattgaatccatgcgaatatgtacaatataagagtacctactttatgtaaaaaaaaaaaaaaaaaaa

SEQ ID NO: 78726 - DNA, 731 bp, Triticum aestivum
  Clone ID: PAT_TA_78726
cttcagcctttattgatgaatatcgacaaatgccaatttaatgaatgcgtaccattaggcttagatactgatcggtatccaggtagaggagtttttattgcaggaactgcattttttgaaccttattgtacattgattatttacttacagagagcaatttggaaacagatcggataatgcggaaggcattcaaaaatttaaaatgacaatttggaatacatcatgtaatatagctgtaattctgtacatagaatcatagccggagctatagcgttattttattcaaatcactcagtattgtacacaatgttcaacgcagtataaaaacaatttacaagtatatgacctgggaagtctacaaaatatttataagagagcaaaatatattccaggatacaaaaataaatttataaaatgattagtataaattacgtttgttgttaaaaactaataatattatgcttatgaacgcttaaaacaacaagttacgatatgatattatattatatttgttattatattcatataaacacttaaattaaatatattttcattgtttttatatgatatcttactgcatgtaccttcatttcatttctaatttatttaaaaaattgtattatttattattttaagatatttttgacttaattaaaaaaaattgattatttattacgttattatttagttactaaaattagcttaacttagttcactatatatggtatata

SEQ ID NO: 78727 - DNA, 673 bp, Triticum aestivum
  Clone ID: PAT_TA_78727
tagctacatatcagaggtggaccacaaaagaactgtcgcagtggctgacgttttccgttctgtgaatagcccatctgtttttcgattaaggtatggttggttttcccttgctgagcttgaagcaggcgtaagtgaaatatctttgactcattttgagaattgcttgatacctgaagacatccatgccaaatctccctcagaggcttgtgtgcaaaaggatggtaattcgctcagtagttgtgctcctgagcaacacccttgtggttcgaaagatcagtcagcattattgcttgctatgccatctagtacaggcaagagtgctcaggtgccagagcagtgcattgatgttctcccctcacagtttggcaggcagaatcaagaccaagttaccacgaaccaagtttttgaggttgatcaagggatggattgtgctgcagtatctgaaggagagtgggcagatacccttactgatatcagtgttggatacttactgacagaagcttccagaggtgctaatactgattgtccagggacatctgttgtcaaaaacacactgttgcttgagaatccctgcagctatgattcatttgatgctgctgttgctcttcatgcttctcgttataaatcagcagagcagccagcccttgcatcccattcaaccatctggggtgct

SEQ ID NO: 78728 - DNA, 623 bp, Triticum aestivum
  Clone ID: PAT_TA_78728
gagggacttcatttcttggccctccatccattgccttcttattctgtgtgatgttagcattgcagtggatcttcattttcattaaaaatagccatcaaactcctttagtatcccaactaggtatgtcatgatcatgtaactgtgctgggaagatccatctattatgctcatgtttctgccctgccgttcagttttcaactgttgcactcagttttcaacagaaggatccatccatcttgttgctcatcaataaggatttctcagtttattgattatttgagtatcatccaagtgttggcctacttgattggaggtgttgaataacaaatttcataaccttataagaggcaaattttgatggctggctcgatggtcatgtttgtcaggcaatgtcaatggcatcagttcagtattttggaaatggtacggtgtagtcatcatttagatggcattaggttaactggaattgaaataatcgtttagattctttgcccagattcaattacataaagcaaaataggtttactttttttttttttgggtttgcaatgtggaaagctcctaggtgatagatgtggaaatttcaatttgctccttctgttgtaaaaaaaaaaaaaaaaaaa

SEQ ID NO: 78729 - DNA, 411 bp, Triticum aestivum
  Clone ID: PAT_TA_78729
ccgccggagacgctgaacgcgttccacctgatttccctctccgcggggttcgacctctcgccgctgttcgatgtggaaggcggtcccgcgaggtgccataaccgggagggcggtatgcggttcgcgacgcgggagtccgcgagcggcgtcgtctcccgtctcgaggaggtggcggcccgcggcggcgggcggatgcgggtgaccaagagcggcgcccgcggcgtgcggctcgagggcgcggagcgcgggggccgcaagggccgcctagccgtggcggccgacatcttcagcttatcgccgtccgtgctcgtggtggacgtcaagaaggacggcggcgacacgctcgagtaccgctccttctgcagcgaggagctccggccagcgctcaaggacatcgtctgggcggccgac

SEQ ID NO: 78730 - DNA, 623 bp, Triticum aestivum
  Clone ID: PAT_TA_78730
tgccaattgcagctgaggttctgaagcagaagggtgtctacaaccccaagaagcttttcggggttaccaccctggatgttgtcagggctaacacatttgtggcggagaagaagaaccttaagctcattgatgttgatgtcccagttgttggtgggcatgctggtatcacaatcctgcctctgttatcgaagaccaggccgtctgtcaccttcacagaagaggaaaccgaggagctgacaaagaggatacagaatgctgggacagaggtggtggaggccaaggctggtgctgggtctgctaccctgtccatggcctatgctgctgccagatttgttgagtcgtctctccgcgcgctggctggcgatcccgatgtctatgagtgcacatttatccagtctgagaaaactgatctgccattcttcgcatcaagagtcaagctcggcaagaacggtgttgaatccgtggtttccgccgacctcgagggagtgactgagtatgaggccaaggcactcgaggcgctgaaggccgagttgaagggaagcattgagaagggtatcgcctttgcgaacaaacagcaggaagctgctgcatctgtctgaagcgaagcaagtgaaatggaatgc

SEQ ID NO: 78731 - DNA, 386 bp, Triticum aestivum
  Clone ID: PAT_TA_78731
atggttgttctgccaaccaaatccaattgctgtgaacactgctctggctcagctcggggtggcaaggcccgtcttcagactgccatatgttccgcttcctcttgaaaagaggatcgagtttgtccggattgttgaggctattggacgtgaaaattttgtgggagaaaaggaggctcaggttctcgatgatgacgatttcgtgttgatcagtaggtactagtaagtgagttagtctgtattttgatgaataaaactgagagtttgtaccttgcgtttacagacttcgttctgttcatcagtggttggttttatatctgtttattaattaatggcgctaccttggctgcattgtataaaaaaaaaaaaaaaaaaaaaaaaaaaaaaaa

SEQ ID NO: 78732 - DNA, 740 bp, Triticum aestivum
  unsure (1)..(740): unsure at all n locations
  Clone ID: PAT_TA_78732
gcacgaggctccattccatttccgcttccccacccgtcgaggatcgtctcccgtcggtcggcgtccttcgcgatcgtctcgtctcgtttcgtttctcctcgcagccagcctgcctgcctgcttgtctgatcgtggggtgggggatggcgaagcacttcaagtacgtcatcctcggcggcggcgtcgcggcggggtacgcggcgagggagttcgccaagcagggcgtcaacccgggcgagctcgccatcatctccaaggaaccggtggccccatatgagcgccctgcacttagcaagggatacctcttccctcagaacgccgcaagactgccaggcttccacacgtgtgtaggcagcggtggagagaggctacttcctgaatggtactctgagaaaggcattgaactggtcctgagcactgagattgtgaaggctgaccttgcctcaaagactctgaccagtgcagctggggatacctttacatatgagaccttgctcattgctactggctcctcggtcataaagctcactgattttggtgttcaaggagcagaatccaacaacattttgtatctgagggatattgcagatgccgacaagttggttgcagctatgcaagcaaagaaagatggaaaggctgtgattgttggaggtggttacatanggcttgagcttagcgcagccttgaaaatcaacaactttgatgtaaccatggtgtaccctgaaccctggtgcatgccc

SEQ ID NO: 78733 - DNA, 580 bp, Triticum aestivum
  Clone ID: PAT_TA_78733
agggcctaatgtggcccaaagccagcttgtctgcaccgggtgccggaatctcctcatgtatccagctggtgcgacgtctgtctgctgtgccgtttgcagcaccgtcactgccgtgccggctccaggaactgagatggcacagttagtttgtggaggatgccacactctcctgatgtacttacgtggtgcgactagtgtacaatgttcttgctgccacaccgttaacctggctatggaagcaaatcaagttgcgcatgtaaactgcgggaactgccgtatgctgctcatgtaccagtatggagctaggtctgtgaaatgcgcagtctgcaattttgtgacatcagttggggcctcacctggtgcagagcagaagcccagcagctgatgatagtgtccctgaaaatactgagatcacctatgaaggcagcttctgaaaggatgctttgagtgcacatgcatagagttcttccctgaagcaattctttttttttctctcctcatctccattctcccccatccacttctgcgttccttcgatgaatctggcgaacccgcagaataaatgagagttttggaaaaa

SEQ ID NO: 78734 - DNA, 639 bp, Triticum aestivum
  Clone ID: PAT_TA_78734
caccagcggcccttgcgaccccgccgtgcccagcggtgcgggcagtgggctcgacctccaccacaccttacccaaccgcgctgcaccgttcggctaccttgccgtcggcctgaccctgactcactcgccaatcgtcaacctccaaccagcgtgaagcccgtgaattcattccaagtcacatgcttatgcgttctccttcaatctatgcttttccaacttcctctaccagaacatgcagatccaacaactttccatgttcaaagcgaaaatgttgagtgaaagtagaaaggtgtcccaagaagaacaagcctcgagaacaaatcagctcttcaagaaataaggcacgatgtacttagccatgaagacttaggatgatcggcaaatttctctaatttctatgtagtgatttgaagagaagactttgtatgatcggcaattttctctaatttctatgtagtgatttgtaattatccgtacaaagcaaatagtatgtggctcaggtgtgtgctatggtagttcaataaaatttattattgtaccgatgatttaataagttatatgaatcactgtcacagctacatatcctggactggtcctcaacacagagcactggttaattctaaaaaaaaaaaaaaaaaa

SEQ ID NO: 78735 - DNA, 350 bp, Triticum aestivum
  Clone ID: PAT_TA_78735
aaggcttgaagccttccacagacaaaccgagcctgtgattgactattactctaagaagggcttggtggcgaatctgcccgcagagaaaccaccaaaggaagtgactgctgaggtgctgaaagccctctcatgatgaagtgtccactctttaggttaagcatgaaatgtaccagaatccctttgtctgggtttcttcaaaattttacttgcgccaacatcatgcagtgtcctttttgtgcgaatgcaccattttgccaacgctttgacaagctcgggaactgtctgaataatctctgtttcgaatgagagaagctgtttttcagtacaaaaaaaaaaaaaaaaaaaaaaaa

SEQ ID NO: 78736 - DNA, 698 bp, Triticum aestivum
  Clone ID: PAT_TA_78736
gcacgaggctgatttttgtgtgctctcttttcattttagaatggcagatgagtatgatcgcagcagctacagaaggtctggtgctgatgacgaggaaggtggctacaacaagaccaacactggagattatggccgcagcggtgacgactacggtcgtgacactggcctcttcaacaagtccagcaacgacgacaatgaaagtggctacaagaacaccaacactgatgaatatggcagcactggtagctacaacaagtccaacaccgacgacttaactggcggcttcaacaaatccggcacagatgactacagtggtggcagcggctacaacaaatctggcgccgacgactacagcagcagcggtggctacagcaaatccggcactgacaactacagcggcagcggcggctacaacaaatccggcaacaatgactacagtggcagtggtggtggctacaacaagtccagcgctggcgactatggcagcaagtacaaggactccagcaccggcgactatggtcgtggtgacgaatacaagaaatcaagctcagacgactatgatggtggctacaagaagtcaagcagcaacgatgatggctatggcggaagcggctacagcaagccgagcaccggcgactacgacagtggtaagaacgcctccaacactgatggatatggtggcagtggctacaacaaat

SEQ ID NO: 78737 - DNA, 726 bp, Triticum aestivum
  Clone ID: PAT_TA_78737
tgaatataatcaccccaagcagtcatcacaggcgtttgtttacggagggatccttctggctggatttcttgtctactctttggttattttcttctcttcgccagtccgctaattcacatgcgtccagatgaagatgaccctgaattctctctagtatgacaagatggctaagcatgatagaatttgaaacgattgctgaaaagctgtcactgcgatatgcaaggtgtgcccggcctcataaggatgtcaatctgcattcagccatgactagacaatctgctgtatacgttgggggctttctcggcacagttttgtctatgagaatgtttgctctttagtacctacaggcaaccccatagttagatgattcattcggccatcataaatggccgatataatccagaggagagttcagataaggtctaatgcaggccatttacggttttcccctttgccggaatgttacgaaaaacctggtatgttaataaaacccataatcctcatgatgcaaacaattgttttcctttctctaacaatgatttcactctagtgttctacgctcctttgaggtttatttgattcactgcaactacactaaaaattgtacaattatggcctgtggaagggaactgccgaactgcagtataacttattgtagttcttgataaattaccattggatggctactagccacctgtggtctcgtaagccaaaaaaaaaaaaaaa

SEQ ID NO: 78738 - DNA, 709 bp, Triticum aestivum
  Clone ID: PAT_TA_78738
gagttgttgagcaagaaccgaggcggatcgccttttgttcctcctgccgaggactagcctgcctgtcggcgccgcgagagatcaagaggaggcgcggttcagtgattcctacaggggagggagaagaggaggaacaccgggggcggagagagatgatgcgggagatgtatatggacgtgctgccgccggtggaccacatagccgcacggagcaactggttcccggccgcggcgcgtctctggacggcggaggagaacaagcggttcgagtctgcgctcgccgggctcgacctctgccacccggactgggagaaggtggcgcaggccatccccggccggacggtccgcgaggtcgtcagccacttcaagaacctccagctcgacgtccagcagatcgagagcggccaggtgcccttgccggtctacggcagcggggccagctcgttcactctgcagtgggacggcaatggcggctacgggcccggggacttcaggcacgggtaccgcttcggcggaggctgcgggaagcggcaccatggccgcacgccggagcaggaaaggaagaagggcgtgccatggacggaggaggagcacaagttgtttctcttaggcctgaagaaatatggcaaggggggattggaggaacatatcacgcaacttcgttcagacgaggacgcctactcaggtggccagtcatgcgcagaagtact

SEQ ID NO: 78739 - DNA, 700 bp, Triticum aestivum
  Clone ID: PAT_TA_78739
gaggagcagctcggcactcctccacccaggtgttacatacgctgtcggccgggtcctcggagcgcgggagatggcggatcaggagaccccagctgtggttgaggcacctaccccggttcttggggagccgatggacctgatgactgccctgcagctcgtcatgaagaagtcaggtgctcatgatggccttgtgaagggtcttcgtgaggctgccaaagccatcgagaagcatgctgctcagctttgcgtgcttgctgaggactgtgatcagcctgattatgtcaagctggtgaaggctctctgtgctgagcacaatgtccacctggttacggtgcctagcgctaaaactcttggcgagtgggctgggctttgcaaaattgactccgagggcaaggcaaggaaggttgtaggctgctcctgtgttgtggtcaaggactatggcgaagaatctgaaggccttaacatagtgcaggagtacgtcaaatcgcactagatacacactatatagtgtgccagtatctggaacttgtgttctactacattttgcacctgagtttaaatttgtgcttggttcttgggctttgctaggagattagaacaattttcaagtgagccaaggattcatgtgaacgatttggacatctcaactcttgtttgaagtgctctcatctactgttaatacaaatcagcaagagccagt

SEQ ID NO: 78740 - DNA, 432 bp, Triticum aestivum
  Clone ID: PAT_TA_78740
tctgtttgcttcatgttgcgcaggctcagatctgattgctggattcggcgtctttcgtcttgatgaatcgagcttggagcgcgtggatctgagcaccggggatacaccaaacgcgcgcgcatgacgcgttggatccggcaccggtttcagatccggcgaaatcgcgacactactggtggttccgtccggagcggatctgttgcgacgatggctgaagaaggcggcggcggcggccgcggcgggatctattggtctgctctacctcgcgggatgattgtctctgcgctgataattattggatgaatttcgataattattagtagatctaagagatgtggccgccttgaagaggcgaggtaagatgcaacatgtaagagtcgagtcaagagtctctgcgtgcgtcggcgaaaaaaaaaaaaaaaaaaaaaaaaa

SEQ ID NO: 78741 - DNA, 303 bp, Triticum aestivum
  Clone ID: PAT_TA_78741
ccctgccttcttgaattgctgccaggcggcgccagcagccacagccacagccagtgcaattgcacggcagccaattttcagagcagcagtagctatttagcgattcctcaattaaccagtcaaatctccacatcctttccccaccatccactttcctcccaaggctcccatggacaccgccgtctccaccctcaccgctctcgccatcttcgcgagcaccgtcgagcacgccgcctacaggagcgtgcacgggtacagggtggtcgggaggaaacgcggcgggtgggttcggtgggagaggtg

SEQ ID NO: 78742 - DNA, 245 bp, Triticum aestivum
  Clone ID: PAT_TA_78742
gcacgagggaagcactctacagaaggcacgcacaggaaggctgaatttgcctgtttgtggctgaatatctgtgcatctgtgttggttccttggattggtttgcatttgtgaacaaactctgaaagctcaaaggcaagaccccaccttgtacattctaacgctgtcagcttgtgtatccattcatataaaacccataaatctgttcggcgtgcgtgggacaaaaaaaaaaaaaaaaaaaaaaaaaa

SEQ ID NO: 78743 - DNA, 471 bp, Triticum aestivum
  Clone ID: PAT_TA_78743
catggacgacatgagggaagaagcacgcagatatggtaatctggtgaaagttgtgatcccacgtcctgaccccagtggacccccggtcactggagtcggaaaggtgttcttggaatatgcagacgtctacagtgctaccagagcgaagatggctttgcatggaaggaaatttgatgggaagccaatggtggccaactattatcctgagcttaagtttgccaatttggatttcgatggataattgcaccaagattctggaagggagaaaaaggatgataattgccacgtagatctttatgtatgtagacatactgtttgcgcgaataatggtttgttctcttacagtacgaaaccgacattttgaccgtggatttatacggatccacaagaggttgtgaatatgaagccagtggattgctcaaattttggctagatttttactttcttaaaaaaaaaaaaaaaaaaaaaaaa

SEQ ID NO: 78744 - DNA, 604 bp, Triticum aestivum
  Clone ID: PAT_TA_78744
gaggctctcgcacgtcgctccccaagtcatcccatccctacgcccgcggccgcgccaccgagtccagaagcttctagaagggggaggggtggtcgcccatgaccgtctgatcggccgtcgccatgggatgcgctggatccactctaaagcctgaagataatggtaagaagttgaaaaaaccaaagccttggaagcacacccaagcaataacgccggcacaactcagacagatgcgtgatgaattttgggacactgctcctcactatggtggacagaaagagatttgggacgcacttagagctgctgcagattctgatttagcgcttgcacaaaccatagtggatagcgctggcatcatcatatcaaattctgacatgacactttgctatgatgaaagaggtgcgaaatatgaacttccaaagtatgttctaagcgagccaacaaatttgatcaaggacggttaaattcataaaataaaaaggggtccagtgtaaattatgtaaatcacatttgttcactgacatcaacgttgaccttgattgggacttcaataatattatgattatgatgtgctagattctgatttgagctgttctcctaaaaa

SEQ ID NO: 78745 - DNA, 659 bp, Triticum aestivum
  Clone ID: PAT_TA_78745
aaaagtgatgacgagataacttattatatataaactttaattaatgacaattgttcccggtctattattgaccattgatgtgaacaaccaatcttcatttcttcttctttggccaaaatcatgtaataataaatcaaatcataaagtcttaatgtaccaagatcttatccgagattagcaacttttgacatattatcattattattaccaccactattactgaataagctttaaataaaatcaaattcaaaaaaaatatttcatgttgaagaagaggaaaaagatcagacatgattaatcgtaacgcatcacaaatattcagtacattgtaaacaacttttcatatgtatgtaaaaactaatgcaagattgatttgaataacttttgcatgatgataacaattcaaagctgttttatttggtaactgagatcaattacttttggttacaccagttttttttcctgtcacaatattgatttcattgtattttaattgtctatcatttgccaaagcgacgaaatttgttttcatttattgaccagaatttttaactaaaatttctgctatttaggttaattaagtgtgatacaagtaaacattcaatcattcaaacttctattgattaaattgatttttgcctcaaaaaaaaaaaaaaaaa

SEQ ID NO: 78746 - DNA, 777 bp, Triticum aestivum
  Clone ID: PAT_TA_78746
tgttatggctttttgtgtgcagttttgagaacctttctccagcgtcaagacatgcattgagcttacatgtagttgatactgaaggatgtgaatggtccaaagacaactggttagttcataatggcactattgaagtattcttcttttacaatactgttttgattttcctttacgtctagaaggtcttggcataattgactagaaatgcttataaattctgtcttcaatcttgaatgggatgtggctagcactgtttctcttctgaaatcaaacttgtgacaactgcataattttctcattggtaggttcatatgatagtttgcacttctcactaaaccaaaacatattagtgcttggtaactcacattaacaaacaaaataacacactttgtgcataaagttgccgtttgcttattaggtttgctgtgcaacttattaaggtgctgatctagtcatacttatgatagtatgatgtttcagttgacaatgttgctcttcagtgaattgataatagtggtaacagtagaacatgggagaattaggttaatgtttcagtaatatagatacacctgattattatgaaacgaggcaactactagtttgtatgcattgctgaacatgtacgcctcatgcccacagtaatgatgcacataagggggctcaagattatatgaacagtgattgcgattaaaattccagtattctttatacatgtgcattgtaaatgggcccataagtatatggacccatccttaatagacaactctattaacccat

SEQ ID NO: 78747 - DNA, 627 bp, Triticum aestivum
  Clone ID: PAT_TA_78747
gcacgaggcgcacttgtagctctcgacccccgcatctcatccctcctctcgcttagttcagatcgaaatcgcaaatggcgaagattaagatcgggatcaatgggttcgggaggatcgggaggctcgtggccagggtggccctgcagagcgacgacgtcgagctcgtcgccgtcaacgaccccttcatcaccaccgactacatgacatacatgttcaagtatgacactgtgcacggccagtggaagcatcatgaggttaaggtgaaggactccaagacccttctcttcggtgagaaggaggtcaccgtgttcggctgcaggaaccctgaggagatcccatggggtgagactggcgctgagtttgttgtggagtccactggtgttttcactgacaaggacaaggccgctgctcacctgaagggtggtgctaagaaggtcgtcatctctgctcccagcaaggatgcccccatgtttgttgttggtgtcaatgagaaggagtacaagcctgacatcgacattgtgtccaatgctagctgcaccaccaactgccttgctccacttgccaaggttatcaatgacaggtttggtattgttgagggtttgatgaccactgtccatgcaatcactg

SEQ ID NO: 78748 - DNA, 384 bp, Triticum aestivum
  Clone ID: PAT_TA_78748
cgggagatcaggctgcagctggagaaggaggagcaagccgccgccgcctgacgcgacgcgactgacgccatgcgcacatgcacaacaaccacttcgatcgagtccgttctccgttccatggcgcgccgccgccatgtccggccgccagtcgtttgtatagcagagcactccatgtcatgtcatgtccggccgccatgtctggctgctaggatcttgcagatcatcatctcttttccatgtgtgtgtagcagagcactccaagatgatcgatcttgtagttgtagcagagaagatgatgagtagtgaggatttttgattttgtaagaaggcgcgcacgcgcgcgtgggaataaactaaggattagacaaaaaaaaaaaaaaaaaa

SEQ ID NO: 78749 - DNA, 768 bp, Triticum aestivum
  Clone ID: PAT_TA_78749
aagtgtagttatacctggagcggcagtttcagcattgcaattcaacattataaaagaggaaccatttatggttcacaatcttgaggtttgtaataggaaactgcaactagtaaatgtaaggaaataaggtccccctacctgtgtcattatgttttataatcgcaaagtacccgcctcgactcagtggatgctgtatgggattgggatacacagttataaacttgtgcttattgccttattttggtgaattatcatgtgataggttcaattaattaattgagaatgtttaagtaaatagaacttattggcagaaacaaactgatcaaatggttcaaaagcttgggtgcttgttcaattttataaataaaattgaatgggatgtactgaagcatttccctttagtaaatgagcagtttgagctcctattttcagtgatttgggttagaatgactgccagaagcaaactggcaatacttgccagcatgtgaattttagtagacctgtcatgaaactgtcatttgttctttaaagtgattcctttacctgtttggcacggtcagggttaccgctcgcttggttttcgtttcggtgatgtatgctatataagtgatgtcagtgatatacctgaagaaacatacaagcttctggaaaactgtgaacttcttataatggatgctctaagacctgatcgttcttcatcaacacactttggactaccaagggcccttgaggaagttaggaaaatcaaaccaaagaaaacactcttta

SEQ ID NO: 78750 - DNA, 670 bp, Triticum aestivum
  Clone ID: PAT_TA_78750
acctctgtgactactccaccatcttctcctgctacaagctcatcttttgcttttagttccagtccagcatttttagcacaatcagtattctccagcaaattcactgcacctgctgcaccttcatatggctcaccaaatactggtcctgctacatcaccattcagcccaatgccaagcgctgtattttctttcacatcagctactccttcaataccaaatccacccacaccaatatttggtcaccctactgtacagatgaatggagggaacatggttgttgacgggaatggatccccttccccagcaacttcaccatttggcctgcgaagcagcgcttctcaattgactccaactttcagtatgcctgcaactcaatttgcttctggtacatctggctcagctggagttttcgaagttggccagtatagtcaagtttcttcaggtgggttctcaatgggctctagtggtggcaatgacaaatccggcagaagaaccatcagagttaagagaaggaaatgaaatgccaatatatttcaagtagcaagtaatcctttctcataaatattagcatttaaggctaagaccatcagcacgtaaaactttttgtttcacatcatttatttgctgataatgagaatgagatgtctcttaaattgttgatcacaatttt

SEQ ID NO: 78751 - DNA, 615 bp, Triticum aestivum
  Clone ID: PAT_TA_78751
tatgggtctttgaagatcccagagtttgaaacggactggaagaagattatcgaggaacatggacttggagaaaacggttgcctcagttccctttatgagcatcgccaactctgggcacctgcatatctgagagataaattctgggcagggatgtctatttcacagcgtggggagtctatttcctcatactatgatgggtttgtgtacccaaaaacttctttgaagcaatttttcagtaaatatgagatgatattagagaacaaatacaagaaagagtggcaagcagatgaagaatcttcccataggtctccattgactgtaacaaaattctacatggaagagcagctggccaaagcctacacaataaacatgttcagaaaatttcaagatgagttgaaagcaacaatgtattgcgatggtatgccaattaaagttgatggccgacttgttacttttgaagtgaaagaatgctcatacatggaagatggaaaggacacagagagcaggacctatgaagtttacttttgtaaagaagagcccaaagttgaaattgagtgtgaatgtggttttgttcagttcactggcatcctgtgtagacatgcactgtctgtgttg

SEQ ID NO: 78752 - DNA, 532 bp, Triticum aestivum
  Clone ID: PAT_TA_78752
ggcacgagggatgctggttatgcggttggtgcaagggtgcttgaactactctgtcacacggagaaggaaacgcaaaggcgagggcgactccaggacctgtaaaaacgccggattgacggcttcaaggacggtcgcagggctgaggtgggcaacgcaggtcgggctcgtgcgtcggacgacggcgtcgggcgagggcgagggcgaggtcaaggcgcagatcggcgagggcgtcgggggcgactctccagaccaggcaatgcgggcgtcgggcatcggaggcgagggcgacggtgtcgggggcgaggacgagggcgactctccagacctggcaacgcaggtcggcgtcgggggcgagggcgacggcgtcgggggcgggtcgggcgtcgaaggcgagggcgacggtgtcggggccgagggcgactctccagacctggcaacgcaggtcggccgtcgggcgtcgggggcgagtgcgagggcggcgaggacccaggacgatcgagggagaggggcgacgtcgggcgagggcgagggc

SEQ ID NO: 78753 - DNA, 734 bp, Triticum aestivum
  Clone ID: PAT_TA_78753
gtactaggtcactggcttgctggtgtgccacaggggcatggtcgcaggcctgctgcttggcttctctgccacacgcaagcggtggccaactactgtgcttctgtacagtcttccagcacaaccaaacagcaacaaaggccagaggcgcaaactccacatcaggttgttcccattttcagatttccaatctaccaatcccaaaataatgcggtattgcagcaaagctacaaccaaacagcaacaaaggccagaggcgcaaactccacatcaggttgttcccattttcagatttccaatctaccaatcccaaaataatgcggtattgcagcaaagctacaaccaaacagcaacaaaggccagaggcgcaaactccacagcagcagagttcagagcctcaagagttgctgacgagaaacgttctacctgggatgattttatcactctaatagcagatgcagatgtcaggattatcaagaaatagcaaatccttatcaactggttagtttatattggattgatggaagaagcatgataaatggagagaaatccagtcttctgtgcttacctaaggtaactattctcctctgttgcctttttctcatgctccttttgctaacacatcaactcctttgttctattttgtaatgaggtaatcatgatataaagcttcaagaagtaaccaactgttactttttttatatcaaaacaactagaactaagtaaccaacaggtct

SEQ ID NO: 78754 - DNA, 723 bp, Triticum aestivum
  Clone ID: PAT_TA_78754
gaggcctcgtgtcgagcttacacgagcgctagctaacgaaggcacagcgcgcttcgcgcgaaagatcggaagagatgtcgaggccggccaggagcgacgcgcacctgtccccggagggggaggcggcgatggaggccgaggtgcgggagtactacgacgaggcggcgcccaagcgccactccaagccctcccgcagcgagccctccgccgtctacaccgacgcgctcgtccccgacgactcccaccccgagctcgacaggttccagcagctcgaagcccacaccgagaaattggtgtgcgagggtggcaaggcaggggatgagttcgtggagacggagtactacaaggatctcggctgcgtcggcaagcagcaccacacgactggaacagggttcatcaagatggacaagccctcggcggacgcgtcgtttcatctgtctgatgacccagatgcatcggagcgccatgcctcctgcatgggaaatcctgctacaaacgagtggatcccatcagctgacacgttgttggtttcaggtgtatccggcgtcagacaagcccaacagaagtgacagctgagcaacgcgcgctctacatgactacacgtacagccagatgtatgcattccaccagcatataaagaagccacacttgattattcacataggacacatgcatctttactgttctgcaaggagtttcttgtggtgttaaccgtgttgtact

SEQ ID NO: 78755 - DNA, 784 bp, Triticum aestivum
  Clone ID: PAT_TA_78755
ggacgaggcccatgacaatctaccagcatttgctaataagtatattatcttccgtcggggcattggaattgatacggacaactgcactatcttcttcatggaaaaaagtagatgtcatcatatctcgagcatggaggtcattgcttccagtcacaaggatcgatagattgttctacgaagaaacaagtacggtcaagaaaggacacaaagaagactgacgaaataaatgatgatgtagaagagccagatctctatgttgagcgtgttcgtctagagaaaatggaactgagcataaagaatctattaagaaaaatgacaattcaagagcctacatttgaaaggatgatcgtagtgtataggagggctagctcagaaagtaaaccagatcgagggatatttgtaaagcacttcaagcacattccgatggccgacatggagttagtcctgccagagaagaaaaaccctagtttaacaccgatggattgggttacatttctagtttctgctgtgattggtttggtcactctaataggtagtttagaaatgccaaaggctgacatatgggttgtcacagctatcttatctggtctgattggatactgtgcgaagatatacttcacattccaagcaaatatggttgcataccaaaacttgattacaaagtcaatgtatgataagcaacttgatagtggaagaggaacacttcttcacttgtgtgatgatgtgatccagcaagaagtgaaggaggtcatcatttcttactatattttgatggagcaaggaa

SEQ ID NO: 78756 - DNA, 349 bp, Triticum aestivum
  Clone ID: PAT_TA_78756
gcctcatgcccggcgcggacgtcggcgccgagcaggagccgaccccggccgccgccgcgaggggcgaggagatggctgggcccgcctccacggcggcgccgctcaccatcttctacggcggcagggtggtggtgttcgaggacttccccgcggagaaggcggccgaggtcatgcgcctcgcagccggcggcgccgagcgcgcggcggtcccggccccggccccggctccgcgcgacgacctgcccatcgccaggaaggcgtcgctgcagcggttcctggccaagcgcaaggaccgcctcgtggagcgcgcgccctacacccgcccgtccccgtcccccgcggaggaggc

SEQ ID NO: 78757 - DNA, 757 bp, Triticum aestivum
  Clone ID: PAT_TA_78757
acttggaataatcgaagacactgctaacagagctcgcttagcaaaactagttgagattccaaacatcaggtctcgaaaagggaaaaatggtctctcttggtgattatgtcaaacggatgaaagaaaaacaggaacacatttattacatggccggttctagcttcgaagaagtagctagctctccatttgttgaacgtttattgaaaaaaggttatgaagtactttacttgaccgatcctgttgacgaatattgcatttcagctatacctgaatttgaaggtaaaaaattccaaaatgttgcaaaggatggtcttaaattgaatgaatctaaagaaaaacttgaagctttacaaaaacagttcgagccattaactaagtggttagaaggaactgcacttaaagaaaaaatttccaaagcttcaatctctcagcgactccatgattcaccttgtgctcttgttgcaagtcaatttggatggacgggtaatatggaaagattagccaagagcaatgctcactctaaaagcaatgacgttactcgtgaatactatttatcgcaaaagaaagccctcgaaatcaatcccagacatccattggttaaagagatgcttagacgtgtagaaggtgatcctgatgatgaaactgccaagaatatggctgctctcatgtatgaaactgcaacccttcgatctggttatatgttatctgatactcagtcatttgcatctcgagttgaaagtttattacgaaaacatta

SEQ ID NO: 78758 - DNA, 514 bp, Triticum aestivum
  Clone ID: PAT_TA_78758
ttgcactcttactactgttcacagagcagtttactaatactagcgtgtctgctgctgtgttgcacttgcaccggtgtcactggcaggtgcgccgtggcggtgaccggtgggcaaagacagcaagagtagctgtacctggactggaccagaggacgagcgagagcgagacagccgccgggacagccagcgacagccggcctgtcatcgctggtggcggggcggcggcgctgcatcgccccttcggcggtgctgcggcggccggtggcgcggcggggaggccgcggaggccgagcatggctggctacttcgcttgctggtagcctgacagtatgctaaggcccagcgatgcgaaggagccaaggaggatggagatggatggattgcatggaggtgtaggcatgtagcactagtggattggtgggggcaagtcgccggtgggaaaggatgggtgccgacttgttctcttgtgaaccactaaactaaaagctaaaacaccatctggggattaaaaaaa

SEQ ID NO: 78759 - DNA, 450 bp, Triticum aestivum
  Clone ID: PAT_TA_78759
gaggcaaccagcagatgttccacaacaaccaagcgatgcaatccatgctggcaacgcaccagctgcagcagctccagctccactcccagcctcagcagcagtcgcaacattctcagcaccagcaccagcaccagcaactgcattcgattcaggcgcagcaacagcagcagcaactgcactcgctgcaggcgcagcagctccagcaggtggcgagagacctcaagatgaaagcgcatctggccggccaaggtcagtggggcgatgggaagtctgggagcagtggcagctaagctttactggcactggaatattttggtgcacgtggtggttaggagtggagatcctttgttttggggatgttgatgtgcaagtgtagatatcgataactcagatatctatctataggctcagttcagcttcagttttatcgataaaaaaaaaaaaaaaaaa

SEQ ID NO: 78760 - DNA, 659 bp, Triticum aestivum
  Clone ID: PAT_TA_78760
gagggtggtttatagaaaatgagggaccttggaatttgcaggatattagcaataatgaagacaatggtctacagaatttacaagatgttaacaataatgaagatgtcaacaacaatgcacctgtgaagagtaaagttgaatgggattctgacaatgataacattatcgaccttgaatctgatgatgaagtgagcttcatgggatgcaatactgtccttgggtttcatccttacaaagacgtcatcttcttgaattttgcgcttgaaagggctgtggcctatcatctgaatacctccgtggttcaggatctgggtaaagtaaggccagattattactgtggttatgcggcagaattattatcatctttcctgtacacaccgtgtttgatggcagagttccccgaggaaggctagcttatttgttagaaacagtttgaacccttaggcagttgggcttatggcatcctcgttttagttcatgttattagtttaatgtcgtagtcttgagaagaaaaactcgtatacagcttgcattacattgggacatgtattcatgtacccatagctttgatgttattttatgaactcagtttgaacccttatcccctgcaaacttattttatgagatgaatgatatattcatgtatccatagctttaaa

SEQ ID NO: 78761 - DNA, 278 bp, Triticum aestivum
  Clone ID: PAT_TA_78761
ggcacgagggaaccgcatccagaagctatcacgagtcattgacctgtaggtgttagtgttggagctggtgcttgccaaaactctgctcgagctcccccgcacgagtaacttatttgctttggtcccaggggactacgaacagtacttgacttcgcattcgaagtaggttacgaggaaagagagcttaacaaaatcagcgttaaatctgagaatttgagcttatgtaacctactatatggatcgatgaaagttcagacccgttgtttctaaaagaaaaa

SEQ ID NO: 78762 - DNA, 467 bp, Triticum aestivum
  Clone ID: PAT_TA_78762
ggcacgagagcttgctgcagtggcagctctatgcgttcaatacgaagcagagttcaggcccaacatgagcatagttgtgaaggcgctttcgcctctccttcaacaaagacctgcaccagccaccgcagagccagccccgcaacctgtgagctgaaaccagtcatatgtgatgggaccctcggcatgcattcaaccagcacattctatgagtcattgagagtattttggctatttgttctgtagcattctcagttgggtacagcatacatgaacttgcctctactgtttgtggacaacaacagttcgtggcttgatgttggcgccacacaatggtatatgcagtaggctcgaagttgtttttttaccttctctaccaataccaactgtttgtaggtttcagaattcgttgcttgaagaatgatgcagaatgatctggactttttaaaaaaaaaaaaaaaaaaaaaaaa

SEQ ID NO: 78763 - DNA, 705 bp, Triticum aestivum
  Clone ID: PAT_TA_78763
ctgcatgattactacaggaaaagttgttcaagattgtaatgttcgggttcttcgcaaagggaaagaagtatatgtgggttcgcttgattccttgagaagggtgaaagaagctgtaaaggaggttggtgctgggctagagtgtggtattggggtagatgacttcgatgaatggcaggaaggtgacatcgtagaggcattcaatactgtgaagaaggcaagaacactcgaggaggcctctgcaaccgtgactgccgcgctcaaggatgcaggtgtccagctgtagaattggcaacgctgataagaaagaagtggtttaacagttgcagcagcagcctgtggccaacaatttttttggcaacgaatctggagggcactggtcgaagttctgaagaataacaagcatgttgctgtacagacttaacatatatgaagatcaattctacagcaccggtgtctgagctcgacgaccatctcgcgcctgccagagctgcatctgctgctgaaagttgatgtacatagagaagatgggatcagctgttttaccctttttagtttgcctctaatagtgacaggtagataacgggtgtctagttttgcaactattgattttattttacacaagatgtaactgcaacggcgacaccgccgccattgttgaaccgtcattcatactcttcatgatagatatatagagttaatagaaat

SEQ ID NO: 78764 - DNA, 768 bp, Triticum aestivum
  Clone ID: PAT_TA_78764
gaggcaaacaatgagacaaacggaaatctggaaagcacacaagaaggccagtcgaacccaacgagcatgatccattacagggatacacagagaaagatagttgagtttattagaaagagataccatcttttggagagatgtttgaatcttgaatacgctgtgattaaaacaaaaacccctgttcctgatgatctcgctgaacaagattttcctggtggtcatagaccggccgttccagactacagtgaaatgctgagagaattgcctgtccttgaacctatttccaaagaagtggcgcctgaaggcacaactgatcagtcacaagtttcccatctttacaacaagatgtgctttgtccttgaagacagtgctgttcctgcactcaactcgcatttcggtgacaaggcagcttcctccggtttagccaatagcctccataagtttgaagctgtatgcgaagacgttagtcgcatcttgagatcccatgaaaatggtaccactcccaaagaggaagttatgctagatgcaagctccaaagagaccacgtctccaaaagatccagcaaccgaggtgccttcgtcagcttccaaagaagctacgcctccagtacaagatccagtcatagaggcagtgaaggaggagccacccactgttaaggcggaggacaaaatggaaatcgatagttaatttgtaggaatcataacgataatatcgaacctttttcgtctaatctaatcgctaaactggctgtagcttttaccatattac

SEQ ID NO: 78765 - DNA, 748 bp, Triticum aestivum
  Clone ID: PAT_TA_78765
attgtgaaagatcagttagttgaaaattctgagagaagccattttgatgagaagactaatcatcttcatggctctgctccaattggtgagaaggttgaaaggcatgccagaaacagagatagacctgatcgtggtgtatgggcgcctcgccgctatgacaaatctacatctgggggtggttcacatgcctcatcgtcagatttccctcaaatacagtcacattctggagataatgtttcgcaaatagcagatggtcatggagacagaaagacagacacaaggggtcatggtggtagccgtggtgttcctgttgaaaatggacataggcatgccaaccgccgtggtcctccacgtggtccaaaggaaactgaaatatctgctagcgtgcctgatggaaagaattcaaagaggggctctgctagttatggtgctcatgagagacaagtatgggttcagaagtcaagttcaggctcgtgagtttgttcattgatgatactcccatcaaaacaggtattgcaagtcgtggagaagtcttggattctgcagcgcattcttctttgttagctgttgatcctgtgaagtatgttaacaaaatgtccaatggttaaatgctgccatgaagtgcaatctcagatttgtcaatcgaagtctcagctatagctgaaaagagagcttgctgatttgattcacagaaatagtgaagtaacataacccggcatgtaggtagctctcgataactttgggcaag

SEQ ID NO: 78766 - DNA, 785 bp, Triticum aestivum
  Clone ID: PAT_TA_78766
gaggagttattacaacccaaggatgatacatggtctgactgtgctaaaaatggatatgcagtaaaaccggtaaagggtgatgcccttctgttcttcagtctccaccccgatgcaacaacagactctgacagcctgcacgggagctgcccggtcattgaaggtcagaagtggtccgcaactaaatggatccatgtgaggtccttcgacatctctgtcaagcagggagcttccactgacgggtgcgaggatgagaacgtcctctgcccccagtgggctgcagtaggggagtgtgccaagaatccgaactacatggtgggtaccaatgaagcacctggcttctgccggaagagctgcaatgtgtgtgcacagtaagttactgatccacccttgtgatacatagcagcacgtcctcgataattgttgccgcggtaccgggtgtatataggactgagcataggatgtgtaacctggaaggagttaagatgtactaagatccatttcgcctatatgcacctcgaaaaattatagccagactcttgtttctgttcattgttcaagctcgaggctagttactcattttagctgaagcaatggaatctacgaccacggattgtacactcttctttgcttcactttctgtggcaatcgattgcttttcttcttggaaaggaaagtaattcttctggtgaaactggttgcttgcaatttacaaaaacgagagacaactcaattgatctggagcagatttgataagtagactcgtagtatgtatatatcaaaaaaaa

SEQ ID NO: 78767 - DNA, 578 bp, Triticum aestivum
  Clone ID: PAT_TA_78767
ctaacaacaaatcaccgaccgatctattccctgccgaatggggggttggtgcgatctttggagaggagtgccagaagcgcggcatgttggtcagggttgccggcgacgcaatcatgatgtcgccgacgctgatcatgacatccgctgaagtcgacgagctggtgagcatctatggggaagccctcaaggccacggaggagagggtggcagccctgaaatccaagaagaactagcaaaagggcgaggacgacgacgataacaccgggcggagctgatgtacaggtgaaataaaagttggtggctgcgagatggcaataacgcaccggaacggtcgtcgctgttcttgaagtgcaaggtcgcagctgctcggtcactaagcaatggtgactgaccttttaaacaggacatagatgtttttttccccctaagcaatggcaatatctcaaatgtttgctgccctgtacttcctgaagataatttgtttcaagtatacccttactggtagaatattcagatacataactttgtaaggcaaaacaatagtaaatggtcccaaataaagtgaaggaaaaaaaaaa

SEQ ID NO: 78768 - DNA, 322 bp, Triticum aestivum
  Clone ID: PAT_TA_78768
gaggggtggtcctgttggccgaggcagcgcacctcctgtgaggaggtagattcttcatggcgtcatgcggcttttctcgtttgtctgaggaatgaggatgttgctgtcgatgtcagaacgctgtctcgtagtcaaaactgtcctaatgtacaattcaacggcttaaggaggatgcaacctgttgttattgaatctgatgtattgacggtggttggtagcttgcatgcagtcttttcctagctcgatttggatggctggaccaataaatgtcatgtattctcgtcaagaaattagcttttgttttaaaaaaaaaaaaaaaaaa

SEQ ID NO: 78769 - DNA, 619 bp, Triticum aestivum
  Clone ID: PAT_TA_78769
aattgattttagaaatgtactgatttatctttgtgagtttgtgagaaaagcttcaagatatgcctgtaacttcagcaatgacgtcctgaggatggtgaatgcacaataaaaaagtgtcgcagaaggtggattgtagttcccctctatgttgacagtgcctaggaatagatacactgacgctttgcacaatgggtagcacaatgtgcatccatacatatcactatcctgtatcttgttttgttgctgatcagaggaatggcactaccggcatgggtctgacgtagtgttttgagaaaaatatttttctttgcttgatgaatctgggcgtggacaataaattgattttttactagaaataaattattgtaaccatgtcggatcttgctgtcatgtaaagtgtaaatttctgtgtaaatatacatgtagatataaatgaactgtttcccttgtttttttgtccattgtactgaatcacaaatgccacagtatttcaaatgtatttccacactaattcagggtatccttatgttataccactatgcaaaaattggatatgtaagcatggtaaattttcacaatttttcttatagaaaacactatttaaaggggaacatatgat

SEQ ID NO: 78770 - DNA, 733 bp, Triticum aestivum
  Clone ID: PAT_TA_78770
ggacgaggagcatatggggtttatgattttagacccgatggcgaaggctacatgcaagatcatcatgcagagttgagatccagagatttccatcatgccgatgatgcctttgcagactcagttagcacagacttctcggaagctacctcaagtgagtggtcgttgtttaccagctctgacgagtcctcatttaccactgaaagcacaagagattcattcagtgttgtggattatggagacaacgctggcctggatccaatttcctctatatttgggccaagttatgctccggagcaccctcctggcaatttcgtctcatgtacaaggttctcaccttccaatccacaaacaaggtacttctcagagagcacaggcttcgtctcggactcttccatgccggcccaccctagcggcattgtacatagaggaaggtatccagatagggcatgtgcctcttcagccgaaccgctcgcttcggcgcatcagcggagtgggtacggtcggtatccccttagtcgagatggttttgttcaaacatctgggttttgccaaatgtaatcggcttacatttcatttcatagttgtagctggtgctcggcagctgcggttagcactgccactaatgctgcctcatgtccttttatttctgatgaggcatattaaattttagctgcataccattcctaggggtagctcgattcaatgtagcgaaaaaaatagattgtctatatgc

SEQ ID NO: 78771 - DNA, 607 bp, Triticum aestivum
  Clone ID: PAT_TA_78771
cttttcgctccaattattgtggagagtttgataatgccggtgccctattgagcatagatgagagcctaatgtgttcatttcagatcctgaaaccaactgatatgggtccaccacatgcaagaaaacaaattccgaataagccagcaagaggttgaagcctccgaccagcatccaatccaatttaagtatcatcacgatcgtcagtcagctcaaagggggtgatctgttgtttggatagttggatccaccagggcatggcattagacatccatcagccaatccatccccttaaccaccctttacgtactcagcgtcttgggtggcggcggcttggctgtaaaggatattattctgtacagcattaggttggattcagcacaccatctgttttattgttcttcctgccggcacaggacctcattggcagcttgacttccagtagatgttagtggtctctattttttttcttagctgtgacatgcgtcgtttttgtgagtgactttatatttggtgattttttatcttatctttgtaatttgtagatgttgcaggaaataggtctgcacaaaatgttgtgtccatcagcagtaccattctttttttttta

SEQ ID NO: 78772 - DNA, 743 bp, Triticum aestivum
  Clone ID: PAT_TA_78772
tttttttttttttttttgaccagcttctgattcccgtttgaagatcgccaggatttcaatgctatctgtgccagggaagaagttaaaagcatgagcattctccaactgccaggccttgctggatatcaagcttttgcagtccttcttaaaactttcccatccacagctaatatatatgagagtctcaggccacgtttcgctgccctcttcagttgttgtactatcaacatgaactgctgcctcccttgcccgtaagatccatggtctcttctcatccttaacctttgcaagcgaacttttagccttgtatgccttgcgctcagacaaagcaactttctgtaaagcgctgataacagatgggtgcaatcctttcctgggaggatccacaataacgacactagacccttcaagccagtgaacaggttcaactgaagcgtcagtattgtgccaagtgatggtgcaacccaggttcgctggaagtcggcttgctgatgtctcgaaagacatctttgactgtttgttaatctcaacacatttcactgacctacatttccttgaagcagcaactgataggccgataacgccagccccagaatacaaatcaacaactgttgaaccacgtggtacatacttgttcagcttatgcaacaaagagttaaatgacagagtattagcctggccaaagctacaaggatccagagaaatatcaactcccccataacgttcccacaggtccctctccc

SEQ ID NO: 78773 - DNA, 343 bp, Triticum aestivum
  Clone ID: PAT_TA_78773
cggcacgaggatcttaaggagaggctcatgcttgttcccagccttccttgtgctgatgcacctggaactggtcgtcagtcgtcactgctccatgcaagctcgtcgcgcacaaatgatttggagtaaagatcgaactgcagacgttgtagtgcacgagcacaatgcacacagatgaagtgaactagctagctagctagaatctatatatggatggtttggtgcttggactcaatgtatattgtatatggtaatagtagtgtaatggtaactctatctggaatctgataaaaataagtacactggtattttgaagggaaaaaaaataaaaaaaaaaaaaaaaaaa

SEQ ID NO: 78774 - DNA, 194 bp, Triticum aestivum
  Clone ID: PAT_TA_78774
accctctttccaaaagagagtgatgtactagtatctgcccctgtgattgcccccttttgagcactcatctctggaattactgagcttttgcagcattttgctaaggaaaaacttttgcagcagattttttgagaatattaaacaggttttagaattatcctacaaaaaaaaaaaaaaaaaaaaaaaaaaaaaaa

SEQ ID NO: 78775 - DNA, 455 bp, Triticum aestivum
  Clone ID: PAT_TA_78775
tttttttttttttttttttttattagcacaaaatacagcacaaatttgtccatgggaaaatattgttgaaatactgaacgtctctcatctactatctctgcacaaagttctcttcccgactattttaatttgttccttgccaaattaaataagctcatacagaaaattttatgatgcctaatgttgcacaacttatgcttattccacgaacactatatataataattgtatagtaggcttctcagcctcagatttgcacgcatatcagtattcattcaggaagtcaagcactccgtgatcaggcggtgggctctgtccactccgcgatagccagggtgtgccgcccgccacaagccacgtacttggcctgccactgcccgtcggggttgctgctgctcttgggcggcggtaggtcgatgggcacttccatggggtgccccgtcgtcaccttcctg

SEQ ID NO: 78776 - DNA, 426 bp, Triticum aestivum
  Clone ID: PAT_TA_78776
acgttcacagcattaaacaacatagtaaacctctggtactcaaaaaattccgacaagccagtaccatgttcatacaaaattgcaacaattactcataaatctaagtagagtgggtcgactgatgcaacacagccagggcagcataggtacttaagttgtaacaagataggccttaaaacatctcaaagctctgaacactcttaagcggtggaggcagcggccttggcagcagatgaaagcttggacctcctcttggccaagctctcgctacggcgatccctctgttccttcagcctctgggcaagaagcttctggtactcagcagcctcagacttcttcttagcgatcctcttcttcttgtcagcaattctagcgcgcttcctctggagggtcaagggggtcacaagccgctggatcttaggtgcc

SEQ ID NO: 78777 - DNA, 576 bp, Triticum aestivum
  Clone ID: PAT_TA_78777
cccgtcctgcacttcgactgccggcgcttgggtggggacgaggaggagcgcggcgctgctgactacgctattaacgctgttcggtaccactccgcccctggcgccgctggagaagacgagtatgaagggccggagttcagagacttggaccctcggctgcaggctgctttgcgagaatatctggtagcaagaggcgtcaaccccaaactggcaacctcgattctccaacacttgcttgagaaggagcgcagccagtatgtgaattggctgaaggcattggaacaggcgtttgccaaagatcgttaactctctgtatctaacaatattctgtggctgagtttagtgcgtaatacatttattttgctgtgccaatgctggagtaggtctgtaggtgccagttctatgccgatattagttcgtttgaatgatctcatgcatgtgaggcataaaatgcaacagctagtttgaatttttgaagccacaggaaatatgtaactggtgcttatatgtactattacaggcagttataatatgagaaaaacagtattcgtctttgtaaaaaaaaaaaaaaaaaaa

SEQ ID NO: 78778 - DNA, 606 bp, Triticum aestivum
  Clone ID: PAT_TA_78778
gaggcagcattgcttctggttttatcagctgatctactctggatgtggctctgtgtagggttctgcagctcctgtaattccaagttgttttggctcctgttctttgagccacttagtattgcctttgatacactgcagtctatcatggtgcatggatttcagttattggacatctggcaacggcatctaatggaaagtggtacagactttcttgatttccagaaatcttataagcaagcagcaggatctttttctgaatggaggggcaagcttactaggaactttggttttgccattgatttaataagcttgttgatgtcacttggtcattactctatgatcttttggcttcgtggtatggcgtttcatctggttgatgcagttctcttattgaacttgcgtgctcttatagtttcctttttgaagaggattaaaacttacatcaagttacggaaggcacttagttcactcgatggagcacttccagatgctacgtatgatgaaatttgtgcatatgatgacgagtgtgccatctgcaggggaccaatgggtcgagctaaaaagttgtcctgcaaccatctatttcatctagcttgtttgcgatca

SEQ ID NO: 78779 - DNA, 719 bp, Triticum aestivum
  Clone ID: PAT_TA_78779
acgaggagagagagagagagagagagagagagagagagagagagagagagagagagagagagagacgatccttcctccccactctccaactcctgcaccaacaaccaagacctatccccaaatccaggtcgatggaggtggcggcggcatggtgccacaggcagcccaacgacggcgagagaaaggagacagcagcaactgctgctccatagactacgtcgctacagaccatgacttcctcaactcctgctacaccctcgctcatggctgccactagatcaatgaagtggtttcggctgagagtctcatgtggcttctaaatgaaacttttcaagatattttagatttcacagatttttcagtcagcccctactgaaggtttggcatgaccacctagcagtggtactaccactcagagatgcaactctagaaaccagttcaggagttagtatcctttctgttgaccagttcagcaaggacttatacatagttgcatatggaaaactatttcaatggttactgattaagcaatatactcgcctgggctattaggccaattttccttctgatccacctcaactagaaagctttttacaggccaatcggtgattggatacctttggggatccttacaaatacaacccatggaggtgatgcaacatcaatctttcattgccttttcagatgagtgtttccactctaagactcatttagatgga

SEQ ID NO: 78780 - DNA, 575 bp, Triticum aestivum
  Clone ID: PAT_TA_78780
ctgcactgttccagcgtgagatagagaaagagagagagagagagagagcaaggatggcgtctctgcttagcctgtacggaagcggcggccggaggaggatgagccgcagtagtggcacggcggcgccggtgaggcggctgctgaggagactgaggtccagcttcggccggagcgcggcgcggccaaggcgaagaagcgcggtgaggttcgggtacgacctgcacagctactcccagaacttcgacgacggcgttgcctcgtcagctccggcggccatggcttgtgcgtagctaggattctagaaccagccaatcaggattctgcttctcttatgtgtaaataactatagccaagatattagtgtggcttaatgcttcctcactgagagattgaccgagtccagggttaatttccggtgattagctatctactgtaggttcgttagttgttgtatatacaagttgtttcgtctgtgtaataagctacccacaagacagcagttctatgcctgccatagatcaacacacaaggggatttatagattgctttggtcagctgttggaaaaaaaaaaaaa

SEQ ID NO: 78781 - DNA, 685 bp, Triticum aestivum
  Clone ID: PAT_TA_78781
gaagccccgcgagatccacaacctcttctcccaccgccccgccttcgaccactgcctcctcgagtacaccggccgcgccaaccaggtggttgcttttgtgacgttcttcacccatgaggcggccctgtcggcaatgacttccttaaatggaacaatttttgatccggagactggttaccgtttgcacattgagctagctaaatcaacttcacgtagacctcgtggaggtggcgaagtctaccgagttattgacaaacggactaacaaaacagaaggaaatgctgatgagaatgtcggtgatgaagttgacgaggaagtatgggggggagacgaggatggagccaatgatgataatggtgatggagaatcagatgagccatcaggcacagaaaatgaaaattccagtgataagaatgaattgcctgcggatcagagtgatcaaccaaggcacaagaagcagaatgggaaatctctctcaaatgatggacgagataaatcttcgaatgatataccaccttgctctactctctttattgcaaatttgggggacacatgcacaaaggacgaactaaatgaagttttatccaaggaacctgggtttgatgtccttaaaatgcgtcgccgtggtggaatgcctgttgcttttgctgattttacggatattgaatcgtctacagctgctatg

SEQ ID NO: 78782 - DNA, 389 bp, Triticum aestivum
  Clone ID: PAT_TA_78782
tgatgaggaggagagctcggctcacggcgctgcggctgtgacgtcgagctcattgagcgagccgctgcttagagaaagaggaaaaggagaaaaatatttggttcttcccttctctcgtagccgacaccaactctcccctccactacgatgttgttgttgttgtttacttgatctgacgatgattactatttgcctgaatcttggttgacttatctgcatgcttgcctgcttgttttcgggcgattgaggattatcgccaaatcttgcagcagctgttgtactgtaatatagcaacattttacttccttcctcttgtgaggaaagagacagacaaagtaacttatttcaatctttagctacattttccttcaaaaaaaaaaaaaaaaaaa

SEQ ID NO: 78783 - DNA, 376 bp, Triticum aestivum
  Clone ID: PAT_TA_78783
agaactttgacagggatcgatcttcccacccttcaccaacattagaaagatctctgcgcgcattgctgcagccgtggctgcaaaagcttatgaacttggtttggcgacacgtctgcctcccccaagagacctggtgaaatatgcagagagctgcatgtacactcctgtctaccgtaattaccgatagtgctgctgggatcaattttgcagtaataaaatctatcaacgcagatgataccgcaatgttgtagttattgttgtttgttgtccctgctgctaaaccacccttgttgttggtgctgctggtggacactgtacatgtctatgcatatatgatgtgttgtaactttatgaaaggaaaaaaaaaaaaaaaaaa

SEQ ID NO: 78784 - DNA, 549 bp, Triticum aestivum
  Clone ID: PAT_TA_78784
cacgagggcaaggcttacgcctatgccaggttcagctactatcctccatgcacgaggccggatctcgtcttcggcctgaagcctcattctgatggcacattcttcacgcttctcatggtagacaacagcgttggtggacttcaggttctccgagatggtgtctggtatgacgtgcccaccagacctcacaccctgctcatcaatctaggtgaccaaatagagataatgagcaatgggatcttcaagagcccagttcatcgggttgtaacaaatgctgagaaagaaaggttatcagtggctctgttttattcaatagatcctgaaagagaaatccagcctgcggataaactgatagatgagaaccatccagcactatataagaaggtgaaaatcaaggaatatattgctggcctctatgaacacgtcgctcgaggggaaatggttatcgagactgcaaagatatagatgtgatatctatgtaacgaataagggacctgaatgaaaccttgcaattccaaatattaataaaattattctttagtaagaaaa

SEQ ID NO: 78785 - DNA, 740 bp, Triticum aestivum
  Clone ID: PAT_TA_78785
gttagtttctgcaatgaaaggaacccgtgcgaagaatggaatcattgcaaagttgagtgtttcatgggcccctgatgtatatgaccctcctattacttctgactctcacactgtgagagggcaccataggagttcaatgaagagcaactacaaatacaagtcctccaagagcagtagccgcagtaccacgggaagcaaaaaggacaagaagcattctaggcacagtagcagcagtggtggcggcagcaaaagggacaggaagcattcttcccacagtaccagtagtgccagcagcagcagagctgttaccagtggttctcaatatcgtaacacatactgtggtgacgggatcagcagcagcagaactgtgacatgtgttcctgagtctgccaaggtatctccattggtgttagctgaaaatgccgcaccgcaagagccggttcctgtactcaagacactggaaccaatcaaatgtgctaccagctgcagcaaagagaagccatttgccttactgtcacgccagttttctcctgcaaggtacaaggggatgttttccttttggagccaaaaccaactggcttcttgataatctgctatacggaagctcacctggaagtcttcgttgctaattatgtcgtatcagtgattgtttggtatcattcccttcgttaccatgtttgtttcgcctgtgtctgaaacttcagaggtcacgttttccaaagttgcccggcaaagtgcct

SEQ ID NO: 78786 - DNA, 650 bp, Triticum aestivum
  Clone ID: PAT_TA_78786
gaggctttggagcctgggaagccagtaaaatctgacaaagctgctatcttaagtgatgccactcgcatggtaattcaacttcgtgctgaagcgaagcagctaaaggatactaacgagagtcttgaagataagattaaagaactgaaggcggagaaggacgagcttcgtgatgagaagcagaagctgaaagtagagaaggagacattagagcagcaggtgaagattctgactgcaactccagcctacatgcctcaccccacattgatgccagcaccgtacccacaagcaccacttgcccccttccaccatgcccaggggcaagccgcggggcagaagctgatgatgccttttgttggatacccggggtacccgatgtggcagttcatgccgccttccgaagtcgacacctccaaggacagcgaagcgtgcccgcctgtcgcgtaatgcttcatcggttgcgttatgtgaattaatcgtaacctgaaaccgcttagttgctcaatccattggttgggcatcgtcgtccctgattcacattcactattgttcttgtgttagtagtttgtttttgtatggaagtaagctgacatttgtggcgctctatagaggctactgcccccttttaacgtacaatacaatttttccggaga

SEQ ID NO: 78787 - DNA, 669 bp, Triticum aestivum
  Clone ID: PAT_TA_78787
caaactagctatccatctccagcatctctgctctcttcctcagattattcagctcgaagacgacacttacaatccccaaactccagaagcagagatccgcaaatactacgaaccgattggttcatggaagcatttctcccatgtctgcaccgcaccagttgattcagatgattcctccattgtcacaggggcacatctggaagtagtcagccatggtttcaagaaaatactcttccttcgccttcatttctccaaagtctgcaatgccacttctgtcaagaacccagagtgggatggatctccaaacctgggtcagaaatcaggcctcatctcaacacttatcagcacacatttctccacagcagctctaaagcccgcgcctcgccctgccgaagtgaacatcaattcggcggtgtaccctggtggcccgcctgttccagtgcagaccccaaagttgctcaggtttgtggatacaacggagatgttgcgtggaccgcaggacctgccaggttactgggtggtttcaggtgcaaagctgcatcttgagaggggcaagatatcgctgcgggtgaaatactcactcttgacagtaaattcgcccgacgatgagttttcacccgatgaagaattttagaatatcattctggtttatgtgcagctaactgtgag

SEQ ID NO: 78788 - DNA, 607 bp, Triticum aestivum
  Clone ID: PAT_TA_78788
gtccgtgctaacgatgaatgggtttcctactctccatcccaagcttcagtttccaaggagagagcaattgaatctgctaaagctgtttttctcaaagactatgaccacttagaaccatatcggatccatcatgcgtcacgccttgttgctattcttgaggcctatgcaatctatgaccaagagattggatattgccagggaatgagtgacctgcttgcacctctccttgctgttctagaggaagatgacgaagccttctggtgctttgctggttttatgaggaaagcccgccacaattttaggcttgatgaagtgggtatacgccggcaactcaatatggtagctaggataatcaaatacaaggacttccatctctacagacatttggagatgctccaagccgaagactgcttttttgtttacagaatggtagttgtgatgttccggagggagctcaccttcgagcagaccctatgtctctgggaggtgatgtgggctgatcaggcagcaaaccgtgctgagattgcaaaatcttcctggcggaaattgcagttgggagcacctccaacagatgacctgttactgtatgcaattgctgctagtgtgt

SEQ ID NO: 78789 - DNA, 748 bp, Triticum aestivum
  Clone ID: PAT_TA_78789
gtccgagctctaagaaaaccacatctcatgaccaaactacaagatgaagttaggaagaacacaactaccaaaatggtaagtgaagatgacttgaacaatatgccctacctaaaagccgtcgtaaaggagacacttcggttgcatccaccagttccgctcctcctcccgcgcctctccatggctcagtgcaatgccaatggttatacaatcccagccaacacacgtgtcatcatcaatgtttgggctcttggcagagatgctagatgttgggagaattcagaagagttcatgccagagaggtttatggatagtggagacactatagataatgttgatttcaaaggaaccgactttcagtttctcccatttggagctggacgaaggatttgtcctgggatgaattttgggatggcctctgttgagctcatgctatcaaaccttatgtattgctttgactgggagctcccggttggaatggacaaagatgatgtcgatatgacagatcagttcgcacttacaatggcgcgaaaagagaaactctacctcatcccgagatcacacgttatcaagatcacataacacaacatatggccaacatttcaatagccatgagttctgtatggtagccatagataccaagcaatagcgtagttatctgctataagatatatataatagtaccaaataaaatagagagtccattcgtctcttgaggggggacaatagaagtaaataacaagaagaaagt

SEQ ID NO: 78790 - DNA, 600 bp, Triticum aestivum
  Clone ID: PAT_TA_78790
gggtgatggctatgctccaattgctgcacattgaagaaatatgatgctgctttgaactttacatgtgttgaattgcgcactatggatcaacatgaggtataccctgaggcatttgcagatccagagggcctagtatggcaggtgctaaatgctgcttgggatgctggtatacaagtggctagtgagaacgctctaccttgctatgatagggatggattcaacaagattttggagaatgccaaaccactgaatgacccagatggacggcatctgtttggtttcacctatctaaggcttagcaatgttctgtttgaaagacccaacttttttgaatttgagcgcttcctcaagagaatgcatggtgaggcggttcttgatctgcaagtatagattggtagcatattacatacacatatacaagtgactgattggctccggccttacaagtgactgattggctccggccttatggcttacattttttctctccttttcctttttattttagggagtagtatcagctgatttttgagctgttaaatatagaactcgctggttgctgctcaatttgtaaagcctatttgcatatactctagtctt

SEQ ID NO: 78791 - DNA, 777 bp, Triticum aestivum
  Clone ID: PAT_TA_78791
cgaggacggaacctacttcgttgagactgaagatggttcttctcctggattggatgtcaaagtagatagcagaggtgaccatgatttccgggttgatgttggtgggctgcaaacagacgtaactctagcattttattcaaaggacaattgcaaccatatacacatctggcatgggaagcatcatcatcattacaggcagacgttgagagctgagcagtcacctgatgacagttctcaacctagcgcttcctctgaggcgaggtcacatccaaaggggagtgttttggcaccaatggctggtctggttgtaaaggttttgcttaaagacggggcacgggtggaggaaggtcagcctgtcatggttatggaagcaatgaagatggagcatgttgtgaaggcgccttgtgccggatatgtggaagggctgaaggctactgccggacaacaagtttttgactctagtgtccttttcaccgtgaaggagaacaagccaaattgagaaacccaggcagagattcacgacctgtacagctcaattcacagacgcttcataagttggctgatgatgctgccggccgtccaaaagcaagcaaataataagcgacaacatcgagttcacaacacaaaagcaagcaaaaataagcaacgggttcatctgtgtgaataaattagttgacgagctcccaacccaccccctgttgttgttgtcgcaaacctgaaactgtacagtgtacattactgctgtcacatacagtgacaaaaacaattaaacctcat

SEQ ID NO: 78792 - DNA, 754 bp, Triticum aestivum
  Clone ID: PAT_TA_78792
ggcctcctcctcctgaggctggacgattgggtgctctgcaggatctacaagaagcccaacccgcagcagctgtcgcccttctacgagccgtcgccgtcaccgtcgcggtcgtccatggacgccagcctcggcctcggccaccaccaccaccatcagtaccaccaccaccagcagcagcagcagcaagaggacacctcctcctcctcccggatgctgccgaggaatccgtccgtctccgactacctcgtggactactccgccgtctcggagctcttcgacagcatgccgccgccaccacagccggagactgcaagctctgtcggccatttcttcctcggcaccactgctggcgccagcgacggcgaggccagcacggcgcgcaagaggcaggcgacggcggacagcaacaacgatggtgaaatgtcgtcgttgcacgcttccaagaggtggttgggtagcgatgggtccatgacgatgatgaacggcggcttctccatatttgggccagaccagccttcccagcaggacaggatatgatccatgctaccttgataattagggctaggagaaaggtagctagcgatttgactattgccacactatagctagttgattattcacagatgccgatcgatcaatggatcgtgggggatatatattactcatgcataatttgtagatcaggctaaattagtacagtatatatattgtgtaaagttagtgtaacatactattatataggccggactagcta

SEQ ID NO: 78793 - DNA, 803 bp, Triticum aestivum
  Clone ID: PAT_TA_78793
ggcacgagggagtttatggaaactatgtgtagtgtcttgggttgagactggcactatgccatcccaatgcagcattgcacccacaccaccccaaacggcagttatagacgcgaaacaccgtgatgttcaacagtcaccaccccggttagctactttgcttcacttacaaaaaggacacccattatggttctgggtatcgaagtctctgggcaaaatgtgagaacacctgtggactcagggaaccaaaggctcttggacaaaaagtgaggcgccttggacaaaacgtgtaggagaggaccagagcgccttgcccaccttgcaaacacccatgctgttcacctagcctctgtgcttgcagatgtcttcaaggactccagagcttcccgtaatgcatcctccatctcagagttccctggatccaacttcaatccatcgtaaagtgtttcgcaagcactctcgtagtccttcagtagcatcagagcagcaccctgtcggtagtaggcctttggccagtcaggccgcaatttcctgcattcataagcatccaacaaagccttgcctccattacccatgtgatgccagcaaaggcttcttactgtagaatcctgttgcagaaagataatcctttttctcgaccgccttattccccaatgactttaactctgttgctttccttttactgacaggctcaccattatcagaaatgttacggttggcaccagtctcttccattgagtaattgcactcatttgagccaccctttgcagcagttgagatgcagtctccactgacaacagcactag

SEQ ID NO: 78794 - DNA, 609 bp, Triticum aestivum
  Clone ID: PAT_TA_78794
atgtctggggaggtgagccagagttgttcatggcttcacatgttcttcagatgccaatcaccgtttacatgcatgataaagaagctggtggtttaatagcgattgctgagtatggccaagagtatgggacagaagctcccatccaagttctttatcatggttatggccattatgatgccctgcagataccaggaaagggtggtccgaggtcaagattgtagcatttgtagctctgaatttaaatggcagtgacgcagcggcaagtcgatggtgcacattacctatgctttggtggcaaagacagatggccataattcagcttggtccttttgacatgctggaggtggccacggaacggacatctgctcagctctcgtgatcttcagatgctcctgacttcctaaacagcgcgacaattatgaggagttgtcctggtttcgttgaatgtactgctggagtagtggagtcaaaagctgtatagaggtgaaaccattatgttgaaccaagtaccagactgtgggctcgagtgaaaccagcggcctccgcccccgctgctcgcgtaacagcttcacatgctggattccagagcttaaaaaaaaaaaaaaaaaa

SEQ ID NO: 78795 - DNA, 237 bp, Triticum aestivum
  Clone ID: PAT_TA_78795
tgatgcagaggaatttaggccagaaagatttgaaaatagtagtgtcgattttagaggtaatgacttcgagttcactccctttgggtcaggtaggagaatatgccctggcataacgcttggtttggccaatctagagctggctcttgttagccttctttaccattttgattggactctacctgatggcgtcaagttggaagaatttgatatggcagagatctttgggataacgttaag

SEQ ID NO: 78796 - DNA, 419 bp, Triticum aestivum
  Clone ID: PAT_TA_78796
agagatcgatttctttggtgaggtgtctgggatcacgctcagcccggacgatgagtccctgttcgtcggagtgtgcgaccgtgtctatgccagcctgttgcagtacaggatgatccatgcattcgactatcttgactcgtacgtgtgaagaatagagctttgtgttgtgctgggtactggctgaaggtcacttgctctcggtgacggttctggtgcgcagttcagggaatgtatctgcctgctgttgtgcgctagactcgacgtcagcgagtctgccgtgtaaatagttcagcaattgaagcgtagtgctgtggaccaatattgtctgaacatatgagcagagtaatgtatgtttgcgttgttggttccagactccagaatacaaatagttttggaccaaaaaaaaaaaaaaaaaaaaa

SEQ ID NO: 78797 - DNA, 518 bp, Triticum aestivum
  Clone ID: PAT_TA_78797
ttaaagctgcaaggagcatgtgggtcgtgcccagcttcagtaacaacgatgaagatgggtattgagcggcgcttgatggagaaaataccggagattgttgcggttgagcccatcgcggatgaggagactggccttgagttgaaccaagagaacattgaaaaggtacttgacgagattaggccataccttgctggcacaggaggtggcgagcttgagtttgtcacaatcgaggagcctattgtcaaggttaggcttacaggcccagctgctggtgtgatgactgtccgagtagcgttgactcagaagctccgtgagaagatccctaaaattgcagctgtccagctattgccataagattagaatctttgtagaagtcaggcaccagtcacagttgacaatgtagatgtactactgcaataagtcttaaggagttgtaatgtgtagcctactgggcatttagctcctctacagcgatattatgaatattatgataatcgatacacaatgttcaagtgact

SEQ ID NO: 78798 - DNA, 394 bp, Triticum aestivum
  Clone ID: PAT_TA_78798
gttttgttggaaagcagatagattctgcagagattcctcagtacatcagagaatatgagaggggcaaggatttagagatgtggatgatcatgtacagtccggaccagaaacagcagtaaggcaaggatttagagatgtggacgatcatgtacagtacggaccagaaacagcagtaactctacaaaaatcgtcttttccttccagcaggaaggagagaagttccaacaacaaatatcatcgtcgattgccacaaatgcatgatccccaggatgatcctaccaagaacaagcaacggagcatccccaggacaaatgctgtgtcgatcggtctggcaatgatcgatcggcctgcaggctctggccttggaggtcttgtacgatcggcattgaacttg

SEQ ID NO: 78799 - DNA, 376 bp, Triticum aestivum
  Clone ID: PAT_TA_78799
ggaagaacagaacgcaaggctggaagctgagaaggtggcgtatgaagctaggctgaaatcagaagcggagatccagaagctcaaggagagcctcaagaaggctcaaagggaaaacgaggagttccggaggatggcgcagagccagggcagcaaatgtgctatcctgtagggtacttgctagaagtttcggtggggctaatcgtgctgccgcgtctcttatctgtagtagtaccttttagcagtttatgcgacaactgttaattagtcactggtattcgaatcttctcttccctacattatcgttgtgcttctttgcttgtgaggctgagtaagtaatcaaatctctttgcagcccaaaaaaaaaaaaaaaaaaaaa

SEQ ID NO: 78800 - DNA, 458 bp, Triticum aestivum
  Clone ID: PAT_TA_78800
ttactgaaggtgtgctgttgttgattctaaaaaaggtatgttgctgttaatcctaaaaaaataataagctgatgttttatttaggggtacagaagaaacatgttttcttctctcactcataggcttgcagtagcctatttttaagatgcattgcgtgctgtatttgtaactgatgaatgaattaagtgctttataatagattgtgttggttgattggttggtcgattgaatcctctaaaaataaacggctgaatgagcactcacttttttgaatactgtataaataaaatttaattggtggtgtagtgacaggatgccgcttgagccgtacggggatgccaatgcagtggccggtgttccatggcgagactggtgaaaatgatgagtggaggcacaatgattccacatgggtggcaactgcatacctcatggagggagctgctcgtgctccactctat

SEQ ID NO: 78801 - DNA, 244 bp, Triticum aestivum
  Clone ID: PAT_TA_78801
cataataaccctgtttatccgcatttacccgattaaattcttgttgccattgcggaggcaccaacggtaatttggtcggtgttgtgtatattgaatacctctccccatgttttatagcgggtgaagggatacagttagactaaaagtgtagtgtcatttgtgtttcagaaacatgggagaaaccccacttcttgtttatatactgtacaaagatttagttgatcttaaaaaaaaaaaaaaaaaa

SEQ ID NO: 78802 - DNA, 531 bp, Triticum aestivum
  Clone ID: PAT_TA_78802
ttttttttttttttttgctggttcacttccagtgctttatttcacattaatatctgaatatccaagtacaagcggcggctgaactaaattaggtaagatgaacctatgaatagactagtttccttattttctagcatagtccattttgactgaccatgggtttattatttcgtacaaatacagcaggtgatatacatattctgagaagatgacatgtcggatcagcatcggcagctgcagcctacataaccatccatccgccatttggggatgagtcctgatcatttgacaagccctaggttgatgatgccgaatgcagtatgaggccaatccttctcgctggccttggtcagcatcgccctgccccaagacacccacccctcccatgtcattctcttgtcccagctgctgccccactccagcaacagcttgagaccttcctctgcctgcatctgcgcatcgccatacctctccatgttaaggtacacctgtgcaagcaccaagtgtggttctcctacaaatgggttcttg

SEQ ID NO: 78803 - DNA, 601 bp, Triticum aestivum
  Clone ID: PAT_TA_78803
gctgacaagaaaagaccgaaatcacatatcctcgagcttgttgcatggcttcatcatcttattagtcgatctaaatccgctaatggcgagcggtctcccatcaaatctcctgttcgatcgcctacacaaaggggccatacaatcacattatctccaaacaaagccagcagcaattcatcacctcttcttacccaagaagatcaagatatgctaagggatgtcaagtacaggaaattcatccctggtataagcaaaagccaagagttcgagactaagtccagacatagcaagcaaagcaggttgagcaaaagtaatagtcactcaccaagcagtggcaacatgaaagagttgctatcaatcaggaggatgcttcctgtcatcgactttgagatcgataggacaaaagctatggacgtaattgatagagtcgataatctaaaaagtacagtaaggacttagaattaattggtgccaaagctgaaagttgcgctgcgaaatatgatcttgaaaatactgggtgcccgaaggaaacaaaaagtctgctggaattggcatgtgaaaggctgcaagcagccaaaggcgtgtcattgtgttctcgaga

SEQ ID NO: 78804 - DNA, 436 bp, Triticum aestivum
  Clone ID: PAT_TA_78804
acttgttcctagggaacccgtggaagttgaacctcccattcgacggcgacagcttccagcaatggctggccggacatgcgccggggcgggtgtccggcgacatcgacgcgtgcacgcggtggctggtggacgagttcaaagccgcgggggtgtccaagaagctgggcgtggtcgggttctgctacggcggcgggcgcctcgtcgagacgctggcgcgcgacgcggacagctgcttcagcgccggggtctgcttctacgggtcacggatggacgcgtccctgggcgaccgcatcgcggcgcccgtcctcttcgtgtgcggcgacggcgacccgctgtgcgccgtggagacggtgcgggagctggagagacgcgcgagaggcggcgcacgggcggcggtgtacgccggcaggggccatgggttcgcgcaccggccgca

SEQ ID NO: 78805 - DNA, 237 bp, Triticum aestivum
  Clone ID: PAT_TA_78805
tggtctctcagcattactatccgtgttgtatgtggattccgagggaaccttgtaatatcaaagatgttcattcactcgtagaagaaactgttgttttcttacttttctacgcttcctatgaatgaaaggacttctatttgttgcatgagatgtgcacttcttggcagtccttggccttgatgatgacgattatactgatcagtatctatattctgttttcaaaaaaaaaaaaaaaaa

SEQ ID NO: 78806 - DNA, 585 bp, Triticum aestivum
  Clone ID: PAT_TA_78806
cctcttattcctccatgacaccttggatgaaactagtactgtatacagcaggacattgtggaccggtatctgctgtgttcatgaaagggctacgttttagattgctgcctgaaccattagctggttgtgagaaggcactgatatggtcttgggatggctcttcggtgggtggcttaggggggaaatttgaagggaatttagtgaagggcaacttattgttacactgcttgaattcgatgcttaaacaatctgctgtgctggtgcaaccacttagcatacatgatcttaacacgtcaggaaaccttgttactgtggatatccctttacccctaaaaaatgatgatcagtcaattgaatctgtggtagctcaaactaatttgccaaaggaacagatcttagatttgacttctgtattgaaagacctatctagtaaatttgagctgagcacacttggctacctccgtctactgagacttcacaggattgatgaaccagataaatttgacccagaaaatgtaagctaccagtgggtgcctttgagcttggagttcgggattcccttattcagtccaaagttgtgcgaga

SEQ ID NO: 78807 - DNA, 649 bp, Triticum aestivum
  Clone ID: PAT_TA_78807
cgggacaccattgcattcagctaactcaccatttgtcccatctccatcccctcctgttgccccatcaccgatgccagtggattcagataaaccactctccaacttatcttcgctcactagtgcggggcaagcacatcagcaaacatcccttgcacctcagacacaatctatagccgttaacacaccaggtatatcagcgtcacccttgcttgcagaattcacaagtgctgatggaagtcaggttaacctaccaactcaagttccaaccaaatcagcagcagaaaggcctctggatcgcttgcttaaagcattgcgaacaacacagcgcgagtcccttagtgctgctgttagcgatattggatctgtcgtgagtatgattgacaggattgctggatcagcgcctggtaatggttctagagctgctgtgggtgaagatcttgtcgctatgacaaagtgccgcttgcaagcccggaacttcataactcatgacgggagtggtgcatcaaagaaaatgaaacgggacactagtgctatgcctcttaatgtgtcatcggctggaagcgtgaatgatagcttgaagcaatcatatactgttggcactccagagctacaatcaactgcaacgtcacgtgtcaagtggcaaagggct

SEQ ID NO: 78808 - DNA, 606 bp, Triticum aestivum
  Clone ID: PAT_TA_78808
aatggtattgataaatgctgtttacttcaaaggaaattggaaaaaaaaatttgacccaagtcaaacaattaaaaaatcattttttattgataataattcaagtattgatgtaccaatgatgaaaaaattagataatttaaattatggtttacttgatgaatatgatgcacaatttgttgaaattgaatatgacagtgaagatgataatgatgaaataagtatgataattatattaccaaataatgttgatggtcttaaaaaaattgaagataaattaaatgaaattaattatggaaaaattcgtgaatctggagataaaagacaagttgaattgagtttaccaaaatttaaaattgaaagtagcattgatttacaaccagctcttacaaaaatgggaatgagtgaaatgtttactgacaatgcaaattttagtaaaataactaaaaaaataccattgaaaataagtaaagttatacaaaaagcatttattgaggtcaatgaagaaggaagtgaagcagcagcagctacaggtataattatgattaaaagttatcccgcctcctcccacacctacaatatattttacaattgataaaccatttattt

SEQ ID NO: 78809 - DNA, 452 bp, Triticum aestivum
  Clone ID: PAT_TA_78809
ttggagaattggatgggcttgtgctccagctaatatcgcctcagcaataagaaacatccatgtcaagctaactgattcagcccctgcaccattccaagaagctgcgttggttgcgttaacaagcccaccagacttctattcatccttgaaacaggactacacggcgagaagagacttcatccttcaggtgcttactgattttggcttccgcattagcttcaagccacaaggctcgatctttgtatttgttgagcttccaaggtcatggcaactttcagatatggatttcgtgacgaacttgataaaaaatgctggtgtggcggccgtgcctggtcggggattcttccactcaagtaccgacgacccaagctaccatcaccggtatgtcaggtttgcgttttgcaagagcaatgacaccctaaacgctgctgccgagaagatgaggaagctag

SEQ ID NO: 78810 - DNA, 252 bp, Triticum aestivum
  Clone ID: PAT_TA_78810
agcggagaactccgtttggacgctcttcacatatgaaagcaagtggaagaaagttacgtgtacataactgggttgcggatctgaaggatccagtgggatgtatgcaattttggcttcagaattgcttctgtttggtcaattttcatgtaacataatttaatacactgagacagactaccatgttcttatattggtaaatatgaagcatgtacatgtctgcctgcattgtacaaaaaaaaaaaaaaaaaaaaa

SEQ ID NO: 78811 - DNA, 612 bp, Triticum aestivum
  Clone ID: PAT_TA_78811
aggagaatctcgatagaatgaccgttgagtgatgtagatgacatacacggcgtttgtatgtgcttatgtaacatagttacatagcggtgttagtagtaatgtagtgatatacatccaccaaagtatgtatagcaagcttatgatcagttgacccattaacggcaagatctgctacagttaactctcaacaacaataatgatcactggacatgtatttggaactcggggtttacagtggcaaaagcttacaagcacttaagtggacacagaaccatacattggagcttcaaatagatttggaattgctcgtgtcaaaacaagcataaagtcttgcttggctgattttagtggagagactaagcacaagagaacttctcagaagaaagaacatggcacttgaagaccataattgtgtactttgcacctcatcaacagaggaatcacttgtccatctactaatagattgcccttttgcgtccacttgctggaactggttgggcctacaaattaacccacaagcgaacatctttcagaatctggaaagcttcagaagacagttacaggtcccattcttcactgaaatcatcctcatgtgttggtccatctgggaaa

SEQ ID NO: 78812 - DNA, 230 bp, Triticum aestivum
  unsure (1)..(230): unsure at all n locations
  Clone ID: PAT_TA_78812
gatgatcaaaactaggactcgctgatatgacagttgtgccctgttgcttaaatgttagggtggtttatcatagctgtccgactgaattccaagctgtttgtcaaatattctattgtgaattcgtgatagtgttcaatgatgacttgtttcaaacagtgagtattacgtaggaaaaatgccagctaatctccaacttgtctgatcnaaaaaaaaaaaaaaaaaaaaaaaaa

SEQ ID NO: 78813 - DNA, 494 bp, Triticum aestivum
  Clone ID: PAT_TA_78813
agagccaagtccatgaaattcaaggatggctactgatctcatctggtcagccagtgaatgagtacattgattcggctgtgagacacgtccttctcagacagggtgttcttggtatcaaggtgaagatcatgctcgactgggacccgaagggcaaggttggtccaatcacccctcttccggacctggtgaccatccataccccgaaggacgaggatgagctgcgccctccggtcttggcacctgaggtctaaggtcccaaaagtgtccttgatatggcagtttgatcgggtcctagctaggtttctatcttatgataagggcaatgctaagacagttggttaccttaagctttgtggacagatgctatgtattggttctgtgttacttttgtttaagctaagttttgccgagacaagctacattgatatgtacctgatgaaattgtggttccttattgtatgctctgctatgttatttttgccttttttcaaaaa

SEQ ID NO: 78814 - DNA, 653 bp, Triticum aestivum
  Clone ID: PAT_TA_78814
ctcgcggctgaacagggggaggtgtcggccggcgatctccatcgcagcggaggggaggggatcctggtggttcaactattgtatagcagtatgttggattgttgatgttcagaatttcgatatcctagcacgattccccctctcgccgcctcttgcccaaggagaacgtcgaccacgccgtggtccaggctctcagcatcggtgccactattatctgcctaacgctacacgtccagggtcatactggatttcaagagaagaaaaaaggttgttcaagaacataaaaaagggatgagactaggaagcataaatggactgcggtgcaagcagcttaaacttgtcattcttgcttttttcatgatgtttcttctctggaaatgggagagaggaacatactacactactgaaatcctccggccagattcattgattttggctcatccagctaactcaaagtttgtagatcagcatacatcatccgaagaagactttccgaatgcagatacattgacacaatcagtagttaaagtagaacagcaagtaagtgatgcaccaccaccgatgtccatagcaagtgattctgctgatgttgcggatgaaagggaaccaccgccttctgggaagaaagattgtaactacggaaatggaaaatg

SEQ ID NO: 78815 - DNA, 609 bp, Triticum aestivum
  Clone ID: PAT_TA_78815
tggacaccgctcaacctctcctacgaattcagcaacactcacctggacgattacgtgcggtccaaattgctatcggagaaggagctactgagctacaatgagtcctctaaggatcagccccggacgctagtagaggtggtcgccctggcgtgcgcggtcgtcggcggtgacacgatccagacgtacctgtggagcagcctcgccgtggtcgtggcgccattgacggggcaggcgatcctccacaactccctcatgttcattcaggcgttaatgggctccgtgccgctggcgcacgtggaggacgtctgtgaggcacacgtcttctgcatggagcaggcgtccatgtccggccgcttcctctgcgccgccgggtaccccaacatgcgggacatcgtcgaccacttcgccgccaagcaccccgacctcgagataaagctgacggaggtgactggggaaggcgttaggattgtgcccaacaccagcaagcttgaggacttgggattcaggttcaagtacggagtggaggagacgctggactgcagcgtcgagtgcgccaagaggctgggagaactctagatgctgctacacatgcatgcgcagcactggaaa

SEQ ID NO: 78816 - DNA, 681 bp, Triticum aestivum
  Clone ID: PAT_TA_78816
gctgatgctattcacgaggtggtggccaggtcattcccacggccaggagggtcatctatgcttctcagctcacagcaaagcccaggcttcttgagcccgtctacctggtggagatccaggcccctgagaatgcccttggtggtatctatggtgttctgaaccagaagagaggacatgtgttcgaggagatgcagaggcctggtacccctctgtacaacatcaaggcttacctccctgtcatcgagtcctttgggttctcaagccagcttagggctgcgacatctggccaggccttcccccagtgtgtgttcgaccattgggacatgatgacctctgatcctcttgaagctggctcgcaggcttcaaccctggtgcaggatatccgcaagaggaagggtctcaaggagcagatgactcccctctccgatttcgaggacaagctctaaatttttggccgccgcatgtgttgtgccgttacccttacatgttctagttggtctactgctaagagaactgctttcgttgtcgtatttcatttcccttttgtcgaatgcatgtgtttcacatcaacaatcctatgttcgcgtgctactgagaaactatttttactctgtcgtgatgtaacggatgtggaacctggatcatctttttgctgtctaaaaaaaaaaaaaaaaaaaaaaa

SEQ ID NO: 78817 - DNA, 344 bp, Triticum aestivum
  Clone ID: PAT_TA_78817
aaggatctgttacagcactcgaatttttgtggtcgttcaatgaaaatgatccaacgatccgtataggcatatagcctccttcttacttcaacaacctcagccacctccttccccgtgacctccctcgttgtacacaaacgaaatggcagagcaagtagaaaacttcgtccaaagctttgtacgaaggagtaacaacttgtcaaaaaaaagtttgtggaaactactttttctatatttcaggtgtctaaattttaagatgatgtcatgcaacactcctgtactatacaattagtacaagtaaattgttacttttatgaattgttaaaaaaaaaaaaaaaaaaaaa

SEQ ID NO: 78818 - DNA, 591 bp, Triticum aestivum
  Clone ID: PAT_TA_78818
gaagagaaaacccagtactatccaggtaaggaaatcaagcgcagaaaacgacatagaagaaagcagtacgtggatcaagagccctgcattatgaggggggtttatttcaaaaatatgaaatggcaggctgccataaaagttgacaagaaacagattcacttgggtactgttgggacacaggacgaagcagcccggctttatgatagggctgcttttatgtgtggaagggagccaaactttgagctttctgaggaagagaagcaggaactacggaagtacacctgggagggcttcttagcagtgactcgcaacacgataaccagcaaaaaacaaaggaaagttgggttgccaaggcgtagcaaggcagacctgttcatgggacagagtgatggcgatactgagatggccaatggaggcggttcatcgaattctgataatggagacgcagagacgtcggcatcttaggttgctcccaggggtttttgccgttgtggcaactcaagtggagtcctccagcatattcattccgagcatgatatgagctccgtttaggattttgttctctcatcaataattaattttcatgtgcat

SEQ ID NO: 78819 - DNA, 473 bp, Triticum aestivum
  Clone ID: PAT_TA_78819
aatggtccagttactactggttttactgtgtatgctgatttccctagttataagtcaggagtttatcaaaagactactgaccatgtgcttggtggtcatgcagttaagataattggttggggaactgagaatggtgtcgattactggttagttgcaaactcctggaacgaattatggggcgataaaggtttctttaagatcagacgaggaaatgatgaatgtggattcgaagataatgtgattactggattaccgaaactttcatagtaagagatgaattaactcattattttttgaagccttcaggtgattgaaaaaaccgaaatttttataattctataagtactgataaaaaaatgagtatattatgtcttcaacatgaagaatcagattttgacactgttatctatttaacttgaaaattttgaataaagattgttttattttgacaaaataaaaaaaaaaaaaaaaaa

SEQ ID NO: 78820 - DNA, 452 bp, Triticum aestivum
  Clone ID: PAT_TA_78820
ccgccctacgcgcagccgccgccgtcgcagcagcatcagagcagcgggccctccttcatggagggatgcttagccgccctttgctgttgctgcctattggaagcctgcttctgagatccaagctgcgcacagcttgttctggaaaaccgcttggcacacttgatataactgggattggcttgttagtgaagaaccgaagataccatgagtccataacatctctcccatctcctatcgttctgtttgtccgttgagatgtttggtgtacctagcatcatcttatagtttatgtttccaatggaattcatggaatcattggtctagctaaaattgtgagatgtcaagtttctttactctgtggtcgttgcattttgctccttggcgttgtcaagtgtgggatgtgtctataatctttttaggcctaaaaaaaaaaaaaaaaaaaaaaaaaaaaa

SEQ ID NO: 78821 - DNA, 289 bp, Triticum aestivum
  Clone ID: PAT_TA_78821
agatcccagcacagtctgcttgtaccaccaccaccaccatatcgtcgagagtctactccgcatgcatcgggggcggcgtccaaccatgtcggagggtcgccaggatcgcacggggtgctatgcacacctagaccggcaccgggatcgcaagctggggcgtcccaaccctcgccggtatcgcacactggacagtcgccgtgagctgccttgggagttgtttttatgtattagacttgtgaacttggaataatatgtactcttgaacgagtgggttgacatatattctgaa

SEQ ID NO: 78822 - DNA, 593 bp, Triticum aestivum
  Clone ID: PAT_TA_78822
atgacttgaggatcagctccaatagacgctccggcgcagagaagaaagggctgtggtcagtgtccatcgccaccacctctctcggcggccatcgtcggatcatggcctcctgctgctcctgcttcaccatgtggtcattggttgtctttatgtacacccgaggcactgcattcactgcactctcggcgccgtcatcgacatggccgaaccttgcagtgctcagagcggctggccatgggcgcagcagaatggatgcaagtgtggagtcctgcagaaacgttgttcatggtggattatgcgctggtgctcctctctcagcgccacactcgttggagggcagccatctcccagaccgaatctcagatataaataagagttgaaccaagcaataagcataggggaagttttgaatcacatcttttatatcttgctctgtttggtacccaaacggaagcatggttgctgctatgaagatggcttgcttgatcttgtctctgaacaaatgcatcgcatgggtgacgctcagtcctcctgcgctatgccctaccaaaattacctgccaaacaacagtaacactggaggagtcatctatg

SEQ ID NO: 78823 - DNA, 364 bp, Triticum aestivum
  Clone ID: PAT_TA_78823
gtcgtgttcccaagctttggtgagcgctacctctcatcagtgctgttccagtccatcaagaaggaagcagagagcatggtggtcgagccctagagcgcgcaattctggcgaccattttcaggatgttcaccattttcatcacagaaataaagcttcggtgcccttctgcttctgttgacttcgacatacatctgtctgccgacgatgtccagtccattgtggtcgttgttttacatcgtttatagacttgtgatgtttttttactacaatttgacactcgttctattctgtatatcgcgtcagccagtgtgaaataaaagcagtacagtgttttattgcgaaaaaaaaaaaaaaaaaaaaaaaa

SEQ ID NO: 78824 - DNA, 520 bp, Triticum aestivum
  Clone ID: PAT_TA_78824
accatactgggtatcatacagttgttgctgtatgcctatttcagaaaaggatcaagcgaggaagccaagctgccattactagtcacacatacatgagcatgccaaaagaacaaaggttcgctgatggactttggcgaaatcctttttgggtgcgtattctgctgtatgctaggaaaaaacttgacttatcactgtcagagatcaatggcgacctatcccattcacaaagtccttgtccgaattgttttgctcctgtgaaaaacatgctgttctttcgttttatttacacgcaacggggatcatagtttcgctgtatattccatggtagatgctgcaaattgttgatggagtcattcgtttattatgagtgagtgagtgagtgaagttttgtattttgtatattatagtatagtagtgttgttgcgtggacttcatcaacggatggggccgcctgtatacacgtacaaaagcaataaaaggatattattattatttatccataaaaaaacaaaaaaaaaaa

SEQ ID NO: 78825 - DNA, 457 bp, Triticum aestivum
  Clone ID: PAT_TA_78825
gtgagcaggctgctaaggtcaccggcatgcttttggagatggaccaaacggaggttcttcacctgctggagtcaccagatgctctcaaggccaaggttgctgaagctatggaggtcctccgctctgcccagcatctccagcagagcaatgcctcccccgagcagcagctggctaatctatcactgaatgatggtgttgtttccagctgaatgtttctgatgatttggaaactgctctcaatttttgcttgataccatcctatctagagtgcaatgactttgtttacttggcttattggagatttagctgattagctgaaccagaggtgggtttagttttgttgctattttggttatttatggatatgttgttttgttggagctgttttgtgactgttactcgatttatcacagttgttttagagcgtcatcgtttttctaaaaaaaaaaaaaaaaaa

SEQ ID NO: 78826 - DNA, 327 bp, Triticum aestivum
  Clone ID: PAT_TA_78826
tcatcaagtgctttacaagggcctagtcagctagttgctgctgctcctgtttctttgagtagcaaatatggacaaacatctggtgcgaataattcagttgatgacaatatacctcctgcttctgtagttgataagttttctgggttacctgaccgaaatgcttcagcaccttcaactggtaatctgcaaggtggagaaacaaaatccataggggctgatttacgaataaaagagagccatgaattatcccaagctaatggtagcaggggatgcagtgtaaatacattaaactccagcgctgtgccacagctcgtgactgttcctatt

SEQ ID NO: 78827 - DNA, 157 bp, Triticum aestivum
  Clone ID: PAT_TA_78827
atgcgctccccctccatcttgcaagctcgggcagaacttgcatgaaagcacaatccttccaaccctgcatgatatcatccttcaggactccataaggaaagactctacgagcggatggacagaatctacatcattgtctctggattgccatggctga

SEQ ID NO: 78828 - DNA, 576 bp, Triticum aestivum
  Clone ID: PAT_TA_78828
gacgaggaattctgtagttgtccaagaatggattagaaagaatatggtacaaggaggttagtttcttaagagaggttgatgcagtgatcagttcaggagtgaccccagctgagaggctgctcaatttgtacgagacgaagtggcaacgcagcgtcgatcctgtcttccaggagttgttatactgatgctgagaaacctcttacacagcaaaactggacagtctgtagatgtactccccccatacagaaaaaaaactcatgtccattctattccatgcctcggcagctaatgtccgccgtccgttttttcttgagcctgaagagggaaaaataaccgccgtgcagcaattcagcttcacggactcaattgtttctgcctcctggaacatttgagttcggaagcctttgtaggtgctgtctttgttggggccttttacaacttccgatttccctcgtcaacagggagatgggacaaaccactgtttgtaccagaccctcttttgttcctgatgatttttgtatgaaaaataagcccatctggtgcatgatggaaactaaaaaaaaaaaaaaaaaaaaa

SEQ ID NO: 78829 - DNA, 412 bp, Triticum aestivum
  Clone ID: PAT_TA_78829
cgttgaacaatcttcggtcgaccagtgagccggaccatccatctgccagtgccagtgatgtaacaacggcaactgcagcgacagatacgtgaggtcgcagccggcagggcaaagctatttggtgcggttgcaggggctgctgctccgccctgtccggcacgagagcgtggagagtgacggtgagccggcggtggccaacagtcgcttggttggcactgaagagctgcctagcatagttgtagatgatggccatcagctgccagatcgctgactgatttgatgacctgaatgattatgagtagggaacattagtaagggaatcaaattatgcagcggtttttcttttgctgtgtattttgcgagtaaataatactgctatataatgttcacgacctgttcaccgtttgtgctc

SEQ ID NO: 78830 - DNA, 737 bp, Triticum aestivum
  Clone ID: PAT_TA_78830
gaggctttccatactcactgaaatcgttcatgatgttcccgccaaaaaggaagaagtttcctacaatgttgcctcaccagccgtttctggtgtacgatcagtctctgttgctccccaagttgctccagtaaacaaggttgtttcagctccagctcaatactctgcctggtctggtgaagttgctgctccagctccagcttcaggatcatgggtttcagatgttaaacccgctacatggacctcagaagttaaacccgctacatggacctcagaagttaaacccgctacatggacctcagaagttaaacccgctacatggacctcagaagttaagcctgccgtctgggcatcagatgttaagccttcttcatgggcttcagaagttaagcctgttggatggacctccgaaatcaagcctgcttcatgggcctgggctcaacctaaaccatcatacagacaaggtgcttgggctgatgttaagcctgcttcatggtcatcatggtcagaaccaaaaccattgaatgcctacgtttcccaaccagctttctatggtgctgaatacccacaaacaatttacaccaatgcccaccatgctgctccttggtcatcaacttggtcatccgctcacccagttgcatggaccgaaccaatccaaaaacgatctgaacgaaaacagttctagattaactaaagattaatcaagtactgattcagaaaaaaatgaaatcaaaatgatc

SEQ ID NO: 78831 - DNA, 543 bp, Triticum aestivum
  Clone ID: PAT_TA_78831
gcagatctcctgtggagctgcacattttgttcttgttgctggtgatgggtataggatgtgggcatggggcagaggccgtatgtggtgtacttgggagaggccagactgctgacagttacataccctgtgttgtgatgtggcctcctcttgatgagaacttccaagagatccatgaggaccaagcgggaggatcaacatcaagagtgaatgatcgcactagcaccgagttaactcagaagctatctgctgcctcagaggagttgcaattcctaagatcaaaactgacactgatggagagatatgccaatatacttcacatctcaatctttcgtaagccacttgatgaacgggcgctaccacgttcacttcaggaatcttctgtctttgatatcagaaaggaatttgagaacattttggatgcagcagacactgatgaacttaatcgtttggagatcttctaccgcagcatgctttctggcgtgaaagataagcttctgaagagaagagtccaagagatggtccaacaatgcataatttcactct

SEQ ID NO: 78832 - DNA, 533 bp, Triticum aestivum
  Clone ID: PAT_TA_78832
cctcgccgccatcgtcatcgtcgtcatacctgccgccgccatcgtcaactggccggcctagccgctcgccgcacgtggtggtcgatggtcgcgcctccaccaacttcttcagcgcgtggatccagtattgatgttggggagctcctacttttcctacttttcctacaaaactgagctacttttctgcatggggcacgccaccgtcggcagtctgctgggcaagctaggatgcaggaacttggagctgggaggctgatcttctccctcctgttctctgcttctatggctggcagaggatgagataaagtggacttgcgggcaagtgaggactgtgagggaaacaaataagaatttggatgagatagttgaatattggcaaagaaactccaggttacatttctgcaaccttaaaattgacacagttttgttaaagtgcattggttctgctctttgttcaaacatgatctgataaaccactgtggggaactgcatagcttttcatgcatccatgctacatgcatggtgctgctact

SEQ ID NO: 78833 - DNA, 608 bp, Triticum aestivum
  Clone ID: PAT_TA_78833
gaagagcttggagaaacgctttggccagtccccaatttttattgcatccacctttatgactcaaggtggcatacccccttcaacaaacccagcttccctgctaaaggaagctatacatgtcattagttgtggatatgaggacaagacagaatgggggaaagagatcggatggatatatggatctgttactgaagatattttaactggtttcaagatgcatgcaaggggttggatatccatctactgcatgccacttcggccttgcttcaagggttctgctccaattaacctttctgatcgtctcaaccaagtgctacgctgggctcttggttcagttgaaattctacttagcagacactgtcctatctggtatggttacaatggaaggctaaagcttctggagagactggcatacatcaacaccattgtttatccaattacatctatcccactaatagcctactgtgtccttcctgctatctgtttactcaccaacaaatttattattcctgagattagcaattatgctggggcattcttcatcctgctttttgcttccatcttcgccactggtattttggagcttccatggagtggtgttggcattg

SEQ ID NO: 78834 - DNA, 543 bp, Triticum aestivum
  Clone ID: PAT_TA_78834
tttttttttttttttttgtgaaaaaatgatttattgaaatagcaaattgctagttgcacaaatggaccaaaactaggaatttttctaagtcacagatgtgtttgatgtacataggcaagctaaggcctttacctatcctgaatctgatcttaaataaagtgttctgtatagacaatacacatggaacaaacggtgttcaccttggagcaactcgttcttgaatcagatgggggctactgccaggtcaatggcatcaacagctgtcatagctataagctatgcactagctttaccacgctgtacaggggctcggagggaagctctgtaggcggcgtcggacctctgaatcccatcaaagacgtagccgaaaggtggcatcatgacgtatcttcctgaaccaggtgtaatgttcagaacaccatcctcccatacccaacctggcacaagtagaggaatgcatgctgtcctgtcaaacctgggtgtggtatcaccagttaatagtggtgagagattgtttgttggtgagatagttgttgggggaat

SEQ ID NO: 78835 - DNA, 492 bp, Triticum aestivum
  Clone ID: PAT_TA_78835
cctctcctctcccctccaatggcgaccgccatttcctctctagtaactcctccagccctccaccgccgctgcctaagccctgcctccgtctccgtctccgcccctatccgtatctccttccgggccgccgcggcgtctcaggcgtggcgccggggcttgacgctgcgggtgtcagcctcctcggcagtgctcgaggcgccagaggtggtggcggcgcggaagctctacgttggaaatgtccccaggaccgtcaccaatgacgagctccgcgacatgttcgccgcgcacggcaccgttgagcgggccgaggttatgtacgacaagtataccaatcgcagccgacggtttgggtttgtcacgatgagcactgtggaagaggccaatgctgcagtagaggctctcaatgggactgaggttggtggtagaaaaattaaagtgaatgtcacagagagcttcttaccgaacattgaccgatcagcacctgaatcggaa

SEQ ID NO: 78836 - DNA, 317 bp, Triticum aestivum
  Clone ID: PAT_TA_78836
gattgccagaaggaagagagattgatagagtggagaagatgatatgctgcgttgaccaaaatcatgatgggcgtgtggatttcttcgagttcaagcacatgatgcagagcgttgtcgtccacacctcctgattggatcggatcccatccccttctttacacaatttctttctttctgttgttaatttcgtttatgaatttgtgtgctgctcctcgtcgctgtcttacccaacattcttgtacttttataacccagtaatattacgatgaaattaattttacgaaaaaaaaaaaactagaaaagaaaaaaaaaaaaaa

SEQ ID NO: 78837 - DNA, 629 bp, Triticum aestivum
  Clone ID: PAT_TA_78837
ttgatgagcgggaaaaagaattgatgagatgttgaagcgtaataaccagcaaaggtccagcactgttcaagtgctcgagggtctgctggcatcacaacgtgaagcatgcgctgaagccaataagagggcagaggacctgtcattgatgttgcaagcaactcaaggcaaactggacatgctccaacaagaaaccacccttgatagcaagctcaagacctctgcaaggcgcttaagaggcgaggctacagagtctgtacatgatatggatatcgatgaggacagcgtgaggcgtcggaaacgatcaaaaagcacaacaagccctttcaagagcactcacacagaggacggtggttccgtgtttgttggtgaagatactcacaacgggagtcagcaggggacagaaaccgaagactataccaaattcactgtgctgaaactgaagcaggagctcaccaagcacgggtttggtgctcaactcctccagttgaaaaatccgaacaagaaggatattgttgccttgtatgaaaagcacgtcgtcggcaagtagtagttcctcgttcctcggtaatacttgtgtgcttacactttatgctttctagactttcctgtagcgttgaaacttgaattga

SEQ ID NO: 78838 - DNA, 477 bp, Triticum aestivum
  Clone ID: PAT_TA_78838
gactttgacaagtttgataactatgtgactgcaaaggaggtggtttcagaatggtctcaaatggaggagatgaatgagaggctaaggttctttgttgaagaatgcgaccatatccagggcatccagtttcttgtggatgattctggaggctttgccagtgtagctgcacagtttttggagagtatcgctgatgattacacaaatacccctgtaatgctgtactgtgtgcgcaatccagactcctctgggtcttccagaaatcagcgcgaaaccatcataagatctttgcacgatgctgtgtcattgtcgaaactttcatactcctgcaatctgatggtaccaataggactgccttctctaagttacttgtcacctttgctttctataaaagatgataaacacttccactccagtgccatttgtgcagcagcaatacattcattgtctgttccatttaggctacaacatgtgggcccg

SEQ ID NO: 78839 - DNA, 504 bp, Triticum aestivum
  Clone ID: PAT_TA_78839
tccgcacgcacgcccacaaaaccactaagaaaagaagaggaggaacgccgcaagttcacgcgacgatggagaacgccgctggtgctcccgctcccgccatcaccaagccgtcgctatccaagaagccctcgccgtcgttccgcctccggaacggcagcctcaacgctctgcgcctgcgccgcgtgttcgacctcttcgaccgcaacggcgacggcgagatcaccctcgacgagatggcctcggcgctcgactcgctcggcctcggcgccgaccgctccggcctggaggccgcggtgggcgggtacatcccggccggcgccgcggggctccgcttcgagaacttcgagtccctccaccgcgcgctcggggacgcgctgttcggccccatcccggaggaggtgcctgaggacgacgacgagggggacatgaaggaggcgttccgggtgttcgacgaggacggtgacggcttcatctcggacgccgagctgcaggccgtgcctcaag

SEQ ID NO: 78840 - DNA, 586 bp, Triticum aestivum
  Clone ID: PAT_TA_78840
ccgccgcctgcccatcccccacccgtaccatccacactgcctccacaagtcgacgcccaccccagccctcggcgcagaggccaccacgcaggatccggtgagcgatgtaccaatccccagcctccgccctcaccctgccctcggtggatctagcctcggcacagaggttggcatgcagctcgcggaggaggttgaagacaaagcgtgatccacggagaaggctgaagggtgacgccccacctccaacatgcggtggatctggtccgatctgcaggctaggcgagttccgcatggagttccgcatgacgcgcacaacaggaacagaaggagttccgcatggaggtcgcgagtcccacctgtaggctaggctggtagcatattccctttcttgtactctgttccgatctataatctgagatggtttccacctttaattttctccagctacttattttcttttgtgttttgttcatttgcaggttgcagctttgcagaagcaagacaagcaaggcaccctagcttggtcctgcctaattgatttttttgccaggtgcagttctgctttgtattaaaaattaggatgatt

SEQ ID NO: 78841 - DNA, 602 bp, Triticum aestivum
  Clone ID: PAT_TA_78841
ggttgagaggtcgatgatgagaatttgctagccgtcttgatcgagtggtagctgacttggggagaaaaccccttaaggttttggtccaagtcaacactagtggagaagaatcgaaatttggagtagatccatcaggatgtgttgaactagcaaagcatgtcaaattgaactgcccaaaccttgtgttctctggtttgatgacaattgggatgcttgattactcatcgactcctgagaatttcaagacactggccaactgccgtgaaggggtgtgcaaggagcttggaatacccgaagagcagtgcgaattgtctatgggcatgtcagctgacttcgaacaagcgattgaaatgggaagcacgaatgtaagagttgggtcaaccatatttggtgcaagagaatacccaaagaaaaactagagtgcttatacattcctgtcgcgatggcacagaacatgtaggagtctgcaactgttccaaatttgatgatgcatcatatatgtgcagttgtgcgcccattctactcagctgaaaacattttgacaactttttggctgaagtattaataaggatgctgctgtgccattgtctgcttctgttaat

SEQ ID NO: 78842 - DNA, 355 bp, Triticum aestivum
  Clone ID: PAT_TA_78842
ctgcctgctgctgcatgagattgctgagaatatgcaactgttggatggctgaaagctgcagctgcaactagcagccgaacaagcactagatggcctcagttcaccgtgaatcaactcggtgctcgaacataacaacttatgactattgagaatatctactaagaacccctctgtataatattactagatcctctttttttgtattttctttcctaggactagcttccagtattcctgagctcctcatttccttgtgttctcattatgactatgatggtgtagagagagatggatccatctaaataaaagtgcaagatttttacaaaaaaaaaaaaaaaaggggaaaaaaaaaaaa

SEQ ID NO: 78843 - DNA, 713 bp, Triticum aestivum
  Clone ID: PAT_TA_78843
gggaactgagtcaagtggtttcatgtacccaagtgcagtagaccattttaaaaagcagtttgcgtaccttgaagaacattatgccaagggatctacaggaactccacctgagaggcaacataattcattgccacggccttctgttgtctattcggacaaccgatcacaaaccacagccaacatcaccgaggatctttccaagtgtataatcagagaaaatacacaaaagccacatcaacattctgcttatgttgcaagtaaatttccaccccatgttcctcaaggtgttgttgcaaggcctggtaaagcggttggttcggtgatgcagtacaacccctatccagcatctgctgccgagcaatatgagcaacgaagaattgctaggcacccagcagttgccccaaacaatatcccttctggaagctcatacccgagaagaagtcagacctgcaagagtgagacaggtgatgctgaaaggatggatgtgaaccaagctgggcagccaaagccatatgcagcgaacaaattaccagctacggttgatggtcgtggtggccactggtagaatttctgcagtgcaccagcaaaccatttcaatccatttcttaacatgttatcagtatcgactacttatgctaagcgctacattattctgacaaaattcagaaatgtagttctgtacagatttatattctttgtcaggatacctgaat

SEQ ID NO: 78844 - DNA, 630 bp, Triticum aestivum
  Clone ID: PAT_TA_78844
tctctatatcagcaacagcagcagcagcagcagcaacaggttcctgctcttgttcgcagtaacagcagagaccttgatgtgcagtttgccaacttgtctctgaaacacaaagaccccaactcaggccgggatgctctctctgggcctcttcgtacttagtaaatccttccattcttgtgggtattatcagttgccaccaacgtgtggctgtcatctccaccaagaaaggagaagtgcacttggattgcgtgaataacaccagaaaaggctaatagctatttatctgatgtttattatttcgggatatgcacctggcggtcatcctcagctcgcgtccattggtgatgctcgaccagtcggcggtgtttagggttttctttttagctagatgcttttcaagcatcattgtaccatttcccatgctagggttctaatctgttactatccccttttttcctgagctgtattcttcatgcatcgtagccatgtttggattagttctgcgttattagtggaatgtggagcactagtcagcatcaggtaagttgctttggaaatgtgccacatccttgataactgtatgttgtgctattatttctcagtactcaataagctagtgcaaatgaagta

SEQ ID NO: 78845 - DNA, 614 bp, Triticum aestivum
  Clone ID: PAT_TA_78845
tattgaaagagcttgaacatcagaaatctgaaagccagaaaatgactgctatggtagctgaacgtgatgctctctatcaagaattgctccaggctagggcgaaccttgagttcgagaagaaggcaaagccagagctaactgcacaggttcaggcaatggagaaggatcttgtagctatggctcaggaggctgagaagctgagggctgacattgcgaagcgaaacacacctagtagtttcagcacccgtggaacttatggagcctctttgtcgactcctgcgatgggtttgcaaggcatgtatgatggcagctatcctacggttgggagccgctatggcagtggcactggggcttggagctcgcatgatccccatggttacccgcatctttaattgtacttctgagttctgaccagtgttctccctgaacagctccctgagtaccttgactaagtatctcgtagtataagttttggtgcaccatcgctaccttttctggtcaatacacagcaatatacctattctggttgtcttggttccttcttttttcccttactagaaaaaaaaatcgtgaccatccctactgcacacgctgatgctgtgtgctgatatgct

SEQ ID NO: 78846 - DNA, 283 bp, Triticum aestivum
  Clone ID: PAT_TA_78846
ttctgcctgaagtgctgttgtatcctattggtagactgcgcgaccacacgcagagctgagttgtagggataggatgtcttttatcaaccgattgtagtcttagattgtatttgatttcattgctgatgtccattcctgaattcctcctggcctcagacgacagccagctgctctgatgacttgctgaaactgtttgagtacagcgtacatataagcccaaaaagagtgaaatacaaatcattttgcacctgctggtgacctgttcaaaaaaaaaaaaaaaaaa

SEQ ID NO: 78847 - DNA, 439 bp, Triticum aestivum
  Clone ID: PAT_TA_78847
gtcacctacggccgcctgctgacctccatgagagccatcatgaagaaccgcggtgggggacacgatctgcagggccccatcggagcacccacccacacggtggccaacttcagcggcgtgcaggagccgaacctgtcctcgtcggagatgtttgacatacaccgcaagccgttcgtcctgtaaaacaccacaccaggaccgctccgcttgtacgcacaaatcactattactgctgcagttcaacaagaatacttaatgatcgccgtatcagaataatcagttatccatcgggttgagctatgatgcttcctagtgtaaaccaagtgtaataatcagttatcctcccttagacttctagtgaacctcagtgtaataattaaggctgtcgttcatggtcctcttatatacgtatatatgtaaaccaagtgctacatgcggc

SEQ ID NO: 78848 - DNA, 174 bp, Triticum aestivum
  Clone ID: PAT_TA_78848
tttttttttttttttttttttttttgccaccacacagatacaatgcaaatagcgtccacataatagtagcgaattcacagatataatagtaacagtagcgaattggacgcatacagcaacatagatattggaaaactccaatccaatcttctcagtttttccaaaacatttcac

SEQ ID NO: 78849 - DNA, 521 bp, Triticum aestivum
  Clone ID: PAT_TA_78849
gcatgctgctgcttatcgctttcttctgccttctaatgcttctcacaactctctgaaacaaactttgctgatggaagatttctctgaagcaatgcatggcttccttccagtcgccatgcgtgatcttaggaaatatgctcctgatgataaagatggtggttgggaggatgttggagggctaaatgaagcagtaactatcattaaagagactcttgaactgccatcaaaatacccaaatatctttaccaaggcacctgtgcggttgcggtcgaacattctcctgtatggaccacctggatgtggtaaaactcacattgtgagagctgcagctgctgcttgttctttgcgattcatttcagtcaagggtccagagctattgaataagtatattggttcatctgagcaatctgttcgcgacttttttgcaaaggccgttgcagcagcaccttgcctattattctttgatgaatttgactccattgcaccccagcgaggaacccatagtgctggagtttctgatc

SEQ ID NO: 78850 - DNA, 561 bp, Triticum aestivum
  Clone ID: PAT_TA_78850
ccttcggctaaaggccaccttcctgtacattgacctcagccgtgtgatcaccttctgcgagggcgaagagcataagaaggcgctcactgtccttgccaacaagttcttctactccatggatgagctgagcgacgcagtggagagcagaagcctccctctgacgcaggtgcggtacagcgacaccgctgacgcgctccgcgaggtggtcgccgtcctcgcgccgtccctgctgcaggtcggcccgcatgatccggaggaatagagagatcagtctcagatgcgccccctgcctggcccctgcagtgcaaacgcgatatgtcgtcgtgacgcgggcgagagctgggagctgatagagataggatagctcatatatagctcgaaacctgcaggacagtggacagacgtacggtgagacgggtgaggcagcgtgacagaaaaatgccgtgtgcgatcacctgtgtgtggctgtgtatacatgtctcagatttgggttgccgtcccttccccgccccctttgcgtttcgcgtgctgccgatatatgctctgctgctctctgatcct

SEQ ID NO: 78851 - DNA, 709 bp, Triticum aestivum
  Clone ID: PAT_TA_78851
tagcctagccgccggctgccggcgcgcgggaaccggatgctatgctgctgagctgcgggtcgctctcctcctgggtgcgccgcttcgtcgcctgcgttggagcagaggttgttttggttgtgcccagcctactccgataatagctgttgatgagcctgcaaaaggtttaagaattcaagggcgctcagtaaaaaggcacaatttatctgacgacttttggagttcaagcccgcacgaaatggagaacagtgccttgcaatcccgacatagtatgtcttcaatcagcacagcagcacaacctaatgatcagcatgcttctggaagtagcagctccccaaatgattttgtaaatcaaggtcttctactatggcaccagactagacagcattggattggaaaacgaaggcgtaattctcagggtcaacaaagtcaagaaccaaaaataagtggtaatgctacatatgagagccttctgggaagctcgaaaccatttccacaaccgatccctcttggtgaaatggtggatttcctcgtggtcagctgggagcaggaaggcctatacgattagagttggttatgcgaagtgtgttgtttgtagccacgttatgattcgctgaaatgtaacgcaacttcattatgctgcgaaagcctgtgtcgtgatgaatgtggattcactggattgtctcggaaaaaaaaaaaaaaaaaaaaa

SEQ ID NO: 78852 - DNA, 156 bp, Triticum aestivum
  Clone ID: PAT_TA_78852
cgaaggcgaggcagggtagggccgagggagggacaggagcaccagccatgggcacgtgagcttctaccgcaactatggtaaaacattcaagaaaccaaggcgtccttatgaaagagcgtcttgatgctgaactgaactggttgggagatggctgag

SEQ ID NO: 78853 - DNA, 297 bp, Triticum aestivum
  Clone ID: PAT_TA_78853
aacgcgctctctcctcgcccagcttccggaactcgccccccgtccccgtcgccaccggcatggcctccgccgtctccctcgccgcctcctcctcgcccctcgccgccacctcgccctcgcgcgcgccgcgcccccaccaggcgctcccgcccgcccgcggcccgcggtcccaggcccaggccctccgcgcggtctccggccccgccgggagccgccggtggggcgtcggccgcggcgcgacggccgtctgcgccgtccagggccaggacaccaccatccaagttcccgatgtcacga

SEQ ID NO: 78854 - DNA, 721 bp, Triticum aestivum
  Clone ID: PAT_TA_78854
ttatcccccctcctccacggcctccctccgccaaggccgccggagcccgtcgccggaggcagctgcagggaaggacgccgtcgccggacacatgcggggttgggcttcccagatagcttgtctcttgctgcactaagctcttccaatttttaaaaatggcagctcccaagcccattgctcggcttatttcccatgtcattcttgatttagatggtaccctcttaaacacagactgtgttgtaagtcaagtgctgaaaccatttctagtcaaaaacgggaaaaagtgggacagcaagaaagctcataaattagttggaaagacaccttatgaggcagcagctgttgttttagaagattatggactcccttactcaacagaagaatttctctcaatgcttactccaatgttcaatgagcaatggtgcaacataaaagctcttccgggagctaatcggttgataaaacatttgaagagtaatggagtaccagctgctttggcttccaactcaccaagatcaaacattgacgcaaaaatttcctgccatcaaggatggaaagagtcgttctccgcaattgttggtggtgatgaagtagagaaggggaagccatccccagatatatttttggaagctgcaaaacgaatgaatacaaatcctccaaattgcttagtaatcgaggactccttaccacgtgttgcagctggaaaagctgcaggaatgca

SEQ ID NO: 78855 - DNA, 418 bp, Triticum aestivum
  Clone ID: PAT_TA_78855
ccatccatctcgtgtgcccccattcgcgttcccggccttctagaactgccaccgccgctaccccgcctcattcccctggccccagcaccgcgcgccagcgccacaccctcccactccgaggctccgaccagcgcgtgtcccgcgttccgctcccgcgcctctggcctccaacgacgagacgacaccgtcgcggctcagcccaccgccactaccccacaactatcctcgctgtctcccactgagccatggtcccagtcgcgtgacgaggcccaccggccagcgtcacggaaagctccccttatctgcggttaaccccaccgcgaggccgcgcctcacacgccttgggttcgggctcatcatcccacaccgcgacagcgccgccactttcctgacaacacacaaaaaaaaaaaaaaaaaa

SEQ ID NO: 78856 - DNA, 266 bp, Triticum aestivum
  Clone ID: PAT_TA_78856
cggccggcggcgatggcgcccgtgttgacgtggtgctggtgcagccactgcggcgtggaccgtcgcctgaggagggagggtgactacgcctcctgcagctcctgcggcaaggtcctcctgcagctccggggtgacgacgacgccgccgccgccgaggcccctcgccttcgcctgctcctggggccgaggatgcggaggaccaaaaagcgcgcggcggcggctgatgctgcaggcggcggtggagttgccgccggcggcggcggcgg

SEQ ID NO: 78857 - DNA, 510 bp, Triticum aestivum
  Clone ID: PAT_TA_78857
cagtgtatatttggaaggattggatctgtgcgagtgaggaccttaccttctgtaccagaaaacaatgaaactgatgcgtcttttgacatcgatgtccagatgggatctggtactggatttcagtatgaagctccggaagaatattacactgctggttcagtaacacttcattgcccgaccactgcttcaagcgaaattatagcatcagtagcactggatcaaacagccttggcaaaccatcaggaggattatcagatgtctttcacaaacaatggtccttcacttggtcactggtatccggagcaagagcatctaatggcttctcagtatgcatctcctttcccactgattatgcaagctggtgatcctgttttgtcgacacaaagcagctttaacattgatgagtttatcaaagacctcccgcacgataaatatcagttctgcgcacccgatgtgagtatgctgccaaccgatattggctgcagcatgacgaaactgcctgcctatcgt

SEQ ID NO: 78858 - DNA, 477 bp, Triticum aestivum
  Clone ID: PAT_TA_78858
gaaccctgctctggaggtgcctgcccagcaggatcagggtgcggtggaatatggaaacctcggcgaggtggcggcgaggatggacatcgaggtgaacgactaccctggatccggtgccaacaaccgccatgaacctaggagccctgggagaccatgaactttgcttgacgccccgtcatatatatcatccctgcgtacgtctcacagaagaacgaagagcatggcatggagtcttgagagttttataattaagctactaagtacgtagcatgcagcaggagtacattgttagctataaattctactagagcttattaacgagtcttgtcgtgtatacttaattacgtagcttagtacttgtatacgtcgatcgtatcgtggggtgtggtacggccggtggtgctgaggccgtctaagctagctgcataggattttgttaggggcttcaacaacgcactgtcagaagatcaagtgaac

SEQ ID NO: 78859 - DNA, 418 bp, Triticum aestivum
  Clone ID: PAT_TA_78859
ttttcccttatttttgtggtatgcttcctttcttggttatagacatcatctggtccatgctcatgtgtacggtgataaccatatacatggttcccttgcagatttgtggtttcattagcattgatgcttaacatttttgttttattctgatcatgagatacttggatccgctttgccactgaaacttcttttatacattcatcttggtaattgttttctttatattgaggttactcagttgatatgaagaggtactgtcactctttccttccttctaagatctgaatcaaatttctacatgcttattattattgcagagataacctaattattgcagagtcaattctttgtgtattatcagtttccaaattatgccatgtcatcctcacttgtttgattgttcaacgatccgcacttg

SEQ ID NO: 78860 - DNA, 572 bp, Triticum aestivum
  Clone ID: PAT_TA_78860
ctgctgatgttctgttatggaaagacaagaaaacttctgctgttgtaatagggggtgcaactgttatctgggttctgttcgaagtgcttgattaccatctcctgactctgatatcccatgcactgattggtgtgcttgccatcttattcctctggtccaaagctaccacctttatcaggaagagtccaccagatattccagtagtgcagatacctgaggatcttgttgtgaatgtttcacgagcattatgcaatgacatcaacagagcacttcacttattccatgagattgcaatggggcatgatctgaagaagtttttgtttgtgatcgtggggctgtgggttaactctgtatttggaagcagctgtgacttcctcaccttgatatacattgccgtcctgttgctccacacggtgccaatcttgtacgacaagtaccaggacaaggtggaccatttcgctggaagggcacacaccgaggccctcaagcagtacgaggtgctggatgccaaggtcctgagcaaaatccccaggggtccggtcaaatccaagaagcagaactaggatcaaccg

SEQ ID NO: 78861 - DNA, 601 bp, Triticum aestivum
  Clone ID: PAT_TA_78861
tggctgttgctgcatccaataaaagttcatccaaacccagattgagttaccctgacctggaagaacaggcccttcagtttatcttggactgctgtgaacctaatatagcaaaatatacaaagtacttagagggtggcggtggctctccagaagtttcaatgaatgcaaaacaagccaacagaacattactgctaaaacaggtagcaagagatctgtgcatcagtgaacggagaatcctgtatcgtacacaatatatattgcgtagaagattgagggacatgagaggtggcgaacttagagctctgtcattgttcaatgggctaagaaaactctttaaataaatggatcggctatcttatcttggcagatcttactggatccagtaacatggcgctttgaccttactgccgaagcctcatatgtttgtttgccaaatcagactgcagtccaggatctggaccgcaaatttcatcctcggagaaacatctggatgctagaaactagtaattcttcaatgaaggatagctgtgcgttgacattgaacagcccagagcttatatgtaaagagtaatcggtgtaatgttgattcaattcaaccatg

SEQ ID NO: 78862 - DNA, 642 bp, Triticum aestivum
  Clone ID: PAT_TA_78862
gcacgagggagcgaatatccaaaaggtgttgtcattgaagaagttgtagatgatgcttctgagccatcaagcagtcaaagaagttcatcccctggatacactgtttcacaacctcctgaagaagggaactctagaccttcagggtcttcaagcatagatgctaatggcttatcgaagctgggaatgcagggaatgtcacctgaactagtaaaaactgccagcgatatgattggcacaatgaaaccagaagaacttcagaaaatgtttgaagctgcttcttcgttgcacggaacaagctccagtcctccaaatttgggacctaatatgccagaaatgtctcctgagatgtttaagatggcatctgacatgattgggaatatgtctcctgatgaattacaaaatatgctgaattttgcttctaatatgggtggacctagtgcttcccccttgagaccagagaataagcttcaatcttcatcaagagccacaacaagtagtacttcccagagatcagtggataacagccaaccttcatcttctcaaaatgtcatggaaaatcctcatgaaatattaagcaaccaaaggatgggtgaatcatcatcccctggtgcaccttctacagctgatatgcaggaaaccatg

SEQ ID NO: 78863 - DNA, 509 bp, Triticum aestivum
  Clone ID: PAT_TA_78863
ttcatctttcttgccagtaaacccacaggatcctccactggacccgtttcttgtccacacactaaccattaggtttgaaccaaagaagcagagacctggtgattcatctgaaggagctagtgaccaaagaaactttgagctcaaaatggagttcataaaagccttgccgagtggtcaagaaacagaaattgtactggtctcatgcacaggctcaggaattgaagctaataggagagaacaagtcctgaaagcaaagaaggctggagaagatgcattgaggagatctggccttggatatacatttgtacggccaggtccactgcaggaagaacctggcggtcagcgtgccttgatcttcgaccaagggaacaggatctctcagggcatcagctgcgccgatgtagcagacatctgcgtcaaagcgttgcacgattcgaccgcgaggaacaagagcttccatgtgtgctatgagcatgtttcagagcaagggagcgagcgtatatgaactt

SEQ ID NO: 78864 - DNA, 463 bp, Triticum aestivum
  Clone ID: PAT_TA_78864
tcaccataaaatcatctcaaaggtactagagagaactcttgtagacaacattttcccactgtagaaatgttgttggttatttgcgttctgcttgttattcaatcattaaatgccatttagactaattgcaaccaactcacaccatggcgtgttgtgttatctctgaattacatggatccgtattatagacatcagtcaatgggagttgttggttggaactgtatggtcaagcgtgtgctgcttgtcagtgtggccaagcttcatactcttaatagagatattgagcaaactggcctagttattgagctacacacttatatttgtattactggaatgaggatagcctgtataatgtgatatgttgtgtttcacatgagtctaggaaggaggaccttgtgagaagacacctttgggaaaagagcaacatggacaggtacactgcacagactataaaggaatcaaa

SEQ ID NO: 78865 - DNA, 636 bp, Triticum aestivum
  Clone ID: PAT_TA_78865
atgagatgaatgacgacttggtgactttggtctagcaaagttgtatgatcatggtatcgatgcacaaaccacacatgttgttggcaccatgggctacatagcacctgagttggcacgtacaggaaaggcatcccctatcaccgatgtgtttgcatttggagtgtttcttcttgaggtcacttgtgggcgaagacctgttgaacacaatagagagaacaacacagtatcgatgttggtcgattgggtactagagaaatggcacaaaggactgctaacaaaagttgtagacccaaggatacaagatgagtttgacattaaccagactatcttggtgctaaagttagggttgctatgttcccatccggttcctgattctaggcctaccatgcgtcaagtcatgcaataccttgatggagacatgatgttgccagagcaaatgccagaaagcttgaccctcggtatgcaattcatgatgcaaagtgaagggtttgattcatacatcatgtcacaagcaacgacaatggttagtcatggcacactaaccgacatctcgggtgggagatgaagcggtggtaataagatacaagtagattggcactactaattattgtacttgtacttgtgtatgcaagaatc

SEQ ID NO: 78866 - DNA, 217 bp, Triticum aestivum
  Clone ID: PAT_TA_78866
cctggttaattttatcttttttttttgagattttaaccaagaacatgcatttgaaacttaactaatttggtcaccttttctgtttgcgtggttgtattaccactagttctaatttgcaatgttaaaatctagaactatttggtttgtggagcagcaaactaaattttttaaaatattcaaatactgatcatggtgatattgtttttcagattacgtt

SEQ ID NO: 78867 - DNA, 559 bp, Triticum aestivum
  Clone ID: PAT_TA_78867
ggagatcgaaatgcattaggttggtttgctctctcagcttttcacataagaatacatgtgattgtggctccccgtcttcatgtataaagttggagattgatgtatggaatgtagtgacgcatagtttttttttaatcactgctatcttggagaagttacagctattctcgctgtcatccaacaagccaatactacccaggttttcctaacatcgtggattgcaccttatgttctgttctgttgacgacattgcgtgacttcttttgagtccctactttctagtgtgaagcaggcaggcgagattctttaatcacgtgatcctagtgattcatgcatgaaattgaagttacgaaattcagttcatgacaaaatctggtaagagcctgttctgcgcttctgcttgatatgaggctgagagctctatgaataataacggatgtcacctgtttgaatatgtccattttgtattggtaggctcgatatggagctataattgtacatgataggagatgaatctttcttttttcacttgtgcaaagttatgattaaacactaaaat

SEQ ID NO: 78868 - DNA, 631 bp, Triticum aestivum
  Clone ID: PAT_TA_78868
tttgtcgaccaatgccatggaagcattcccagtaccgactattactacatgtcagcaagatccttgtccagtagtccagtgccaactgctggtacatggttgggcagtaatcgtcaatcatcaaggactcccccacaaacgaatgatcaaaggggatctttagttggtgagatcgctccagcacattctgcaccatctactgtaacaaaaaatgccctctcagtggcaccatggatgggtcttctattgggtatgtgtctcttgcacattttagttggaaacacacatagggaaatgccaagtggaactgtcataccagttggaagaaggcttttactgtttgtggatgatcatggaaattcatctctcagccatggtagtggaagtgaaattggaagctttcttggttgggctatggcaataatttatatgggtgggcggcttccccagattttgttaaatatgcaaagaggccatgttgaggggctgaatccattaatgtttgcctttgctttagtgggaaattcaacatacgtaggaagtatacttgtaaatagcatggactggtcgaaacttaaaccaaatctcccgtggcttgtagaccctggaggatgtgttttgctggattctt

SEQ ID NO: 78869 - DNA, 216 bp, Triticum aestivum
  Clone ID: PAT_TA_78869
ctcgccttgcttgctgaagtcaagttcttgcgaaggaagtaccaatcctttctcaagggtggctcacagcagaaacattacaagttgaagaagcaagctcggtacatgccatctccattgggaagcaacaaggccaccgcgttaggtgatcatggtgcaaggaccaaagtgccttctaccagcaaaaactcaaaccttcacttaaatcaagattct

SEQ ID NO: 78870 - DNA, 556 bp, Triticum aestivum
  Clone ID: PAT_TA_78870
agactgtcagttactacactgccaccatcaagctacagattaggagttcgtccatctaatctccatgagctattccctccttacataactgaagctttacaacagtcaataataatgattgacagagagatgccaggctttgtttctagcaaggccctacttcatggtgtggagactaggacaagttctcccttacaaatttcacgacatggagaaacatacgaaagtacatcactgcgaggattatatccaattggggaaggtgctggctatgctgggggcatattaagtgctgctgtggatggtatgtattgtggttttgctttagctagacagctatctctattccacggtgatatagagtcatttcttggcaaagcacaaaaacaaacaggttttgtaaagtattgaatggcagtgcctagtattttattggtccaaaattttggggaatgattctcgccatggcagctttatatcataggacaattttgtcatgtttagagcagctgtgattgccttactgaattcatcaactaatttgtgcacggttgat

SEQ ID NO: 78871 - DNA, 472 bp, Triticum aestivum
  Clone ID: PAT_TA_78871
atccgaccatggagaaggtgtctgtgttgggagatccagtggcggcgcacagccctcgtggcctcatcggtgtcgagcaaggatggccagatgcgaggggaacgatgacgacaagcataatgaggtatagcccctgtgtccgctcgtgctctgtaggtccttggctccgcacatcatcttgtctgtcctgcagggtgcatcgagatccttagaatcctgtgggtgctggtggtggagtgggcctcgcagcaggcctcgccggcgaccgtgttctggatctcaagcagtcgcccatgagcctcggcacaagatgcaagtgcctgagatttgcaaaaacttcagattgttattattggctaacctggaggtatgaggatgctgtgtggaacgaacattgcagctacatgaaatgaggatgttgctatactgtatgtcttttgatctacctgtatagactacttaccttatattt

SEQ ID NO: 78872 - DNA, 557 bp, Triticum aestivum
  Clone ID: PAT_TA_78872
tggagcgtggtgggctcactgagatggttgttagggataaaatactggtcttccgcttcacaaatgttggcaaacttccattaccagtgcttcagtttgttgaggtcacgtttgggtacacaccggataatctcttgtacaagaagctcgactttggtgttgacctggactctaggattgcactggttggtcccaatggggcagggaagagcactctcctgaagctgatgacaggtgagctggctccattggacggtatggtgaggcggcacaatcacctgcgcatcgcacagttccatcagcacctggcagagaagctggacctggacatctcggccctgcaatacatgatgaaggaataccctgggaacgaagaagagaggatgagagccgcagtcggtaagtttgggctgtcagggaaggctcaggtgatgccaatgaggaacctgtcggacgggcagaggagccgtgtcatctttgcgtggctggcatacaggcagccgcagctactgctgctggatgagccaacaaaccatctcgatatcgagaccatcgac

SEQ ID NO: 78873 - DNA, 280 bp, Triticum aestivum
  Clone ID: PAT_TA_78873
gcttgttcattgacggccaggctgagttgtttgtcgcttgagaattgagatatcacaaggcatgcggctagctagctcgccgcagtgtatctgtgtatatgcttttgagtgatttgtgcgagagcaatcacaaagggaaatggagagcccagcttgtaggaaccacattgatgtagccaaagatgtttttgcatacctgtatagcactagctgattgtaaaaagcatctactgactttgagcaagtgaggggaaaaaaaaaaaaaaaacaaaaaaaaaaa

SEQ ID NO: 78874 - DNA, 245 bp, Triticum aestivum
  Clone ID: PAT_TA_78874
tcgaccacgcgtccgtaaaatataagaacgtttttaacaccgagggagtacaagcatggagtacttgattagttgcatgctaagtttcatgcttagttcatcatgatgtgtatgtggtgtggtgtggtgtggtgtgctgtaaataatgcaggtgtcgacgaaaaagtggccgccactgctgcccatggcgcgctagctcatgctcgacttgaagctcatcggcggaccggctgaacctacctacc

SEQ ID NO: 78875 - DNA, 112 bp, Triticum aestivum
  Clone ID: PAT_TA_78875
gtactcccttctgcacccagtcatctacaaccttgtacaagccatcatatgtgtacattactgggtgccgaagggagtaccaggacatgcggtatacaagtataaattgaag

SEQ ID NO: 78876 - DNA, 538 bp, Triticum aestivum
  Clone ID: PAT_TA_78876
ccacgcgtccgagagtctgcacgctatgctgacgaggtcctatctgaagatttacctactattatatctggtatttcattccccaagtcgatgcgctggaactcaaatattgtgtttagtcgccctgtacgctggatcatggcacttcatggagatcttgttgtgccattttcttttgctggcatctcaagtgggagccagtcatgtggccttcgtaactcctctttggcgaattttaaggtggaaactgcagaatcatatttgcacactgtagaaaaagctgggatcgtgattgatgtgcaggagcgtagagcaaaaatcttggatgactctagtacactagctagaggagtcgatggggatttcattgcacctgatagcttgctgcaggaggttgttaatcttgtggaggcgcctgtgcccattcttggtcgatatgatgattccttcctagaacttccgaaagatgtgttaacaacggttatgcagaaacaccagaggtattttcctgtaacctccaagtctacaggcgatctgc

SEQ ID NO: 78877 - DNA, 534 bp, Triticum aestivum
  Clone ID: PAT_TA_78877
ccacgcgtccgtgatgctctggccaatcagtttgctatcactgtcacccatcaaaataacccgcaaccgattgcagcctaccctggcactgccagaacaacccctgatataacgagcttggccagtgttgaacatgtagcgttagagacatcagctcgatctgcagtgtattcatttaacactcacagagttgaggggtccgttttcttggaagaatgcgtagtttttccaagaagccgcgagcaattgcagtctgctgggccttcttcaccgtattctgcacaaattgtggagaagatgcagcttgcgccagaagccactttgggaaggaacaggggttcgccgaaggacgatcggacacccgagagggcgagggtggagctgcccaacagtgggcaagtaaagcaagccggagaaggcaccataaggatggacatgagtttgcttagttgtcgcgtctgctaccaccccgtcaagccccctgtcttccagtgcaatgtcgggcatttagcttgcggcacatgcctcgcggag

SEQ ID NO: 78878 - DNA, 320 bp, Triticum aestivum
  Clone ID: PAT_TA_78878
ccacgcgtccgcacaaacaatggaagaagatcgtgttaaccatcctgttgtggtaaatggtgtccgagcacaacgtcaacattttcaagaaaaccctatgcaggaccgatctacttctcttattgggaacaacgcagaggcttctgcacctgttacctatagacatgaaccccaacaaagcactagtagaattgcacgaactttggtagacgaatatattgaccatcctattgtggcgaacaatgttgacgagcaaatacaacgtgtccaagaaatcaccatgcaggaccaagctactgcttttactaggagcagaggag

SEQ ID NO: 78879 - DNA, 478 bp, Triticum aestivum
  Clone ID: PAT_TA_78879
aagcctgaggataaactggagttgccagggaaacagaagcctgcagttgcagcggaaagacaaatgatcaaggactttgatgataagaaaagaagtcttgactcgtttgaagatttggatgcaaagtcaccaactggtggttctttcaagattggagagtgcattcggcgagctgcaagccagctgaccgggccttcgccaattgcaaagtcccagaatgaaaataccgctgaagcggagaatgcagaatttgatgtctctagtgatgatgctgcgaatgaacttactgtggaaaagtgcgcaaagaggagacgcttgcatagccatcaccttgcggaccccaaggagttattctctcagctttgctcggttgccatagagccaacggatggatacaacttctcggcactgacaatcagttacttcagtgatttcaggaattatgttgtctctgttgctactgaagcaagcattatcg

SEQ ID NO: 78880 - DNA, 478 bp, Triticum aestivum
  Clone ID: PAT_TA_78880
ccacgcgtccgcccacgcgtctgagttttcatacaaaagctaggtttgtatggtgctacttattcccaattctaggtttgatggcgcaacagatgcagttgggattcagttttttctggagaatgttcatcctagaatgaagctgctgcatcggctctttttggattgccagactcattgtatgccaggcctaatacatttggtgaacttatgcgagctatcatatccccatccagcaaagtccaagaagcagttgactgggctttgaagggtgcgaatccagatattgttttgcacacgcgcatgatggcgaataggccagtccgagcaagaaaagctgcagttctttgtattaagagagccctacagattaggaataccaagggtgcacctctggtggcactggtctcagacacaccagcatttgtgaaggagataaagtcagacatcagtgagtttgcagaggtactttattttg

SEQ ID NO: 78881 - DNA, 174 bp, Triticum aestivum
  Clone ID: PAT_TA_78881
taaggctagagtttctaggttagagtttgtcatctgtacgttttaaacctatacaatatctgagccgttattattttgtgtcaccagatagatggctcctacttgaagtcagtttccatgtatgctaaaatatatgcacgtctctgtttcttaaaaaaaaaaaaaaaaaaaaaa

SEQ ID NO: 78882 - DNA, 229 bp, Triticum aestivum
  Clone ID: PAT_TA_78882
tcgacccacgcgtccgcaacaaaataatcaacaactttgaatatgtttaggcatgtacgctgtcatgctatatatcttgtattaattgaattttgaagataatgattaaggaattcatctacaataggaacttacttcccaacaaggaaagtccagtgattgggcaacaacatgtggaaggataattactggatactttttttcagcgaacaactgcagagcgatttgc

SEQ ID NO: 78883 - DNA, 479 bp, Triticum aestivum
  Clone ID: PAT_TA_78883
ccacgcgtccgtattcagattcgagaaactgcaaatggaagcattacacttgctggcgtgacggaggctgaagtcaagtcaaaagaagaaatggccttgcacttggcacgaggatctttgtcacgcgcaactggaagtacaaacatgaatagccagtcaagtcgctctcatgctatttttacgatatctatcgaacaaaagaggacctcaagttctgcatctgagaagtcaactagtaatgaatatgatattttatcatcaaaatttcatctagttgacttggctggttctgagagggctaaacgaacaggagctgatggattacggcttaaagaagggatacacataaacagaggccttcttgctcttggcaatgttattagcgcattaggtgatgaaaagaagcggaaagaaggagcatttgtcccataccgggacagcaaattaactcgcctgctgcaggactctctaggaggaaa

SEQ ID NO: 78884 - DNA, 394 bp, Triticum aestivum
  Clone ID: PAT_TA_78884
cgacccacgcgtccggtgcaatgtgggtgcaattaagcggatcagaactagtggcttagatactaaagtttatctaacaaattcacacatgtatccttttgattagcttaatagtcttatgtgcattatctgttgatatttgttgcttgcataataaattgatatccgcgtattctatcttgattgaattatggagttctgttctacatagggtctgttgtagttttgactgcagtagtttaagagtcatggtagaatgttacatagcttggtagaggcattattagttttttgattgatatatatagatataaatgtatgaacatctttcatgtaatggccggccttattgaatccaaactggtgatttgaaacaaagcaaaaaaccattatt

SEQ ID NO: 78885 - DNA, 314 bp, Triticum aestivum
  Clone ID: PAT_TA_78885
ccacgcgtccgccaatccccacgaccgacgcgggaggcgactgccatggccggtcggccgtttctccggcaactcgtggagagaccacgacccgggcggaacgccaccgagcctcgcgttggaggccggagaaggctgtgccagaggactccggggagggcgtgccggcccgattgggcacaggcggagacgcccacggccggtcggccgcaccaccggcggcatgaggatctcccgccccgctcctcctcggagtaggcgcgacgcgttggaggcgtcattcaagagtccgagtgcctctgggctccatgtgc

SEQ ID NO: 78886 - DNA, 330 bp, Triticum aestivum
  Clone ID: PAT_TA_78886
ccacgcgtccgcagacagatcgaagatcctatgtttgtagatataacaaacttagaacagatcagagctttggttgcatcccttgaggctggtctgcgattcacgacatgtataacgtcgttaatgccaattcttatccagttattggcttcatcttcagccacagatgtcgagaacactattcttctgctaatgagatgcagacagtttcaggttgaaggttcagaagcagcactccgaaaaatgttacctctggtattttctcaggacaaatcaatatatgaagcagtggagagcgcattcattgccatatacacaaaaaggatccca

SEQ ID NO: 78887 - DNA, 294 bp, Triticum aestivum
  Clone ID: PAT_TA_78887
ccacgcgtccgagaatttctctaaaatctccaattttctacagcacaagacaacagctgattgtgttgagttctactacaagcaccataaatctgacagtttccgagaagtgaagaaacttctggatcttcggcagcaacaacccactggcaattacctaggaacaaaatctggaaagaaatggaatcctgagaatgctgcatctcttgatatgcttggaaatgctgcatcagtcgtggctgcccatggtcttgattatgccaacagagtacagaaagatactgcaaagattat

SEQ ID NO: 78888 - DNA, 169 bp, Triticum aestivum
  Clone ID: PAT_TA_78888
attccccctctcctctcctcctcttgcccccactcggcgggccgccggccggacgggagacgcgaggtcgtttggtcgactagatccccaggttgattcggctgcttttcgagtccgtgcgtgcgtggtgttttgatctggcgcctctggccgaattgctcgcgagatc

SEQ ID NO: 78889 - DNA, 384 bp, Triticum aestivum
  Clone ID: PAT_TA_78889
taccggtccggaattcccttctcgacccacgcgtccgcagtatgctggaccaggtttatttgagcaaatgacgcatgcccaagtgctcgggatgttttctggagtcaatggcagagccaacgggtttcgtcatgggcaccaactgacggaggagagtgttaaaatagtgcagaatggagtgattggaaaggcagctaccaccaccagccccttgcaagaagcagatcatgatccaaagggttcatatccacaagacgataacaggtccgcttctccaagcttcaatgctgccggttccccgcctagggggaaagcggcagcgaatccgaagcaaccagacttggtgttacagctgtgagcgcagtaacagccattgacatacat

SEQ ID NO: 78890 - DNA, 176 bp, Triticum aestivum
  Clone ID: PAT_TA_78890
cggtccggattcccgggtcgacccacgcgtccgcgagaagagcagtccatcttcttgggccgcaagccgagctggagagacgccgtccaagcacgcacaaatacgcccgcatctcccaccacgttctcgatcgaaccggcgggccccgttaaaccctacacccgcaaccccccccc

SEQ ID NO: 78891 - DNA, 158 bp, Triticum aestivum
  Clone ID: PAT_TA_78891
cgggtcgacccacgcgtccgatgctgcatgcaatgctaaagaattgttggagagacagctgtattctgcaaacgcggaagtgcaaaaactgcatggcatcattaaatcactagagaatcaggtagaagaagagaaggcactgcacgacgaactcatga

SEQ ID NO: 78892 - DNA, 288 bp, Triticum aestivum
  Clone ID: PAT_TA_78892
ccggtccggaatcccgggtcgacccacgcgtccgccaaaagcacgcactctgactggcagcagcgatccatgttacatcgaagcatatcatttggcggatccaactgatggcagaatcaccctacatttaaagattttgaatttgactgagctggaactcaacagggtggatatccgagttgggctctctggagcattgtattatatggatggattttcccgcactgttcgccacctgcgtaatcttgtttcccaggatccagtccaaagtagcgtcactgtgggagt

SEQ ID NO: 78893 - DNA, 229 bp, Triticum aestivum
  Clone ID: PAT_TA_78893
ccacgcgtccgcaattggacaaagctctgcatggcaatgatgtttgggctatggcagtggttgatccttcttccggtaatgcagtttctaagtcgggctcgcatccagaagatttagctgcagttttgacaacaattccaagatgtgttcgaaactccaactggcctgcctccacacacagtgtatgatcgtgcaatcaccttggaagtgggacataatcctcctaact

SEQ ID NO: 78894 - DNA, 181 bp, Triticum aestivum
  Clone ID: PAT_TA_78894
gactctttgtatacgggtctgaaggcactcgaataccacagcaagggcaagaaagggagaacaaaaatagcagaattggatgaactacctgcacccatggtcaatgttgatatggacatatttgttttggctggcgatgttataactttacttgagagagcagccttggaaccgttgcctt

SEQ ID NO: 78895 - DNA, 293 bp, Triticum aestivum
  Clone ID: PAT_TA_78895
ccacgcgtccggatgtgtggatgggcccttcccaggcagagactctgtaactaaagctgcacttactttcggatgctctgcctgggtacgagctggctctggaggacatggccgtcaccatgtcaatgtttgtcttggtgtatatgaccaatgggttaatggtgggcaaatagaagccgctggggatcaatggtatgaaatcaaaggagcattcaagcttgaaaagaagccatctaaagttattgcatatgttcagggtccccctccaggtgttgatatccgagtcatgggtc

SEQ ID NO: 78896 - DNA, 494 bp, Triticum aestivum
  Clone ID: PAT_TA_78896
ccacgcgtccgctgctggtgtatggaagaggttgcagaaaaggctgaaacaacaaaatatctccttcactgacttaattttccccaacattaaagttatctgcaaggaattgctttcaaaggatggtctatttagttcgaacaaacaagaacagcgagcagcactatgttcattagcaacgctgatgtcaatatcacccaatgatacatttgtagagtttgagaagcacttcatagagcttccagaccgcactttgcacgatggcttctctgaaaatgatatcaagatattctttacttcggaggggcagctgtcaactgagcaaggagtttatgttgctgaggctgttgcttccaaaaatacaaagcttgcaaagggacgttttcgtgcatatgatggtcaagatgcggagcctgcaaaaagtgataagagagaatcctctagcattggcaagagagaaactgggaaatttacaaaaaagacagctcctgttg

SEQ ID NO: 78897 - DNA, 286 bp, Triticum aestivum
  Clone ID: PAT_TA_78897
cgggtcgacccacgcgtccggccgccgccacagccgcctcaccgttgcacgactcccgaaccttcgccctgcagcagggcgagttggatgggcgctttgcggatgccggagagaaaccagcagcaccatccgaggagccagcggaggcggaggcggaggaggacgatgacgacgatgaggacgatgacgaggagtattggtcctaccatgacgtgggtgaagccctagactggctcgacgccgccgagggcccggatggctcgacgcgtctttcctcaaccttctc

SEQ ID NO: 78898 - DNA, 152 bp, Triticum aestivum
  Clone ID: PAT_TA_78898
ggggaggaggatgatgggagggcgcgcggtgctcctgctggtgatctcggcgctgttcgcgcagatcggcgcgtcggatccgctgttccacgagttcttcaacgagagcttcgacgggagctggatcgtgtccggcaaggaggagtataaag

SEQ ID NO: 78899 - DNA, 511 bp, Triticum aestivum
  Clone ID: PAT_TA_78899
ccggaattcccgggtcgacccacgcgtccgagaagggaaattggctgttccttttagcgcctcaatctttttgggttttgacgcagatccatcattgaatgttgcagctcgcatccgtggaccaaatgatcagtacataaatcacattatgaatgaaacaggggtcactgttgtactaagaggaaaagattcagggaatcttggcaactgtcacgctgaagcatcacagcaacctctgcacatgcacctatcaggtgtgcatttgaagagcctagaagctgcaaaggttttagcagaaaaccttctagatacaatagcagcggaacttggtgcttccagaatttcttcttcaaaagtatatggtgctgttccacctcctcagcaactgttgactggtgtgcacacctcgggaacatctgacatatgtgtgtcaactggagcatcacattcctttgcccctactggagttacttctcccatagccgccccttcagtgacacttcaatctggg

SEQ ID NO: 78900 - DNA, 300 bp, Triticum aestivum
  Clone ID: PAT_TA_78900
ccacgcgtccggagcagcgaggctggagctccagacgacgcacatgtcgctgggtggaggagaggccagctacggggcgctcctgtcacgatgtggtgagatgcaagggaggggtaggatgccggtgacagtagaaggagcaggccggtgtagagggcaagcagcacaggaagattaagaaggatatgaagctttgtatagtttcatggatggggtttgggtgtcctcatgagagcagttcagtgcttgcacctctgcaacctcgccaacatggacaatcactggtcatgagtacaggat

SEQ ID NO: 78901 - DNA, 198 bp, Triticum aestivum
  Clone ID: PAT_TA_78901
ccacgcgtccgtgtaaatcttcgatgccctatgactggttcaaggattaaggtagctggtaggttcaaaccctgtgtccacatgggttgttttgatttagaagcttttgtggaactgaatcaacgttcacggaagtggcaatgcccaatttgcctgaagaactattctctggagaatctaattattgatccttatttc

SEQ ID NO: 78902 - DNA, 353 bp, Triticum aestivum
  Clone ID: PAT_TA_78902
ggtcgacccacgcgtccgccgaggcgagcccgagcagcccgcttcctgcttgatcaatcttctctcttcccaccgagtcctgacctacaaaccgtgccctagagccgccgccgccgccgcgccgtaccctagcgtcacggccgacgcctcaaacccccacgcccgcctctcacgcgcgtggccgccatcgccgttcccgtccttcctcctcgggacatcgcgttcctgctgtctccaccccgcccgcagtctctagccattggggtttgaggtatgagcttgttttcatccagcgattagttaaatcccactgaccttcaaaacatctgggtgtgccgctgcacacccggcac

SEQ ID NO: 78903 - DNA, 429 bp, Triticum aestivum
  Clone ID: PAT_TA_78903
ccacgcgtccgcgagtagccgtcccaatcctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttctgccagaaggaggtagctgtgtttggctgcaggaaccctgaggagatcccatgggctgctgctggtgctgagtacgttgttgagtccaccggtgttttcactgacaaggacaaggctgcagctcacattaag

SEQ ID NO: 78904 - DNA, 330 bp, Triticum aestivum
  Clone ID: PAT_TA_78904
cgtcatactacacactaccttgtcgcctcttgaatctagaaatgtgaagcagaggagaggaggaagcacacctggtctagctatagctactcatggctgccacgcttcaagtaggagcggcagcccggcgaggtgctctcctcggagcgccggtttccgccggggtgcgcggtactctccgtggtctccggcaaaggtggcgcgtcttccactctaccgacgagtcgacgaccagctcgcacccatcttccactctaccaacggccagatcgcagcggacagagatgcaataccttgccaacagcaaggcacggcgtaactggaggggcg

SEQ ID NO: 78905 - DNA, 234 bp, Triticum aestivum
  Clone ID: PAT_TA_78905
ccacgcgtccggcaccaccaccgggcatggtgcctttgaataacgatcaaggtcctcagcctccttcagtcagctggcctgatgctcaatctggtatggtggatcctttgcaaggttctccagctagggaagagggtgaggttcccgagtctgagttagatcctgacacaaggagaaggcttctgatattacagcatggccaagacacaagagatcccacaccaccctttgctg

SEQ ID NO: 78906 - DNA, 200 bp, Triticum aestivum
  Clone ID: PAT_TA_78906
tcgacccacgcgtccgcaggagaggaagacctcgccccctccccctctcacctaatccgcggcagccaaatggcgctcacctcccagagcctcttcttcaccccgtcgcccgccgggccttcccggcgaggccgggggcgccccgtcaccatgtccgccgccgcctcgcacaactcgcaaccccgaaacaaccccttcgc

SEQ ID NO: 78907 - DNA, 362 bp, Triticum aestivum
  Clone ID: PAT_TA_78907
cggtccggaatcccgggtcgacccacgcgtccgtgattgttatcaccaaactgatcgactccgtgctggaggattgcggtatttcatctggaatgacgcaggaccaggagagtgtatatcccattgaagggccacagcccatggacatggatgtcaagggggtctccgctgtgaagcaaaatgagcagcgtgaacagttgcgtcgaaggaacaccgtcatggctttggaagtgttgcatatcatggccgctgatacgaagattcaggcatttctgcgcttgatatgccttaacatgcctgacaaattcagtgttctgagccacaggctgacactgattgaagctcacaagatggcactcgag

SEQ ID NO: 78908 - DNA, 310 bp, Triticum aestivum
  Clone ID: PAT_TA_78908
ctaacttactgagaaggttttgtggcaaatatggccaaaatcagcaaaagatcatctcgcgtctcaaggaagattgcagggatgaccgaataactgttgaaattaactttcaaaataatgaagttgtgttatttgctacggaacagaatatggaaaaggtcttttgcactgtcaacagtgctttggaatgtgaatgtaagatattgaggaacgagtgcctagagagaaatttatttcctgggaggcctggcagttctcctattgcactatttggttcaggtgctgaaatcaagcatttggaacttggggg

SEQ ID NO: 78909 - DNA, 134 bp, Triticum aestivum
  Clone ID: PAT_TA_78909
cgacccacgcgtccggtcttttgtattaataatctgacctgctaatgtggaacatgtcgccattaactatttagtcactttcctggtgatctcaccatttcaagtatcacaatctcttcacaacttgaatgctg

SEQ ID NO: 78910 - DNA, 266 bp, Triticum aestivum
  Clone ID: PAT_TA_78910
gacccacgcgtccgctctactgactacctctcccccctccaaaccccccctcccctcccctcccctccccttggttcgtccgcccgcctcggactccacggccgccccaccggtgcaagggaggatggatttgtccaggttcgcgtctccgcgcccgccgggcctgcagatcggcgccgcctccctccggggggcctgctcgctgcgccgaccccggcacagaggcggggtccacggcggccggggcgggaacctcatggtcgcct

SEQ ID NO: 78911 - DNA, 300 bp, Triticum aestivum
  Clone ID: PAT_TA_78911
ccacgcgtccgcgtgagttcgttcgtttgagatgcagcttccgagtggagtgggggagaaataaagcagcagcagcagcagcttggtcaaactcggaccggatactgacggactgactgattgattgattggttttgtttgttggcttcagactctcgagctgaaactcaagctcacggcgaagcagctgcggtaacggcaccacccggaagaccaggagggctggatctgggcggaatggaggccaaggacgtcgcgccgctcgccgccgccaccgccgccgcccccaccgcgccggcg

SEQ ID NO: 78912 - DNA, 250 bp, Triticum aestivum
  Clone ID: PAT_TA_78912
ccacgcgtccgacacaagctacacactggcctgaggctttgtctcgcgaaggcgctcgtggtctcgggtaatcgcgacaacgtccctgccaccggccatggacaagaagcagggcttcttctcggcgctgcgggaggaggtggcccgcgggctgtcgccggcgcgggcgcggcggagggccgaggaggtggcggcggcgaaggcggcactgcggtacgcggggggcggcggcggggaggccctcgcgccg

SEQ ID NO: 78913 - DNA, 569 bp, Triticum aestivum
  Clone ID: PAT_TA_78913
ccacgcgtccgcgtcctcttcccctagccgagccccagcatcgccgagattggtctacgactcccagatcgctgttcccgccggcgaagttctctcccgccgcatcacggcctagattttcgaggcgaaggttgacatctggaaagaacttttgtgcgtgctcaacaatgtatctgataaagacctgaccctggaattaagcaggacatacctctgtttccatttagaccacttgttatctgcaacagcgccccttgttcttttcaccagcgcactgcttacacatctcagtgtgtcagatttactagtacaagatgcccatgtctggcaatcagacacaatctagcgactttgagctcgttgccagccaaccagatgctcaatgcctagtttgcacgagaccttttactttggatactgaggtgaccaatagctttgaagctttagctatatgcagggaatgcaaggctactgtgcttaatgatagccaaagagatgtaacaaccagcactagtcagcagagacgacaaagaaggcggagatctagcactgcaagtctggaatctaat

SEQ ID NO: 78914 - DNA, 403 bp, Triticum aestivum
  Clone ID: PAT_TA_78914
ccacgcgtccggctaaaagccaacctagaaaccattgttttcccaaaaactatgtggttcatatgttgacatgattgtttactagtaggacaaccaggaggtagtgcaatatccttattagttatactcagggatgcaaaatcttcacctgatgattccacccctttttacatgacactagctgccgcatggtaaaaggtgtctcgccgatgctctttatgacacccgctgacagattaatgagtgcactcatagagaacataacaaggtattttaggaagtgcttggactaggttcaaatttttgaaagttttaggcacgctttttttacagtgttggtttcaagtttttctttccgacaccgttagactttctgaaatacagccttgaactacacatgaaa

SEQ ID NO: 78915 - DNA, 432 bp, Triticum aestivum
  Clone ID: PAT_TA_78915
ggtccggaatcccgggtcgacccacgcgtccgcatttggtgtgattgtaagggtggaaagcgaagcatttcaggttctcaaaggagtgcctgataaacctgaagtggtgcttgtgaaactgagagaaataaaatacaaaatcgatcggcgcacatctgcaaaagatagcaagaataacacggtgtcaactaaggatattgtcatggtcattgaggggccatgcaagggaaagcaaggacctgtggaacatatacacaaagggatatgttttatacatgaccgccaccaccttgaacattcaggctttatctgtgcaaaagcacaatcgtgtgtccttgttgggggatcggctgtcaacagcagcaggatgggtgttgatacagcagatccacggcttggtgcttttagatctccagcaaggatcttgcaatc

SEQ ID NO: 78916 - DNA, 288 bp, Triticum aestivum
  Clone ID: PAT_TA_78916
gacccacgcgtccgagagcgcgcgtgtggcttctctatgaggcgtacaacgagctgcagcgtctggcggccgagctgggtggcgcagcggtgccggcaccagcggtggtggtggtcggccaccagacggacgggaagagcgcgctggtcgaggcactcatggggttccaattcaaccacgtcggtggcggcaccaagacccgtcgacccatcgcgctccatctccgcttcaacccgcgctgccactcctctaactgccgactcctctccggttcgggcgagggggacg

SEQ ID NO: 78917 - DNA, 291 bp, Triticum aestivum
  Clone ID: PAT_TA_78917
ccacgcgtccgcttatgatggccgtattttgacacttgtctaggatgtcttagttacttgtttcctcatcattttgtggtgaactgagaaggtagactgagcccatgaaggcctggaagctagttttactagtagtatgttgcactcttgagttctctattggggagactagtaggattctgagctgtggaagcaccctggctgcatattgttttgagtctttacttttcccctgtatagaagtacctatcagatgcacaatctatatcaactgatatcctgatgttattc

SEQ ID NO: 78918 - DNA, 363 bp, Triticum aestivum
  Clone ID: PAT_TA_78918
ccacgcgtccgcgacggcagcaggtggtcgaagcttcccgccgcggcggcggacgtgacggacctgccgctgctgccggacgacgtggaggagtgcgcgggcgccgcggagcgcgcgctgaggtccgcgggagcgacgctgccgcagccgcaggcggggagcaataatgggacgacgtgcgacgtgcccttctgctactgcgggataagactgaggcggccggtctgcgcgctgccggcgggcagggctgcgaggaggctggagagggactgcgcgcggccggggctcgccggctgctcccggtgcctccgggcgctgaacctgctgaacgccattggagagaagaacgccacgtcggggaag

SEQ ID NO: 78919 - DNA, 454 bp, Triticum aestivum
  Clone ID: PAT_TA_78919
ccacgcgtccgggatattatctgtggattatctcttcaatactgcagcatatacaggtagggtgaagaaatattagtttgtgtaacccgcatggacttccattggtggtgttcagaaaattgggcagctaaaattttgtggggaagcacttactgatactactatgtttgttgtaagactggggtaatacgggtacaacttcaccatccattgttttttacttatgcttccccactgcgtttttaatatagttcatcattctcctacatgaatcctgactagactgttaaaagttctaggttgctttatgttgctgtagagtcctgctctctactagagagctgagcatgacaatgttttttttataataatgaccacatcggaatgaagatggtgcattgactgtccgaaatgaggaccaagaaccagattctgtaaactctttgtaataagt

SEQ ID NO: 78920 - DNA, 450 bp, Triticum aestivum
  Clone ID: PAT_TA_78920
ccacgcgtccgggctgaagaaggtacttgaacatgtgagtacagtacaagatctctgttctgtattgaagatggaacattttagcataataactgaagttcatgacagtctagacgactctgttggtaaggaccacaagagcattagcaatgataccctgtcaaaacttgataggacaatagctactcttaatgaggacaaaatgctgaggctaaagaagcttcaagagcttgccactcagctaaatgatctatgggatctcatggatacaccaatggaagaaagaagcttgtttgaccatgttacctgtaacagaacagcgagtgttgaggaagtcactgcacctggagcgcttgctctagacataattaatcaagctgagatcgaggttcaaagattggatgagctccaatacagcaagatgaaagagatagcttataagaagcaaac

SEQ ID NO: 78921 - DNA, 537 bp, Triticum aestivum
  Clone ID: PAT_TA_78921
ccacgcgtccgcactcctccttctcaggctctcagctacccaaaacctcgccggcccggcacaagtcgagcctgcactgcacgcgcgcagccggcgcatgcattttccgccgacgcgcgccgcagctcgtcggcaccaaggtcgaccgtagcacgcgcgcacgcaggacactcggcagtcggcaccgatgggggcggcggcgccgctgacgctgcgggacttcctggagatggcgtgcgagtccagctgcagcgacggcttccgctcctacccgcgccgcgtcctcccctgcccgtcgtcctctgacgacggcgccctggccacgcaggcgaagctaaaggaggagacggcgcccgtgcggctgctcatcgaggccgacctgcggcggagcccgtcgcggacgctctcctccatcctcttccccaggagcccgcggtcgctggccgccatctcgcgcctctccaggaccctctcgcggcggctcgtcttctggaggcgccaccccggcgaagacgacggcagcgagcgggactccct

SEQ ID NO: 78922 - DNA, 420 bp, Triticum aestivum
  Clone ID: PAT_TA_78922
ccacgcgtccgacgccaaggagagaccggggggtggacggaagcgcgcgcccaggcggcatgggcgtcctacggagcacgcagagcatgcaggcggaggtggaggagatgcgcgccgcgctcttccacgggggcggctggcgcccctcggccggcgacagcgacgtcaagcgcgcggccggcggcgacgaaggcgcggccggcccgcgcaccgtgtgcgtcaccggcggcatatccttcgtcggcttcgccatcgtcgaccgcctcctccgccacggatacaccgtgcgcctcgccctcgagacacaagaggacctggacaagctgagggagatggagatgttcggggaggacggccgggacggggtgtggacggtgatggcgaatgtgatggaacccgacagcctgcaccgggcgttcg

SEQ ID NO: 78923 - DNA, 265 bp, Triticum aestivum
  Clone ID: PAT_TA_78923
ccacgcgtccgaggatatcatacgagaagcgcaagcggacgagcagcggaggaaggaatagagcagcttacgaattccccgtccctccctgcgcccatccccgctcccgctcccgctgcccagatcccaaaccacaaccctaggcgccacctccgcccccgcccgccccgcccgccggcagccgcgtcctcttcgcaccaccaccaccatcccgccacctccgcccgcagcgccctctccaacgccgtcgcgggcgcctccgccg

SEQ ID NO: 78924 - DNA, 397 bp, Triticum aestivum
  Clone ID: PAT_TA_78924
cgacccacgcgtccggccagtcggtgaactggatggcgcagagtgcgcgggcaaagggtgccaagacgcgcaccgcatggttccgctggcccactctcaagctctgctcgacggagctgcgcaaggagatcgtgggcaagaagaaggccaggcgacgggatgctgcagtcggattgttcgtgttccctgcacagtctcgggtgaccggcgccaagtactcctaccagtggatggcgctggcacagcagaatggctggcatgttatgcttgatgctggtgcacttggtcccaaggacatggactcgctggggctctcgctgttccggccagacttcattataacctcattctaccgggtgtttggttctgacccaactggatttggctgccttctgat

SEQ ID NO: 78925 - DNA, 537 bp, Triticum aestivum
  Clone ID: PAT_TA_78925
ccacgcgtccgtgcaatatgaccccatcaccacccaagcatgtgacaaacttatttaggacttctgtaccccctgttgtctcattcaatcttggatctcttggatttctgacttcacatattgtatgtttcagactccattctaagagaattttatcctatgaccttcttttgtcaagtctaagcatgtaacatttccttcacttcagtttgaaggtttcaggcaagatatgagagctgtcatccatgggaacaatacacttggagtttatataacccttagaatgcgtctacgctgtgtaatctttcgaaatggaaaagcaatgcccgggaaagtgtttgatgtgctaaatgaagttgttgttgatcggggttctaatccatatctctcaaaaattgaatgctatgagcataaccaccttatcactaaggttcaaggagatggtgtgatagtagcaacaccaactggcagcacagcatactctacagcagcagggggttcaatggtgcatccaaatgtcccatgtatgctgttcac

SEQ ID NO: 78926 - DNA, 570 bp, Triticum aestivum
  Clone ID: PAT_TA_78926
ccacgcgtccggcggccaagaccctgcgggccgtcctgtcgtggagggagaccatcggagcagatcacatcatcgccgacgagttctccggcgagctgtccgaaggcatggcctacgtcgccgggcacgacgacgacaaccgccccgtcctgatgttcaaaatcaagcaggatgactacccgaagtaccagcctcagaaatcgttcgtgcggttcctggtgttcacgctggaggtggcggtggcgtccatgaaccgcttcgtggaccagttcgtgctcctcttcgacgcaagctttttccggtcggcgtcggctttcctcaacctcttgatgggcacgctcaagatcgtcgccgactactaccccggccgcctccaccgcgccttcgtcaccgacccgccatccctcttctccgtcatgtggaagggagtgcgcccgttcgtggacctggcgccggcgacggcggtggtgagctcgctggacttcgaggactcgctggaggacgcgtccttcacggcctacccgcggacggcgtcgctgcggttcgagccctccgtggcggccgtgctga

SEQ ID NO: 78927 - DNA, 195 bp, Triticum aestivum
  Clone ID: PAT_TA_78927
aggaacggggggaggacatacaaaaaatcctccctcaaatgggacatacacaatctactttttttggggaacatacacaatctaccaaaaaactgggggccggctaccaagggctaccataaactccaggtttcccctaaagaccaaagaaaaaaaaaatgaaacttccaaggaacctaaaaatccccttttaaa

SEQ ID NO: 78928 - DNA, 337 bp, Triticum aestivum
  Clone ID: PAT_TA_78928
tcgacccacgcgtccgaatctttatatgaactggttagactgttatgaaacgacttaggcctgggcgttcggtagaaaccgaaatttcggtttctgttgttcggttttttcctaagttcggttagtgaaattagaaaccgaaatttacatgcaaagccagctaactgaaaaatcggttaaccgattattcggttcggttttcggtttaaaccgaatttgggcactacgccttcgttcctctctgcgtgcagccatggatgcgctctcctcctctgggcctctcctttgcgagcggcgatggagcgacgacgcgtggacggacgaatgcgtgctcctc

SEQ ID NO: 78929 - DNA, 319 bp, Triticum aestivum
  Clone ID: PAT_TA_78929
gacccacgcgtccgcacacctctcgccggagatgccgccggggacccctctgccgtcgacgggggcgtggacctgggagaacgccgtcgccggagcgaccgccggcttcgccaccgtcgccaccttccacccgctcgacgtcgtccgcacccgcttccaagtgagcggcgggagagggttgtccgacttgccgccgtacaggaacacgggacacgctgtatacaccatcgcacgatctgagggcctgaggggactttatgccggcttttatcctgcagttctggggtcaaccgtttcttgggggctacatttctttttt

SEQ ID NO: 78930 - DNA, 111 bp, Triticum aestivum
  Clone ID: PAT_TA_78930
ggaaggctctcaaacatgtacacccaactacaagttaacaattccaaacttaaggtgggtgtacatgtatagagagccttccacatttacacccaactacaagcggacgcg

SEQ ID NO: 78931 - DNA, 504 bp, Triticum aestivum
  Clone ID: PAT_TA_78931
ccacgcgtccgctttttggttcagtctgatcttcaaaaattcacctgtggaaggaactaccaattggaaagaagtgatggaggttttcattatgcaataggacaattttaaattgttgcctgacttgttgtcatcatactccatgtatgttcaatgccacctatgcatgaaatgctgtacggcggttttgccactttttattcatcagcgaattgcaccatgtgtacgaattattaccattcatgggcaggccacgtttgcccaagattcgagccactatcatattctaacacccaataaaatttataattatttgcagaaaataaacaaataaaatcatatttttatgctttgatcctggcccagcttccatcatgaacacctctaacatggacaaaaatgaattttcttccttctggctattttaataatgggccttttgttctcatgcatttaaactacatcttgcatgatagttcgagaaatattaagagcatacatcat

SEQ ID NO: 78932 - DNA, 601 bp, Triticum aestivum
  Clone ID: PAT_TA_78932
ccacgcgtccgccaccacagccccactctcagagagcacggacgccggacacgcacgagtcttcttgaagcaatggcgaccaccgcgatggcgctctccccctcgtccttcgccgggaaggcggtcaaggacctgccgtcgtcggcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggcgactacgggtgggacaccgcggggctgtcggccgaccccgagaccttcgccaagaaccgggagctggaggtgatccactgccggtgggccatgctgggcgcgctcggctgcgtcttccccgagctgctcgcccgcaacggcgtcaagttcggcgaggccgtgtggttcaaggccggctcccagatcttcagcgagggcggcctcgactacctcggcaaccccagcctggtccacgcgcagagcatcctcgccatctgggcctgccaggtcgtgctcatgggcgccgtcgagggtaccgcgt

SEQ ID NO: 78933 - DNA, 408 bp, Triticum aestivum
  Clone ID: PAT_TA_78933
ccacgcgtccgctccgcaccaaaaccaaaatccagcagcaagccaagccaacccaagccaggccaggcgtcgcggatggcgtcgtcggcgttcaaatccaccacccgccgcaatctccacggctcagccgaccgccccgtgcagccaccgccccactgcccccgccgctcccgcagcgtcacccctgcgccccgccgcgaacgtctcctcggggattacgccgggactacccgcaccaatccgctcttcgaccgcggggggagggccttctctccacctccgccgccggaggactctggggacagagggaggaaggagagcaggggtcgcggctcaaggaaggcgcggtcggtgtccgtcgcgccgccgcagcgtcggcgcgctgccacctcggcgccgtcgtcggca

SEQ ID NO: 78934 - DNA, 488 bp, Triticum aestivum
  Clone ID: PAT_TA_78934
ccacgcgtccgccctgccaagcgagccccagaaagtttccgatcgaatcgaagcaaaggctttctcgtccgcctccaagatgcagatctttgtgaagaccctcaccggcaagaccatcacccttgaggtcgagtcctctgacacgattgacaatgtcaaggcgaagatccaggacaaggagggcatccctccggaccagcagcgcctcatcttcgctggcaagcagcttgaggacggtcgcaccctcgctgactacaacatccagaaggagtccaccctccacctggtgctccgcctcaggggtggtatgcagatctttgtcaagaccctcaccggcaagaccatcaccttggaggttgagtcatccgacaccattgacaacgtgaaggcaaagatccaggacaaggagggcatccctccggaccaacagcgcctcatcttcgctggcaagcagcttgaggatggtcgcaccctcgctgactacacat

SEQ ID NO: 78935 - DNA, 652 bp, Triticum aestivum
  Clone ID: PAT_TA_78935
ccacgcgtccgcggacgcgtgggtttgtcgtgcccgtgtcctgcaggagctcatcacgcgccgaccgtcccgagctccaatccacgactccccttgccggagttgaacccaggcacctccccgctactccccgtgccctcgttcccaagctccatcgagaggagaggagcccccgcaagccactgctccgccgctgccctcgtgcccgtacccgagctcctcccgatccagatcgaccccgccacctcaagtcgctgctccggccaccaggcctcgccggagctccgacctcgccggagctccgacctcgtcggagatgagtagccgccaccctgtttcctctcctcctccctctgattgtctcccctgaccactcactcccctctcctgtttctctctgtcagggaccgaagcatggctgccgcccgtccaaggacgtcgccgccccatggatccttctccgcctggagcttctttacctgcatcccccccctccgtccagatccgccgtctccgcctcccttccttcgtctctggcgagcagccgtaccgccgcggctcagcttcctgtcgagtagtagcgagcgcgtcaatcgacgagtcctgcccgtgttgaccgagcctcgaccccctccctttgcttcgctcgcgc

SEQ ID NO: 78936 - DNA, 496 bp, Triticum aestivum
  Clone ID: PAT_TA_78936
ccacgcgtccgggcattttcaaccaggagtaccattgagttcgatgtgtacagctacggagtggtattacttgaactgattaccagaaagatggccctggatccctcgttccctcacgatgtggacctagtcagctgggtatcctccaccctgaatgagggcaatgtgatcgagtccgtgtgcgaccctgccctaatgcgtgaggtatgtggcactgctgaactggaggaagtatgcagtgtgctgtcgatagcccttagatgcaccacggaggacgcaagacagaggccttccatgatggatgttgtgaaagagctgacacgtgctaggcgtgatgctgtatcgctaccgaagcaggccatatctggttccagcagttcctgtctaaacctggcaacctgatgttttgctccagcagttgtagtaaggggttgtttggttcagaggaaaagtagagggaaattataggaacatgaggatttcttttgatagcact

SEQ ID NO: 78937 - DNA, 271 bp, Triticum aestivum
  Clone ID: PAT_TA_78937
tcgacccacgcgtccgatcacgcggactcggccgacctgaacctgcccgcacgcaacgcagatccccacccaacccgaccccgaccacgcgcgcgcggacctgggacccgggcccggcctcccccaccggaatccccgccgggtacctgggggccgtcgccgcggttgcgcaacaggcaggaccgggggcccggctccgattccaagctggccgccgccgccgccaccgccccccgctccgcgtcgccgtccatggcgtcgtcgggcgggg

SEQ ID NO: 78938 - DNA, 594 bp, Triticum aestivum
  Clone ID: PAT_TA_78938
ccacgcgtccgtgattggtgcgaatctttcaacacatacccaagaacctatgatgttcttcacatgagtgatctccttggaagtcttacaaagaggtgtgacatccttgaagtagcagccgaagttgaccggatattgaggcctggcagatggttggtgctgaaagacaccatggacatgatgaaaaagatgcggccaattcttcgctctctgcactacgagaccgtaattgtgaagcgacaattccttgtcgccacaaagagtttctggcgtccccggtgataaagctgacatggaccaaacttctaagggagtcaaccaaagcactaagattctgttgattctttgagttctgatctgatcaaattatttatacaacagagatgtgatttgtttgggtccaggtagccctgaagttttcggtggtatatagatacacacttgtgcagtctccgtgccgattctttttcctgccaaaagcaaagcaatacaatagggatggtatagctgtataatctagtgctaacagatgcatacacagaggatacaggatcatcttttgtatacttgttcaacaaaattatttgtgtacat

SEQ ID NO: 78939 - DNA, 606 bp, Triticum aestivum
  Clone ID: PAT_TA_78939
ccacgcgtccgagcgagatcagcagcagcagcagcaatgcaggacgccgcgcacgaccccagcgccgccaccttctactccgccgccgccggcctctacgccagcactcacccgcccgtcccgctccccgccgaccccggcctctccttcgtcccgcacatcttctcccgcctccccctcggctcggcgccgccgcattccccgccgtgcctcctcgacgccgccaccgccgcctccctctcccgcgccgacctccgccgcctcgtctcctccctcgcgcgcggcctccgccgggcccacaacgtccgcgccggctccgtcgtgctcctcgtcctccccaactccgtcgccttccccgtcgccttcctcgccgtcctcgccgccggcggcgtcgccaccactatgaacccctccagctcccgcgccgagatcgccgagcgcctgcgggacaccgccccgtccctcgtgctcgcgtcgcccgagaacgccgccaagctcccgccctccgccgccccggtcgtccttgtaccggagacattcaatcctacgccctcggcgggccacgagttcgcgcccttccgcgcgctgctcgattccgacgccgac

SEQ ID NO: 78940 - DNA, 305 bp, Triticum aestivum
  Clone ID: PAT_TA_78940
ccacgcgtccgatgaccgcatccctcccaccaccaccaacctcccccacccccacccaaaatcgcgcgcgaaaacatttccctcgctcccgcgctgctcctccaaatcgctcccgcctccgctcccaaaacaatcccctttcctccgtctcccaaaccaccgacgatcccccgaggccgttccgaatccctcgccgcgcgcctctccccccggctcccgcgcccgcgcccgcgacccctgctgccgcgacccgcgcccgccacgtgttcgacggaaggcccggccgggcggcgggatgttacgtg

SEQ ID NO: 78941 - DNA, 263 bp, Triticum aestivum
  Clone ID: PAT_TA_78941
ccacgcgtccggtagccgacatgcctaggaaggagcgcgacgccgagggcagccggagctcgtcgcggcggcggcggtcgccgtccgactcggactccgactccgactccggcggctcgccccgccggggccggagccgccaccgccgcaggagccgccgtaaggccgccccgccctcctcctcctcctccagcggcgcgagcgattcgcaggcgtccggctccggctcccactccggggaccgccggaggaggcggagcggg

SEQ ID NO: 78942 - DNA, 571 bp, Triticum aestivum
  Clone ID: PAT_TA_78942
ccacgcgtccgcttttactccgttgacgaacgagaagaaaggcgtgctacttaatggctcaagcgagatcccctctcgtggagagactggtagactagggagtgctgctcccgttgccagatcacagagtcacaagtttctgactttggatttacagttagcgtctcgtcagaatgtcaaaatcaactctaattcccctgtcaagaaagagaaactagatcaggggttttctatatttccttcagcaagacctcccaaggatgtgcaaacaacaagtggcatggaatcttcttctaacctctagcttgggaaaactatctaatttagatcttaatgtatcactggacccagttgatcaacttgaaggtttgcctacaatgcaggctggctttaacataccccatcatacaacaattcagcatcagaaagcacaggttcccccagtggcacccttttcttcagtaagtagtcggctgagtctaaatattgacaatactctgaaaccgtcaagtgcatatcaacttcctaataagagtgtggcagctgatgttaccttagatttgcaacttaa

SEQ ID NO: 78943 - DNA, 293 bp, Triticum aestivum
  Clone ID: PAT_TA_78943
tcccgggtcgacccacgcgtccgcacggagacgacgatggacaccattctcaataattaaccttagcttcaaatctctgttttttgctggttaatatgaatgataattaattgattgacatgaaaatcagagttggtcaattcaacgtagtaccgtctgccaaattatgtactataactaatttagatacttttcttgtcaaagatgaatattaattttgtaatgtttacctgtttacactagcgaaaacactagtctgggcttatgtttctttgcacactttaaacttctga

SEQ ID NO: 78944 - DNA, 241 bp, Triticum aestivum
  Clone ID: PAT_TA_78944
ggaggtcaaggaggggccacgcccgttgccggaggcgtcggtggccgcgctcaggcagctcagggacgccctcgccggcgcccgggagctgctccgcctcggcagcaacggtagcaagatcttcctggctctcgagagagagaagataatgcagactttccaggacattacctcgaggcttgagcaagccttagctggtatctcgtttgatgagcttggcatatccgatgaagtaagggaa

SEQ ID NO: 78945 - DNA, 322 bp, Triticum aestivum
  Clone ID: PAT_TA_78945
ccacgcgtccggttgagggcaagggaacaagaagtggactgactatgatagtggatagaatttttcatcacagccagatggcagtccagaaattcctaaattaaatttccatgtggagcttgatgcagccaaagcgacatggttatccaatgatattgtaatgtcctcaacactggtcacatcctgtaaaacgtcagaaggcaccctcttcaggcgcttcggaaaaggcaggtcgccttcaatatcaccagaccgctcgtctattagatctggtaagacagatgttgccacaccacaggaaaattgcacaagaaggctgtct

SEQ ID NO: 78946 - DNA, 588 bp, Triticum aestivum
  Clone ID: PAT_TA_78946
ccacgcgtccgattccctcaggtgaagccttggggcaggagagctttgctcctccctacttggccccaaactctagtgctgaagtgatcaacagtggagccaactatgcttctggttcttccggcattttcgacgagaccggttccttctatatcggaagggtgccactaggacagcaaatcagctactttgagaagaccagagctcaggtactggagaccatgggggagaatgccacggccgacttcttggggaacgcgctcttcacggtggctgctggatccaatgacatcctggagtacctctcacctgcagtgccattcttgggacgacagaaacctgaccctgcagttttccaggacgccttggttgccaagttggcatttcatctcaaggtgccactcgatcacctctaactcgctagtcaccagcactgtaattttctctgctttgctcccgttctgagctcaccatcttgcaattcgcttccaaaacgaagcggctgaacgagctcggggctaggaaatttgtcatcgccgacgtcggcccgctgggctgcataccgtacgtgcgcgccctggagttcat

SEQ ID NO: 78947 - DNA, 334 bp, Triticum aestivum
  Clone ID: PAT_TA_78947
ccacgcgtccggtcaaaacttaccttcatcgtgttggccgtactgcaagggctggcagggaaggatatgccgtgacgtttgttactgatgatgatagatccctcttgaaagctattgcaaagaaggctggttctcagctgaaaagccgcattgttgccgagaaacctgtgtctgactgtgcaaaattaattgagcaactggagcatcaaatttctaacataattctgcaaaaaagggacgaaatggcattgagaaaggctgaaatgtaagctacaaaggcacaaaatattgatagctcacagggatgagatatattcacgcccccaagagaacc

SEQ ID NO: 78948 - DNA, 655 bp, Triticum aestivum
  Clone ID: PAT_TA_78948
ccacgcgtccggggaaggggtctgctccgagtactgcgagtgccatggcgactgcaagaacatctggaaacacgaggaggaagtcacagaggaattcgctgaatacaccaagaggaaagctgatgaagctgccgcccaagctgctgctgcccaagctgccgctgcccaacctgctgctgaccaagctgccgctgcccaagctgctgctgcccaagctgccgctgcccaacctgctgctgaccaagctgccgctgcccaagctgctgctgcccaagctgccgctgcccaagctgccgctcaacctcaacctaagccattgccagcacaagaaccagagtcgaagggtgaagccaggaataactccccatcggcagtcaaaatgaattggtgcagctgcaggacgagcggatgtcgcatccaccgctgcccttgcttcatgcacaacgcctggtgctcctcaaaatgcaactgcgcggccacagtgtgtgttaatcgcagtggggccaaaggggctcttgctgagaagctgcagcaccgcgggattaaaagagaggttcttgcttcaggttctgtaacgagcacggcgactgcaggagcggtgctggccaatgagggtggtaaggggtgcacgtgcttgttaagcaaatgcacaaac

SEQ ID NO: 78949 - DNA, 588 bp, Triticum aestivum
  Clone ID: PAT_TA_78949
ccacgcgtccgggcattgcaaaatgctgctgttgatttggatgatgttactttgtctttgtcgaaggatggctacagggacatcttgaagatggctgataacttttcttcttttaatcaacggctgagatatgctcattaccgaccatctttaccagtgaaatctgatccgaagtcttggtggaagtacgcatacaaagtagtgactcatgaaatgaagaaggcaagtggaagtctatcttgggagcaactactgagaaacgcaagacttcgaaagacatatgtatctttatatgcgtcccttctgaagtctgacatgagccgtccggttgttgaagataatgaggagattaatagcctggatcgtgaactagatatggaagttattctgcaatggaggatgctggcccacaagtttgtagaacagtcagcagaaagacagcatgctcaacaaaacaagcagtcctggtggtcatttggatggactggctcttcaaggatgatggagactcaaagagttttagtgatgaagattgggaaaggttaaataggataatcgggtacaaagaaaatacggagtatattcctg

SEQ ID NO: 78950 - DNA, 234 bp, Triticum aestivum
  Clone ID: PAT_TA_78950
ccacgcgtccgctgatcgtgaccagctattactcttggccagccagcccacccgtcgtctccggcaaaggcaaaagcccccctcgcggccctcctgctctccccaattggccccgtgctgtccggcgctcggctcggcttgcggggcgcgccgagaggggcggcgggcagagcgcggggagcgccggagcggagcatgcggcggagagagcgcgggcaggaggaggagcgggga

SEQ ID NO: 78951 - DNA, 217 bp, Triticum aestivum
  Clone ID: PAT_TA_78951
ccacgcgtccgggagcgacagtgccatcggaaggacgatttcattttgccctccgctggtatatcgctcgcttgtcccggcctagggggtcccctccacccgtccccggctctcgcctcagatctccacgtcggcgacccctgatcctccttagtcgtccgccgctcgaccccgccgagttccgattctgcactcacctcgcgacacaccaccgcgt

SEQ ID NO: 78952 - DNA, 514 bp, Triticum aestivum
  unsure (1)..(514): unsure at all n locations
  Clone ID: PAT_TA_78952
ccacgcgtccgctatgatgccaaaaatagccgattttggtttgtcgaggatcttntggcgagcaacaatcacgatttttcactaataacaaagagggaacacttggatatatggcaccagagtacagagtccgaggtgtagtatcgtacaaggcagacatcttcagttttggtgtcatagtcatagagataatcacaggtggtagggactatccatgggactattcatatttccagcaacatagtcccaaccatactgatccatctttccagcagttcacggagaaagtgcttgagagttggaagaacaaatttgtaaccacaccaaactataaaccagtggaaaaatataccaaacaagtaagacaatgtgtcaccatagccctaatatgtgtggaccctggcatggagaaaagaccctaatgcaaaggatataatcgaggagctttaggcagtagacccaggaggtccatgactgcatatagcacgcacagtgctacctgacgaaatggatt

SEQ ID NO: 78953 - DNA, 653 bp, Triticum aestivum
  Clone ID: PAT_TA_78953
ggtccggaatcccgggtcgacccacgcgtccggaagaaaacaaagacacatcggcatacacatgaatattggccccagtgttaacccaccaatcggtggactgacaaactgaaagtacggtaaacagattaccataccttgttgccgcatcattgttgctcagagtcacattgacagactttgcgtcctgtcctgacttcttatacttgtttgggcacttgtttgcccaatgttcctctgaaccacaagtgaagcagccatctctcttcttatctttcttcttacccttcttcttgaaggtagtattttgctggaaagagttctttcccttgaacttgtggaagttcttctgcaccacattggcgctagaagaaccctctgcccctttcacgtgtgagtcatttgctctcgagttccgctcaacacttagatgactgatgacatcctcaatagagaattcacgtctcaagtgcttgagagaagtagcaaagttcctccatccagcagggagttttgcaataatgcaacccgcgacaaagttgtccgataactcacactttaggagctccagctccttagcgatgcattgtatctcatgggcctggtccaatacaaaacggttatcaaccattttgtaatcatggagctgctcc

SEQ ID NO: 78954 - DNA, 506 bp, Triticum aestivum
  Clone ID: PAT_TA_78954
ccacgcgtccgtggtcttatatctacttatgcattggagacccttgttctgtacatatttcatgtgttcaacaactgttttactggaccacttgaggtgttataccgtttcttagaattctttagcaactttgattgggagaaattttgtttgagtttgtgggggccagttcctataagttcacttccagatatgactgcggaacccccgcggatggacactggtgaattgttgctgaccaaggccttcctggatagatgcaatcatctgtatggagttatgcctcgcacccaggagaaccagggtcaaccatttgtttcaaagcacttcaatgttattgatcccttacgagcaaataacaaccttggaagaagtgtcagtaaaggcaattactttagaatacgcagtgccttctcttttggggcaaaaaggctggcaaagttactcgaatgcccaaatgaagatctgattgctgaagtaaatcagttctttacaaatacattgac

SEQ ID NO: 78955 - DNA, 200 bp, Triticum aestivum
  unsure (1)..(200): unsure at all n locations
  Clone ID: PAT_TA_78955
ccacgcgtccgctcgattggtatcaccattggccaggcctgcaacggataggatctcctctccagggagagtgttgtgtgcatgcagcaggttgtgtggcatagggtttaatggttgcaaactgtcttgatcgacaatttccttttcagtgatcaccaagttgggctgtcnaaaaaaaaaaaaaaaaaaaaaaaaaaaaa

SEQ ID NO: 78956 - DNA, 680 bp, Triticum aestivum
  Clone ID: PAT_TA_78956
ccacgcgtccggaatgacgttgagtgaatgctattatgtgactaacttgtgttacaacaggaaatatcagcctatataattcccataagatataaatttatacatagttttcagattcaaatgcaactactatatcagttttcagagcacaactttgtatctttatcaatatgtggattggattgacttgtactttgtctaataaaagaacccgaggttttgtaatatttctgtatccattgagttgtactgaatgctatgcgcacgtttgataggagctcaaaacaaatagaactcggaagttggaaatgctatgtgtactgagttttactgagtagtatatttctgtacccattgagttaatttgctgtatgacctgatatgtgccactctgatagaaattggaagttggaacgaatagaaagtgccatcttataccttttcaaaattggcttataattatctgtttgatttatatcttgctaatccttgtgtattattatttgcttgaaatgtgcagtaaattcatctaccaagtactctccattccaaaaatagcgcgtatagattttttcagaagtcaagcttcgtaaagcttgatcaagttcatagaggaaaatatccacatcagtaaaaccaaataatactgtaaacactatgttggacaggggggggggggg

SEQ ID NO: 78957 - DNA, 535 bp, Triticum aestivum
  Clone ID: PAT_TA_78957
ccacgcgtccgctcaaaatccaaacctaccaaccccacacctctccctctcttccacctctgagtctgacctctctctcctcccgccgctgtcccagccccacacctcctcccaccccaccccaccgccgcgcgcacgtgcgtcgctctcctcctcggctccggccaacaggcgccgccgtccgacgcatgtaactgtgcctagctgtcgtctcttctcatggaccagcagggggcggcgccgtcaagcagcaccagcaccagcaccaacagcagccgcagcacgtcggaccacccccaccacgcgtcggccgccgcgcaccaccaccccttctactacgctgccgcggcggctacaggcgccacgccgccgccgccgttcatgggctcgcttgcgatggtacccgcggctaccccggcgggagcgcagacggccaaccacagccagtcgataacggtggccgagccgccgtccgagaagaaggtggcgaagcggccgaccaaggaccggcacaccaaggtggatgggcgcgggc

SEQ ID NO: 78958 - DNA, 546 bp, Triticum aestivum
  Clone ID: PAT_TA_78958
ccacgcgtccggggcggccaacgccccctcttgccccgtgtgtatggagccctggacctccgaaggcgagcatcgcatcagttgcattccttgtgggcatgtctacggcagatcttgcctggagaggtggttaacgcagcgtggtaacgctagtgctacgtgccctcaatgtggaagaaggtttaaacataaggacattatcaacatctatgcaccggaggttgctgttccaaataatgatcttgagaagcaattacggttttgcaggcaaaagctcgaatcccttgaggaagtggtcctgaaacaagggaagctgcttgacgagataatttctgagaagaatcacaggtcagcagatgttggtgtctcaaaaagacagaaaatagcagagcactcagatggaagaacatatctggaaccatcagcctcagccagtgcagcctcagcttctggcaacagttgccgttttgttttactgaaggaattatcttttgatggtgctcgagtcatgggcatagatgcatctaaccaaataatacttgcttc

SEQ ID NO: 78959 - DNA, 661 bp, Triticum aestivum
  Clone ID: PAT_TA_78959
ccacgcgtccgcaagaacctcattgtatctatttatcctaggattgaagattattgacacaaaaacttctgcaattaagagaaggttcagtttcactattacctttgttttcaaattaaacggcaactctactcatattcacgccagcagcatgcacttttttactcaacaagcaagagggattaaataaattggtgttcatctgagttacttgctgtcactgcatccatatgaggttgatgcattcattgttcgtacgcctctatggggttgatgcaagatcaaatcaggttaggttgcgtgtgtggctgtctgacatagaatggatacagtttaacaactttcattttagttagcatgaagtctgtcgttaatgtagatttttcttaacatttgttattgcttaatgcaaagaagcatcactgttaattaataaatttatagatggttctttggttcagactgcagaagcaacacatgatgttaccacagtgttcagtaatgtccaacgaaatttgtgaaaatgtactttggtaaataatccagtaatttcacccagaccttgcaaatggtagatatgggagccaatgaaacatcgataacatttctaatctattgtaagcctatcctagcatttttactgtacaaggagttgactact

SEQ ID NO: 78960 - DNA, 552 bp, Triticum aestivum
  Clone ID: PAT_TA_78960
tcgacccacgcgtccgctagaactagtcgcgagagcgagcgtccgtctctgtccgtccacgagctccgatcttctagacgccgggagccgagccggcgatggcggcgcctgctgctcttgacgttagcctcgagagggtagctacggcaccggccgttccaccacccggcatcggcgtcgacagtgccaccgcggaggcggagttcctctgggagctgcgcaagtacgtgctgctcctcgccacgctcgcggcctccgtcacctactccgcggggctgagtccgccaggcgggttctggcccgacaacgacgccgacagaggcgcgcgtctcgccggcgacccggtgctcctcgtcacctacccgcgccgatacaaggccttcttctactgcaacgccaccgccttcgtcgcctccctcgtcatcgtcaacctcctgctcgtccgctcgctcggccaccgccggcggtggctgcgcgcgctccaggccgccatgctgctcgaccagttcggtctcatgggggcctacgccgcgggcagctgcagggacgcgg

SEQ ID NO: 78961 - DNA, 500 bp, Triticum aestivum
  Clone ID: PAT_TA_78961
ccacgcgtccggatggacagcggcgccgacgaccgcagtagggcaaaggcgtccgctgagctcaaggtgctgctcgaccgcgagctcggcccgtgcccggacagcctcagaagggacctcggaatcggtgatctgtaaaatgcatatgcatgcatgcagtcgccagttcgccacctctgcctttctctttctccctgaacgtgccagtcgccagtgcggttgtgagttgtcggagctcccgtctgtgcactgcgacctgtcgcagtcgtcagagctccacctttgccttactttccttccggtttcattagtcagcgtggtggtttcttttgttacactgctagcgctccccgtgttcctccatgaatatatgataagttgaagctgcatagatggttgggtcctgtgtgctccatctcatttaggacgtacactggctcataagatagtcttatcctaagcctgacaggcaatctagaaatgacaataaaaatatggag

SEQ ID NO: 78962 - DNA, 288 bp, Triticum aestivum
  Clone ID: PAT_TA_78962
ccacgcgtccggggtgatcccagccacatgctaatgcaacatcttcgatctgtgtagttgttattattctgcttccttgactacacttcgggaaaagctgattaataacatcccatgctgatgtatcccataaatcatcaacaacgattaggtacctgcatgtcaagaatgcacacatgtcacatttatgcgtcagcctaatagtaacaacagttagatacgctaggaagaatgaaattttggaccatagtccctcccagtaccccccgcgccgcccccccccccccc

SEQ ID NO: 78963 - DNA, 450 bp, Triticum aestivum
  Clone ID: PAT_TA_78963
ccacgcgtccgatccgacgccctcctcctcaaaaccctcacccactttagcttctggccttcttctctcgccctcctccttccaccttccccttccgtcccctcccttccccgagaccggcgccgcccgatctcccgatctgctcgccccggcccgccgaggatccgcgcggggcgctccctatttgcggcgcgggtggtgtgcgcctggatcaggtgggcgtgggggcgcgtgggattcgtggcccatggccaaccccgacgacggcggcgggcgcaagttctggcgttccgcgtcgtggtcggcgtcgcgggccgccgaggcggcggggccggaggcggcgccgctcccgccccggatgggcccgccgccgctcaccccgcggtccaagggccgggcctgcctcccgccgctgcagccgctcgccatcacgcgccgcagcctggacga

SEQ ID NO: 78964 - DNA, 271 bp, Triticum aestivum
  Clone ID: PAT_TA_78964
cgggtcgaccccgcgtccgacatgacaagctacaaaaaggttgtttatcttgatgcagatactgtagttgtaagaagtatcgaggatgttttcaagtgcgggaagttctgtgggaacttgaagcattctgaaagaatgaattccggagtgatggttgtggagccatctgaaactgttttcaaggatatgattagtcaagtagatcggttgccttcctacactggaggggatcaaggttttcttaattcgtattatgctgattttgctaact

SEQ ID NO: 78965 - DNA, 518 bp, Triticum aestivum
  Clone ID: PAT_TA_78965
ggtcgacccacgcgtccggcatattaaagatccaacattgatactataatagcatggaacaatcaaaaattatagatacgtcggagatgtatcagaaatcttcttcaggaatttgtggcctcttgatcgcatcaggtgagatcaagttcaagccagcccaccatcaaccaacattttcgtcactttgaggttgcgaattgttggtgaaaccaacaatagcaaacacctgaccatgtgcgacaagggtggccctcagcattgaaaagggtgggcatattggaccccttgagtggcttctgcacctccattgttagctccactgtatttatctcatgggcccattgattgagctggcgacgtgaggagtgcaaatatgcaccccgcatcaatgcacaaggcctctgttgccttcttgaattcttggtcttcgtactcctcttcacccgacgcgctcctcttcctcatcctctactcatcgtagtccctctctcccaaaaatatatattccatatctaatt

SEQ ID NO: 78966 - DNA, 548 bp, Triticum aestivum
  Clone ID: PAT_TA_78966
ccacgcgtccgggcagagccggttagtaagtgtgatgcaacaacggcggttcaattcatcaagaaggtgatcttccgttttggttttccacacaacattataacagataatggtactaatctctccaaaggcgctatgaaagaattttgtcaacgggagcatatctggtttgccgtttcctctgtggctcaccctcagtccaatggtcaagcagaacgagcaaatcaagagattctgcgaggtatcaagccccagcttatggttcctttgcagagaacaccgggttgtttggtggaggagttaccttcagtattatggagtatcaatacaacccccaatagatctacgggttacacacctttcttcatggtttatggagcagaggcggttctccctagtgacatccgtcacgattcaccccgggtggcggcttacgttgaagctgataatgaaaaggcccgtcaagacgcacttgacctattagatgaggagcgtgacctcgcggtggctcgttcagcgatttatcagcaagacctacatcgttatca

SEQ ID NO: 78967 - DNA, 574 bp, Triticum aestivum
  Clone ID: PAT_TA_78967
ccacgcgtccggctcaagaattcgaagcattcacaagggaggtgggatcatattgttgtgttgactttgttgagacctgatattggaatggtttctgcgcagagtgaccagcatctgtctcctgctgtcctgggggaggcgctattctttgcacttcgtgtattgctttctcggagcctcagcaggtcctccactgtccttcgaaattcagattctgtttatgtgctcctcgtagattcacagtttggaggggtggtcaatgtccaaggggatctgaacaagctaaattttgatttgaacaatgtttatgagtgtgctgctgaatggataaaaaaggatgccaaaattacagtttcttccgttgaccgggtatggaataaacttgggaatgctaactggggagacattgggacccttcaagttctccttgcagtttaccactcaatggtccaattctgcggagcaccaaagtattctctcgatgaactggccacagagcatagttcccggctacagagtcgaagatcagagagacacttggtggacagacattccaatggaaacggtctgtttc

SEQ ID NO: 78968 - DNA, 750 bp, Triticum aestivum
  Clone ID: PAT_TA_78968
ccacgcgtccgatcccctcgatagcttttgtgacattagcatggtaactcacacatcgtagacctggtagcttatgtacaaatatcgtggtagcttttttgacccagaaaaaactagtgtaaacatacatttgataactttttgtatgaatagcatggtaactcacacatcgcagacctgataacttatgcacccatcctggtaactttggcgagggggttgtttacaaacatccacccgataacttttgtgtaaatactttggtactatacgcatcatatatgtgataactcacacacaaacatcgtggtaactttaacccgacctgataagaaggttagagtaaccaggtttatgccccgataataactgtgtaaacaacatggtaacatatgtagcacatgtgtgataatttacttagtgcagaagtggtaacttttgatccgaaaaagccgtcggaacatatgaacatgggatctagtttagaagctctcgtcctgaagaatttttatgtgaaaatgtttttcgatcggaccggcgtttgagctacaaaacattttgaaattttgaaataggggagaatctaggatgccattagctactatgtcctttagttcatttgcacatggggaaaaggtcggttgaccatttttattctccggtaatttctatataaacaaaatggtaacttatgaaccagagacatgataacttacttagtttgggtctcataactttgacacaaaaaaa

SEQ ID NO: 78969 - DNA, 751 bp, Triticum aestivum
  Clone ID: PAT_TA_78969
ccacgcgtccgaactcgaaccctaaccaggcggcgccatggaccagttcctcgtcgcggcgccgccttccgccgacgagggccccgaagcgccacgaccgccgcctcggaggtggcaccggtggagccgtatcgccgtggagctggacggccacatcgacgccaggtttcgacatcgggaatcccgccgtctcctcgattcccttgccgagattaggaccttcgaacacaagtactacacgcatggcgaggaacggtgcacgacatatgtgaatcgcatgattaatgcttcaacatttgctgggtgttaccattcagctagggagggggtttcggcaatggaattcgataaaaagggaatatacctcgcatcagtgacaaactcaggatgtttaacagtgcatgactttgagaccttatactgctccttgtatggcccattatgtcgtataccagatgactcatcaaactatgtgctccatatatcaaactcaatgcctctatgtgctgtccgatggaatccaggaaatcaagacgagattgtttgctcatctagccaaactgacaaagttttactgtttgacattgggtacgtctcatctgctccgactgaagttttacagaaagggatgaccaaatttcatggtttctgctcggaatcccggaagggtttgactgatctagcttttactccagacgacaagtcacggctatttgcttctggacttgatggtgcagtctacatgtgggac

SEQ ID NO: 78970 - DNA, 743 bp, Triticum aestivum
  Clone ID: PAT_TA_78970
ggtccggattcccgggtcgacccacgcgtccggatggttccaaagatgcttggtacggcagccttaagcgagagagaatttgatctaaacaaagctactcagatggctgagcaagaagacaagttggcatacagtgagaacccttatgttttagccacactgacaccccgtttgtggccttttatgagacacagtattacttcagtccggcgttctgctatacgaacattggagaggcttcttgaggtttgcaacaccaggagttcagctggagacgccttatctaatttctggcctacatccatattaggtgattcactgcaggttgccttccagaatatacttttggagtcgaatgatgagattcttcaatcttctgaaagggcttggaaacttctacttcagtgccctgagaaagaccttgagtgtgctgcaatatcatattttggtaattgggtacaacttgctacgactccatatggctcaacattggattctacaaaaatgtttatgccagttgcccttccccgaggaagccgttcaagagctgcaaagataaggcctgcaaagctagaacatgaaagttcaagaatggtatcttttggttctacaggagaaaatacttcacacgagaagcaattcgatctttcttcaaatgttccaaagataatcgtgggggccgattctgacaaatctgttacccatacacgagtgctaacagcaatggcccttgggctttttgc

SEQ ID NO: 78971 - DNA, 731 bp, Triticum aestivum
  Clone ID: PAT_TA_78971
ccacgcgtccgggttttgaactaagtcaactaggagaactgacagagcttggaggatcacttggcatttataatctcgaaaaggtgcaaaaaaaagacgaggcaaatgaactaaaactgatagacaaaaaccacttgcacaagttaatactagaatggtgtattgatagacctaacaggaatgcagaacaagaagaacatgtcattgaaagtctcgtaccacacagtaatctgcaagacctatgcattagaggacatggaggtgctaattgcccatcatggttgggcaggtacctctctgttgaaaatttagaatctctttccctatgtgacgtatcttggagcaaccttccccctttagggaagctggggttcgttgctggtgaagggtggcagagtcatgtctcaagccaaagtttccatattctgaaaaggctagaaatagtcaacataccaaaactacaaaaatgggctggaaacgaaccttgtcatttgttctccgttctagaggtggtcatctttatagattgtcctgaactcgtcgaattgccattttcacaccctactagccatcgagcaaagcatgatgagaatatgtcttggtttcctaaactacgggagctcaagattatatgctgccccaaattggcgtcattgcctccaatcccttggactcaagctctgtgctctgctgagataaggcaagcaggatcagtatttgagcagctagtt

SEQ ID NO: 78972 - DNA, 662 bp, Triticum aestivum
  Clone ID: PAT_TA_78972
ccacgcgtccgattagttgagaatgatacttcaaagactaacgtccatgacggaactgtccatcctttgactatccgtgtgatcaatcatgttaaattcctttttgattatcagttaacactgaagctactacttcaagaatttgaaactggaagtgatactgaatcccaacttacagttgttttgacaaagataatgcaagcccttcagaacaacttagacgggaaatctaaccagtacaaggatcctgcgctgatgagcatatttcttgcgaacaacattcactacatggttagttctgttcgcaggtcagaagccaagcatatacttggtgatgactggattcagagacatcgtaggattgtacagcaacatgccaaacaatacaaaatggttgcatggggaaaggttagtgcttcagatctggagactgtctccatccatcaaccgtcctctgctcctctccccgtcgcctagtcttgctgcggtggtggggttggtcgtcctggctatggctcatcatggtgtctcgcttcctcccttggtcgtcctcggcaagatccgggttttcctagtcggttcaactccgaccggcgtggcttgggatgctcccctcggttggtgcttgtcccctcgtggccttttccgtttgcggcccgggt

SEQ ID NO: 78973 - DNA, 287 bp, Triticum aestivum
  Clone ID: PAT_TA_78973
ccggtccggaatcccgggtcgacccacgcgtccgctccggccttctcgctcagatccggaatacctccggggagctcgctcgctcggcaggcgatctcttccccgatccggcggcgcggcgtggcctgtcggtcggtcggcgcttctaagccacgggaggtcgggagggaaagggattccgctgccttcgagcccactccaccctgccccccctccctccgtcccgagaaagctccctttcccccacccacctccaccactccatcactggcgaggagaggagagga

SEQ ID NO: 78974 - DNA, 742 bp, Triticum aestivum
  Clone ID: PAT_TA_78974
ccacgcgtccgattgttgtgaatgacatattcactgagttgtggaggaggatacccataaagagcctcaaatggggtcttcttcagagaagaatgaaatgaactattgtaccaatattcagccattggtaaatgttgcacccacttggttggatgagcagaagtaagacacctgagatagttttcaatgcattggttaaccctctcggtttggccatctgattgtggatgataagctgaactgtatctcaagtcaactttcagtgctgcaaaaatatccttccatagctgactagtgaaatttttgtctctgtcagatactatggcaataggagggccatgcagtttaatgatattgtcaatgaatacttgagccactgtcttcacagtaaaaggatgtgacagagtaaggaagtgtgcaaactttgtgagcctgtcaacaaccacaaaaatcacttccttcccttgtgactttggaagtccttctatgaaatccatactcagatgagtccatgccatatcaggaatatgcagagggttaagtagcccaggataatggcaggtttcccccttatttttctgacaaacatggcattctgtcacccatttttctacatcagatttgaggccaggccaatagaaaattttctttatcctttcataagaagcttttctgcctgaatgccctcccaaagccgatgaatgtaaggcttgtatgatttttggatttgagttctacatca

SEQ ID NO: 78975 - DNA, 300 bp, Triticum aestivum
  Clone ID: PAT_TA_78975
ccacgcgtccggtgaggagacgcggaggcaagcagcagcagcagcctccaaactccgaggcaccacgcgccccgtccgactctccggcgagccgaggccgccgcggaggaggaggaagggcagagggggaggccctcgcggggcgcggctgagcgggccgcggcgcggagaaaatggtggtggtggacgcggcggagttcggggcggaggggttcgacccgaagcggtggatcaacgcggcgctggacgcgcggcacccgtcggagccgctcgaccgcttcctcgccgacgccgaggagc

SEQ ID NO: 78976 - DNA, 779 bp, Triticum aestivum
  Clone ID: PAT_TA_78976
accggtccggattcccgggtcgacccacgcgtccgcgcagatcggcaacgccggtgcgcctcagggtcacggcagtactgtcattgatcagcagcgcctccgcgaccagccttcttcttcacgggcaagagcaccaggatgcacttgttgcggcggagcgcccaccacgcgggttgttctcaacctgcccgtgtgcgaggcttgctacaggcggttttttcacgccggtgcgcctcagcagcacgcgcagatcggctacgccggtgcgcctcggggagcagtgcgcaatccagtggcagtccctacccgtgagcagcagttcttggctaacatggatgcgccgccgaggcctttttccatgtttcccttccggtggggcccggcgaaccccgcactggagcggcagtcttcttcaccagcccgcaatgggcctccgcagcaggcgcagatcaggcctccacccctccacaccttggcaccgccaccggagcggcagtcttcttcacgggcaagggagcagcagctccaggcccaggctgatgcgatgaggctgcaggtggccaatattctgaacaaccctttctcgctcgtccggtcgggcccggcgaacccagcgcctcagcggcagtcttcttcaccaggatgctacagcaatatcttcaccggcaacgggcccttgttcagcagcgccggtgcacgtgcaccccaggctcagggtcacggtactgccattgatcagcagcgccagctcgacctcctccgcggccagccttcttctt

SEQ ID NO: 78977 - DNA, 753 bp, Triticum aestivum
  unsure (1)..(753): unsure at all n locations
  Clone ID: PAT_TA_78977
ccacgcgtccgggcggcgacaccgctgctacctctccctccgcttcttcagattcgaaaagtacagctccggccgggaagcacagcgacgtttcccaggacgaagggtggatcacgattcccaacaaggagcttcctggggattggagtgaggtttcggacatgctgcagctgcggcctttggatcgccccttccttttttcctggcgagcaggtccatatactggcgtgcctatcagcctctaagcaagatatgacctgcatatctccgtttagaattgctgccgtgatgtctaagagcggaaattcgccgcggcaccccacaaataaatctagctctgtcagtgagaatggggatgccaatggaacagccggagaaaatagtcctcacggtgtcgaggataacatggagagtgttgaactcaatgacaaagtatcttctccttcaaaacaagatatcctggagactgaatccctccttcggatggaagatcacaaagagcaaatagaaaccgtgctgcaaaaattcaaaagatctaacttttttgtccgaatcgcggagtcagatgaacctctctggtccaagaaaagagtagctgcaactaagacggcagatgaacaattatattcggatagccagggaaataacacagtttcaaggagtactgcttacaataccatnttctgataaaggagtttttgatggtagcacatccggaggagtcgctcgggatactgtaaggtgctatgctct

SEQ ID NO: 78978 - DNA, 436 bp, Triticum aestivum
  Clone ID: PAT_TA_78978
ggtccggaatcccgggtcgacccacgcgtccgctagccgcctcccgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccagcacgctcacgatcgtcgacagcggcattggcatgaccaagtcggacctcgtcaacaacctcgggaccatcgccaggtcggggaccaaggagttcatggaggcactcgctgccggcgctgacg

SEQ ID NO: 78979 - DNA, 531 bp, Triticum aestivum
  Clone ID: PAT_TA_78979
ccacgcgtccggcgcagcgggcggggacgactacatgtactcggaggaggagttccagatgcagctcgccatggcgctgtcggcgtccaacagcgactgcgcgggggaccgggacagggaccagatcagggacgccaagctcatgagcctcggcgggggcgaccgcttcgccgccggacgggacgacggccacaccgccgactcgctctcccgccgctactgggtgaggctccactccgcaccggcgaattccattcgagctgagctggaatgctgaaccgcgcagttctctaatgatatagtagcaccattaggttgcggttgcttaattacgccagttttcagaattgacgcacttaatgtggagcaagattcatggttcaaacaaatgtcgagccagattccggtggtgctatttgcttgctagttaacctccaccatttaccattttaatccatgatactactaagtttatctatcattgtctgaattagtaaagttttttagttggaatataagtaaagcttttct

SEQ ID NO: 78980 - DNA, 553 bp, Triticum aestivum
  Clone ID: PAT_TA_78980
ccacgcgtccgagtgcatataaactcttccatgtggagctcagtccggatccgggacgtgactaatatagaatgagcactccgtcactgatgtatcaaccattttgttgcctcatagtagctggtatacttaggatctacaaagtttccgtaataatgacgtctctgttgccattgtaatactacccctgcctgtggccatccattgataacatcgaaagacacaagggcaagtcatgtaaactcttcataagagcaagtctactctattatgagagtactgtagaagtgtaggtgctgacaatcgagtttgcacaaggtgaatcgagtttgcacaaggtgaaaatctttcggtagtggctactttagttgttggcattcatggcatgccatgaggaatgcatcggactctctgctgggagatggaccgcggcggtgaggtggtggacttccatgcagacagtgatcgaccgacaacgctacggtccatggcttggtggtggagattcagatctggacggtcgaatgggggtggctacagacaatgctgcagc

SEQ ID NO: 78981 - DNA, 296 bp, Triticum aestivum
  Clone ID: PAT_TA_78981
cggtccggattcccgggtcgacccacgcgtccgcatggtcccctttgggggcgccgcctttttcccgggagagctcgtcagggaggcgctggacgaggttgacgagggcggcattgtcagcgaagaagccctggacgcgcgcgaggtcggcgcgacggtcggcgatggcctgggccacgcgggacacggccctcctcgtctcctccggcgagaacgcggaggccagcggcgtcgctgtccccttcctcgctgtagccatcgctgccgctgtcgcgttgactagttctagatcgcga

SEQ ID NO: 78982 - DNA, 628 bp, Triticum aestivum
  Clone ID: PAT_TA_78982
ccacgcgtccgcacaattttgatctgatcatttcaaaatcccacaacccctcttccaaaatcgcgtcgtcacaccaagaagctctcggaatttcgagttctcctcccatttttcctggcatcgggcgcgcagattttgaccagttatcaactgttcttctccagtccctcgaagcgcagaattttgttcctttttccggctgttttgatccgacagttgttccgaatcactctctccgcagctgacgtcccttttccgggttttgctattgctgggggcgtaaaatccctcaagctggcgaattcggcgtgtccatggaccagcccgagagctctctcccccatgccgcggtccagaaggggcagaccccacgccgcgaggagctcgtgcggctcatcgcgcagtcgctctactccctcggttaccggaaggcggcagccacgcttgaggcggagtccggtgtgccgctgtaccccccggagcacgaccgcctcctgctcgacgtaatgtctggccggtgggacgcgtgcgcggccactattgactctcttaccggcattaccgaaaggaaccgtgcggtcgcggagtttttggtgtggagagggcacttcctggagctgctgggcac

SEQ ID NO: 78983 - DNA, 742 bp, Triticum aestivum
  Clone ID: PAT_TA_78983
ccacgcgtccgaaggcaagtaaaaaggataaatggaatcaagtgaaggattcaattggtcgtgcactaagaaattctagcgttgaagcaatggtaaatataatagcccttagttacttggatcttcctcgtcatctcagaacttgtttgttgtatctgagtatattcccagaagatcgtattatcgagaaggagaacttgataaagagatggattggtgagggatttatatgtaaagagagcagtcatacaatgtatgagttgggagagatatatttcaatgacctcatcaacaggagcctgatccagcccacggggattggtgggaaatgtagcgaggtcaagagttgccgagttcacgacactgttcatgatttcattgtgtcgaaggccgtggatgagaactttgttactgtaataggtgtaccagctggtgtaaatcatgatccacagatgaaggttcgtcgtttgtccctgcagaacaacggagagattccggcgtgtctgattgtatctaatgctcggtcactccatgttttcgggcgtaatgcgaagattccgtctgtgtcgcagttcgggctcttgcgtgtcatggactttgaacactgttggcagttaaaggattatgaccttgctggcatcggaaatttgctgcacctcaagtacctgaggctcaagcacacaggtgcactcaaagcgcttccggaagaggtagcaaggctgcaggagttgcagattgatat

SEQ ID NO: 78984 - DNA, 385 bp, Triticum aestivum
  Clone ID: PAT_TA_78984
ccacgcgtccgggacacacaagcaattgaaggtcagaaaccacagctggctgccagaacgttacctgaaccaatgaagtagtaacaatccttcagcgtcaaaaatcaaggtaaagaaccaccgtcagctacctgaagccctgaactgaaccttaccctaaccaaggaagaaagcagtaacaagcctgctgcgcggcggttgccggcccagactgagcagcagcgacggcccgcagcttgggaggccagagcagccaagcggcggtggcgcgggcgtgcttggctggctgcacgtgcggccgggattgactgcaagaggatggccggatacacataacacacttgaccttctccaacacaatattttgaccttcacaaaaaaaaaa

SEQ ID NO: 78985 - DNA, 374 bp, Triticum aestivum
  Clone ID: PAT_TA_78985
ccacgcgtccggtcatgagcttagtctgatcgaacacctccagcttctggtactcatcgccggcgaggagtaccagaagctggaggtgttcgattagatcgattgtcagttggcatgagcttagtctgatcagttcttttcagaattggcagctggtgttgattctcagaattcgaaccaaatccatgcctgcaaatgcaataggtttccgtcgttgaacattatggttgtgctggtaggatgattggcatggtttagctttatccagttttagtgatgaatcgtccttgatttggagtgcatgaatgaaccttctgtattccggacagtgtactgttcgtggtatgatgattggactggaagaacggatttct

SEQ ID NO: 78986 - DNA, 417 bp, Triticum aestivum
  Clone ID: PAT_TA_78986
ccacgcgtccgcaaaaaaaaaaaacctctgtttctcctccggcagggcgagcacgccgtggaggcggaagcgatgccttcctccccctcgccccccatcgtcctcctcagcgacagcgacgacgaggaagccaccgcctccgccgcgctcttggggctcgccgccgagcgcatcacatcgtccctggtcacgcaggcggacgtcgacgccgtctgcaggaagcagggcgttccgagggagttcgtcgcgcgccccgcgggcgacctgcgcgcgtgcagcgcgccgccgccgggggccgtctgcgtgtacgcccacgcgctggaggccggggtgcgcttcccgctgcacgccttcttccgcgacgcgctcaaccacttcggcctcgccccgggccagctcgcgcccaacgggtggcgc

SEQ ID NO: 78987 - DNA, 501 bp, Triticum aestivum
  Clone ID: PAT_TA_78987
ccacgcgtccggcagcgacgacgagtccaccaccgctccactctcctccccggcacaccctaatcgctttcccgggtttaaaaccgctccagatccgacgagccgaccaagtcaatccgccggccaccgacgcgcgccgcggcaccgaagcttcctcccttccttccctccgcccgacccgcgatctcgattcctgccggagcgaggcggaggaatgggggtggaggaggaggagggcgccatcaacggcggcgaggaggggcccggcctcgcggcggcgccgcacgaccgctgggtcctgctccgccccgcccagggctccgcccgcccctccgcccgctacaagcatgccgcggaggtggttcaagacaagctgtacgtggtcgggggaagccggaatgggcgctctctgtcagatgttcaggtctttgatttcaggacgtccaagtggtcagcgttactgttaagtcctagtcgagattccaaccagctgaatcttga

SEQ ID NO: 78988 - DNA, 598 bp, Triticum aestivum
  Clone ID: PAT_TA_78988
ggtccggattcccgggtcgacccacgcgtccgcactagacgtaacagcaagcccctgcctcgcatcttgtcaatatcgatccacaaaccattcctatggctgtcggttttctctttgcaaaggagcaagatctccggcgagctagatgagtcagtccggtggaacaacagcaggcggtggtggagggggttcagtttgtctggattcaggcgaagaaaagactaaagccaccacattacaaggcgagacaggtcagggagaaggcaagggtgaggatgctcctatctccgagaacaagatcttaacaatgcgaacattgaaggatggacaaggagagaacggaatcgacagggcgctgcatccaagaaaccaagttcggacagatgtaatcagatggagatagcacttgggaatgctgggaagattgggcaggaagttgtttttcaaccatttaaagggatgcaattcgactcaagagaaggatgcatacgaatttttcaatgcatattcttgggaaattggttttggtatcaagcatggcaataaatacataaacaagaacggattcaagacgatgcaggaccttttgtgttcatgc

SEQ ID NO: 78989 - DNA, 450 bp, Triticum aestivum
  unsure (1)..(450): unsure at all n locations
  Clone ID: PAT_TA_78989
ccacgcgtccggctggacatccagcgtctccccggcgtggccgagctcatcgaggccgagcgcctcagggcctacaacctcctcgcgaatgtgaggaagacggccgacggttgcgtctggctggtcgccggcgccctcgaggacctgaggggtgccgtgcccgtgcgtgcgacttgatcgcgctagctagttcttgtgttcttgcgttgcgtgcgtgaaacatgtcttgcgttttttcttgcatcttcttgtgttcttgcgtacgcgttgaaactgtcgatcggttgctgctgctgctacctggattctatgaatgccgcactagttttgtactgctggtttctatgaatccaagactcccaagatttggattctatgaattctgtgaatccaagatttccaagcagtctanaaaaaaaaaaaaaaaaaaaaaaaaaaaaaaaaaaaaaa

SEQ ID NO: 78990 - DNA, 715 bp, Triticum aestivum
  Clone ID: PAT_TA_78990
ccacgcgtccggggatctgctctgctctcctctccgtcttcactccccggaagtcagcctccagccatggcggatctgcagacgccgctggtgcgaccaaagaggaagaaggcgctcatctacttcaacatctacctgggcgacatgtggtccgccatgaagtcggagaagaagcggcagaaggagcacgaggacaacgtgcagaaggtcgtgaagcggctcaagcagcgcaaccccaagaaggacggcctcgtctgcacggccaggaagccgtggatcgccgtcggcatgcgcaacgtcgactacaagcgtgtcaggcacttcgaggtcgacctctctgccttcaggaacatccttgagatcgaccccgagaggatggtcgccaaggtcgagccgctcgtcaacatgggccagatatccagggccacctgccccatgaacctctccctcgctgtggtggcggagctcgatgacctcaccgtcggcggcctcatcaacggctacggcatcgaggggagctctcacatctacgggctcttctccgacacggtggtcgcgctggagatcgtcctggctgacggccgggtcgtccgagccaccaaggacaacgagtactccgaccctcttctacggcgtgcccctggtcgcagggcactctcgggttccttgtttcagctgagatcaagctcatccccatcaaggagtacatgaggct

SEQ ID NO: 78991 - DNA, 703 bp, Triticum aestivum
  Clone ID: PAT_TA_78991
ccacgcgtccgaaaatcggaaatgaaatggaccctggatcttacatcaaggtcaaatgtgtagcatctggtactcgttggcaaagtgaggtgataaaggggttagtcttcaaaaagaacactgctcataagcacatgccgaccaattgtcacaatcctaggttgcttctactgaaaggagtacttggccattctgatgttggtttatcgtcatttaattcaatggatcaggaaaaaggccaactggagaggactataagtaaagtgatggaaatatgcagtcccaatgttataatggttgagaaaacagtttcacgagacatacaggagcttctactaaaagaaggttgtacactgattcttgatatgaagctcagccggttgcaaagaattgcacgctgcacaggttctcccataatatcatttccagaagttttggatcaaccgaagctgaagcagtgtgactacttccatactgaaaaattcattgaagagcataacattgctagtgaaggtgggaagagactatctaaaacattaatgttcttggaaggttttcccaggccactgggttgcacgatattgctacggggagcaaacaccgaagaattgaagaaagtcaagcaagtcatgcactacacggtctttgcagcataccacttgatccttgaaacgtctttctttgaagatcagcgggtgttctt

SEQ ID NO: 78992 - DNA, 158 bp, Triticum aestivum
  Clone ID: PAT_TA_78992
gaccacgcgtccggctgctttctatataaatggcttgctctaattctgatttattaaaaaagcagcacactccatatgtcattcgtaataattaggtcatttgcacatacagatactgaaggctgagtagtgctttatagggtagctggacagcacaa

SEQ ID NO: 78993 - DNA, 725 bp, Triticum aestivum
  Clone ID: PAT_TA_78993
ccacgcgtccgcgagattatgagaggcggcccctgcgtgtggaaagggggcaaacattaggggaaaaaaaagcgacgacgccacgcccccgtccgcggccaccgccaccggcctccccgcccgcccatggccatttcccccctcgtcctcagcggggccgccgtcgccacgctcgccgtcctcggcctcgccgtctacgcctgccgccgctggcgccggggcgcgccccccgccgcgctcccgccctccgcctcctcccagggcgaagatatcaacaggcctctaatatcagacaagttggatgactactcgggcccaagcaataaccttggtagcaataatgctggtgagtctacaatgtggacaaataggagtaccacttcaccaaggacgcatactcatcccactgaatctcatcctattgaaggagaagttcatgtgattgatgttacaaatggtacaccggaagagctccatctgggaagtacgctgaagcgtacagcagaagcaagtgtgcgagcatctgaggcaaagcacacaagaagggcctctggagagaataataacggcggcattcctgtgaaggatatcacagttggaagccacctagccttggaggtcatagctggcccatctcatggaataaaccgctacctgcagtcaggtaatacgtccatgctcccaatgactcttggaaggattcctcaaagcgatttggtgttaaa

SEQ ID NO: 78994 - DNA, 490 bp, Triticum aestivum
  Clone ID: PAT_TA_78994
tttttttttttttgtttgaagcatgtgaagtccacgctagttctgcaaatcaaaaaatctagtatatgctaataatatctaaattggtggtcatgataccaaaccatgaagaagttatcaagaacaaataatgcctatcaaacaatagaatacgacaagcaccgatttcatctagcttgaacaacaagaacttagctttcaaccacagattcatcatcaatgccgtcacttgtttgggaacttcctgtggctgaaggcatatctttcttctcttcgcactcagagactgctgcattggaaaaatgattcttcagcaccatggagatatctgattctgaagctccagccaacttaaacctttcaacagaagcatcaagattcttcttccaatcaccgacaacaagtttgaattccacttgagagcgctcaaaaagcatattgcccccaaaataggtgaatctgttgcctcatcacggctgcctgctcagct

SEQ ID NO: 78995 - DNA, 687 bp, Triticum aestivum
  Clone ID: PAT_TA_78995
ccacgcgtccggcatcactcactgcaatcacactctatcactagctagctcagctgccctacagtgcacgcggattaactagccatggcagctcacgactcggacctcggcggcgccgtccacgtcctcctgctcccgtacccgagccagggccacatcaaccccatcctccagttcggcaagcgcctcgcctcccacgccggcgtccgctgcacgctcgccgtcacgcgctacctcctcggccagggccgggacccgtgcccgggcgccgtgcacctcgccgagatctccgacggctttgaccgcggcggcttcgccgaggccgacggcgacgtcgcggcgtacctcgcccggctggagtccgtcgggtcacgcactgtcgacgagctgctgcggtccgaggcggagaagggccggcccgtgcgcgccgtggtgtacgacgcgttcctgcagccgtgggcgccccgcgtggcccggcagcacggcgccgcgtgcgcgtccctcttcacgcaggcgcccgcggtgaacgtggcgtacgcgcacgccggtgctgggcggtggaccgttccggtcctcgcgggcacggtgccgccggagcttcccgggctgcctgccgggctcggaccggacgacgtgccgtcgttcttggccaagctcgacgagtgccccgcgtacctagacctgctg

SEQ ID NO: 78996 - DNA, 610 bp, Triticum aestivum
  Clone ID: PAT_TA_78996
ccacgcgtccggtcatatgaagtgccaaatatcaatattctacatttgctgccaatattttacaaattagcttcatttatttactggtgtgcgtcttttttttcttgagatgcttatttatgacgactgtctcttcactggttattggtttatgttttcaaatgagaaacatagctaattactaacctttcagggggagagctgttataatccttacaatccacgagttccaggcctgttgaataagcaaaggtttggtctaagaaagtgaggttgctcgtgcaatattcattgaaggtcatcaaatccctttgataggggttaaaagagatggtggcttcaactatgcctcaagagatttagcagccctttggctggttactgaatcatagttgaaatgttttttctatacctcactctttctcggtgtccctattttctgtagaatcaaagtggtatatttcatagttgatgcagttctgccattgtaggtgtgcttttctggtacagcaaggagggttctatttttccaaaaacatatagtaaagatagttcagcagaaactttcacgaagtaatagtgttgtactaccaaaaaaaaaaaaaaaaaa

SEQ ID NO: 78997 - DNA, 433 bp, Triticum aestivum
  Clone ID: PAT_TA_78997
tctttccgctgcagctgctgccgtcacactagctaccgaaaccgtcgccgtcgtcctcctcctcccctcccgcccgcctcgacccctccgccgcaatgccggaggagaaggagtacgtcgccgttcccatgggccaggcgccggagcccgcggaccccgaggaccccgacaagtcgccgccgcgccccacctcgccggccacctccacccgccaggcatgctttgcggaccttcaaagctgggtgtcaagaaaatttatgactggatgtgtagttattttcccaatggctgtgacattcttcatcacttggtggtttattcgattttttgatggattcttcaggccactctatgcaaagcttggagtcgatgtatttggtacttgttccacaaatacttatgtctagccacttgctggtcatggccttgggtt

SEQ ID NO: 78998 - DNA, 280 bp, Triticum aestivum
  Clone ID: PAT_TA_78998
ctgcaaaccaagaacctttcatccccaccgccctccaccgcgcagcgcccacctcctctgcccttcatcgccggcgaccgatggatcagttcccagaccggcaccacgtgcggctgcggagccgcgcgctcggcgggtacctccacgccgccgacgacggggagagcgtcgtcctccgccggagccgggcctcgctgaacgcggcgtgggaggtgcacctccgccccaacggaggccgcggcgtgcacctgctcctgcacagcgccgcctacggccgcta

SEQ ID NO: 78999 - DNA, 424 bp, Triticum aestivum
  Clone ID: PAT_TA_78999
gaaccgagccaaatctcgccgccgtcaaccatggatccgagccggccactcctggggcgcggcgccttcctctcctcctcggcgcacgccgccgccgccatcatcctcatcgccttcctcctcctcaccctgctccgcctcccgctctccccctccatctccatctacacccctccccccatcgcctccacgccccaccaccacctgcagcaccaggaccatgaagaccaggagcaggaggatgcctcatcctgcgacctctcctccccgctggactgcgccgacccacgcctcttccacctcatgatgcgcagcgccgtcgacgccttccccgccgtgcatttcgcccgcttcggccgccccgttcccggcgacccgccatccgcttcctgcgacatggcatggcgcgcccgcaccaactcct

SEQ ID NO: 79000 - DNA, 334 bp, Triticum aestivum
  Clone ID: PAT_TA_79000
ttttgcccctttcaactccggcgatgctcctcctctactgccgccccttctcctctccctgccctccactccgccgcctcctacgatgccgctgcacctgttcttccgcctcctcccccattgttccgtaccaccaatccttcgcccgtcgcatggccctcgcaggcatccacccccaccaccgcattgcggttggggtctcgggtgggccggactctatggcgctgtgcgtgctgacggcggcttggaagaaggcggcgaagggcgggtccgggggattcgtggaggggctcctgggggtcgtggtcgaccacgggctgcggctcaagagcgc

SEQ ID NO: 79001 - DNA, 363 bp, Triticum aestivum
  Clone ID: PAT_TA_79001
caaccaggagccggccctgttcgcgacgagcatccgggagaacatactctacggcaagagcgacgccgccgcggacgagatcgaccacgcggcgaagctgtcggaggccatcaccttcatcaacaacctcctcgagcggtacgagacgcaggtcggcgagcgagggatacagctctctggagggcagaagcagcggatcgccatctcgagggcgatactcaagaacccatccatactgctcctcgacgaggccaccagcgcgctcgacgccgagtccgagaagagcgtgcaggaggcgctggaccgcgtcatggtcggccgcaccaccggggtgatcgcgcaccggctggccaccatcaggaa

SEQ ID NO: 79002 - DNA, 465 bp, Triticum aestivum
  Clone ID: PAT_TA_79002
gtggtgctcggataaggcgaaatggaccatactatgcttatgatactcgtgatacccaccactctgtctgcattccatgttacaataagtcccgtggtcacaccattgaggttgaaggacagatgtttccgaaggcccgatttcagaaaaaaagaaatgatgaggaaactgaagaatgttgggttaattgtgaaagatgtaattgctggcagcatcagatatgtgctctgtttaatgacataaactatgatgtaaaacaagcatatacttgcctgtattgctatattgaggaagtgaagcgtgggctgcacgtgccttcaccacagagtgctgttcttggggcaagtgatctgccaagaactgctcttagcgatcatattgaagagcggctttttaaacggcttaagctggagagacaggctcgtgcagttcagtcaggacgtagttttgatgaggttgctggag

SEQ ID NO: 79003 - DNA, 496 bp, Triticum aestivum
  Clone ID: PAT_TA_79003
tcgacccacgcgtccgctgctcttctcctctctctctctctctcacaactcctgctagaaaaaagttttctttccccaaagtccggccagccaggatgcagggcgccgccgccgccgccgaggggaggagcagggcttcgccggacaaggccgacgaggagagcgccaagaagccgcgcctggacctgcccgacgcccactccgtgaagcaagagctcgtctctccagatgcggccgaaggaggagacccagggggcatcgtcgcggcggcggcgccgtacagcccgagagaggagctcgccgtgaggatcgacgagcgcctgctccactgccccctctgcgccctccccttcaagccccccgtcttccagtgcaaggcggggcacctggcctgcggcggctgcgtcgcccagctgccctgcggccagagcaaggcgtgcgaggacggcgccggcttcttcgacccctgccccgcgctggacgccgtcgtgacctc

SEQ ID NO: 79004 - DNA, 292 bp, Triticum aestivum
  Clone ID: PAT_TA_79004
tcgacccacgcgtccggccagatttggtgacggtgttgtcctcgatatcactccctccttggaggcatccccttggaggcccagcaatggttcctgatggtgtacatggcttgttggtggagcttgggtttgtggtggtgccgacttttttctttctttctttttgcactagccttttgctgtgctttccttctcgaagggtccttgtaacgcttcttttgatcaatgaatttggcagccctactgccaacgttaaaaaaaaaaaagaacaaaaaaaaaaaaaaaaaaaaaa

SEQ ID NO: 79005 - DNA, 485 bp, Triticum aestivum
  Clone ID: PAT_TA_79005
ggtcgacccacgcgtccggccgccgctgccgccgccgccacccccatctgccctccgccctcgacctcgtccaccaacctgtgcaaccccatcggggtacacgcccgtcgactcatcgttgccttccttcgtcaccgccaccgggcgggtcaactgcaccggtgtggcgaggccgaagtcaacgtagtctccctttccaggaccagatcccgcggcgaaaatcgagccttccccatgatactgtgggcacggcgacgacaagcacgagatgaatcagtgttcttggcacctctgccatctcagggtcatcgcgccaccaccacgctggcgcgctccacttctccatggccctccaagccgatgagcacgggtgagctccctaccactgctccctccaccgcgtcggcatgagcggtgcctgctcctccctacgttggacaacacgctgctcagatttgacatggtgaaatctcctcatctttccc

SEQ ID NO: 79006 - DNA, 614 bp, Triticum aestivum
  Clone ID: PAT_TA_79006
gtcgacccacgcgtccgtgcaagtccattgggaggtacttcacaagctccagttagaggtgcttctccacaggtgaaccttggtaccgtgggaataccaacacagagttcaactcctgcagcccagacaccggctattacgacatctgtaaagccaaatccaacagatctaaacattctgtcttcacaaccagctgttaatgactccaaggcattggttcccttgggaaatggatcgccgtccaactcaagttttggggttgatcctttctctgcaactccacaaccaacgcaaaattcgtcttccccccatgtttcaaatggcttgcatggttctacagcccttggcccagctgctggacctcatcacccccctaagccaatgccgcctggtcctgtgcagggtatatcatcgttgctttctcatactggccaggtgccaccaaaccagccagctcctaagcagaaccagtttaatagcataccgagcactccaggaccactgaatgctaacatccctggtggacaaattcctacaaatcaaaaacagtttcaggccccatggcccaagatcactcaagcagatgtcaggaaatatatgattgtatttattaa

SEQ ID NO: 79007 - DNA, 511 bp, Triticum aestivum
  Clone ID: PAT_TA_79007
ttggttactgcacctgatggctcgaactcggtgctagcagaagttcctggacttagtgagccaagcaataactatgttccttctggtttatcacatgctggttccggtaggcagcctgaagtgtcgagctgcggaacggcattaagcatggctgaaacagtaatgcaagcaccattaaaagtttccaccacaccccagctatctgttgatgctcaaaagattgaagaaagaactatgaggctaagacctctgacgccttcatcaaacaaaacatctatatcaagtttgtcggataagttaaaaattagaggtgcaagagctggggattctaatggtcctgtgaagactgcgccacaactgtcaacacagccttctaacagctctgttcgtactccagtcaaatctgagcctgtaaagccatctcaatcaggaagctttcaagtcctgacccgcgagcagaatggtgctgcaaatactgccaaagactgctccagcaatcctgtgagccctg

SEQ ID NO: 79008 - DNA, 632 bp, Triticum aestivum
  Clone ID: PAT_TA_79008
tcgacccacgcgtccggtgaaaataaccttcttggacattgcggaccatttctatcaaaactctgcgggaatctgactttgctgcaaaagttcccggagttacatgcttctgcaatgcttgctctttgcagactgatgattattgatgcagaattctgcgaggcaaatctccagatcctatttactgttgtggaaaacgcatcctctgaaatcgtccgatctaactgcactatagcccttggtgatttagcagttcgctttccaaacctcttagaaccttggacagaacacatatatgcccgattgagcgattcgtcggcatctgtgaggaagaatgctgcgctggacatttctcatctcatattgaatgacatgatgaaggttaaaggttatatcaacgaaatggcggtgagggtagaatatgaatatgagaggatctcaagccttgcaaaactcttctttcgtgagttgtcaaagaaaggaagcaatccaatttataatcttcttccagatattctgagtagactgtgcaatcaacacctcaaggaagaaacgtttcgcaacatcatgcaattcttaattggttctattaaaaaggacaaacaaatggaagctcttgtcgataagctttg

SEQ ID NO: 79009 - DNA, 618 bp, Triticum aestivum
  Clone ID: PAT_TA_79009
gaccccgcgtccgcagcagggaccgcgtcacggtgtggaggacgagggacgagccgtggacggggcggaggtgcggcgccgcggcattgccggtgtcgtcgccttcgatggaggacgtgctcccgccgccgtcggccactggcacgcctccagcggcgacgtcgactcttgctagtccgtggggctcgggcttcactttcggagaccaaacggcgccaccaggtgacacgccgcctgaccagatgctgccgccgccaccgccagctgacgacgacgacgacgattcggccgacttgcctgacctgccgctgccaccgccgcctcctccgtctgacccgtcaacggactggccggacctgcagctgcctccaccgccggcggacatgcacccgatccccgagacgccgaaccagcctctgtactcgtctccaccgccggcggacacgcacccgatccccgagacgccggaccagcctctgtactcgtcgccaccgccaggggtcatgcacccgatccccgagtcaccggaccagcctctgcactcgccaccacctccagctcctccgaccccctttgccccgccccagacgccattgccacccgtcgacacgcccccgc

SEQ ID NO: 79010 - DNA, 575 bp, Triticum aestivum
  Clone ID: PAT_TA_79010
ggtcgacccacgcgtccgctccgccgtaccaatcaccccttctccttcccgaggctgccgccaaccactcctcccttgaccctgccggaattgcgctctgctgcagctgctctctccacgcatcgccggacctccccaaccaccagcgccgttctctcgtttctctcctttgccccgtcacccagagaaggagagagaggagcgagaccctgtcatcgagccactgcctagcgccgtccctccctctcgcggcctcgttgtggtcccgcgcgccgcccggagaccctgctgcttgccggtgagccgtgcaccgccgcctcctccgccgttttgcctcaccgccatggacgccgtggagcttcctcacttcggagccccaagcgccaagttcgccagagtaccaccaggctgctgcttccttgcctcgctaacctcccgcgccgccattttcagcctcgcgcttgctcccttcacctcctcgacgtggctctgcctccgctagcagcccctgctgcgtgtctactccttgggctggaaccgccgaagacgccgggcgttccggcccatgcacatcg

SEQ ID NO: 79011 - DNA, 583 bp, Triticum aestivum
  Clone ID: PAT_TA_79011
ggaacagagatttcatttttggcatttcaacggttagtgtccatcctgtcccagataggattcattttaacactgcctcttgaaagagatgcgctgtcatcgactttgcatatgtttttcagccaacagatgcagctggttcagcatattccggggcagatgacggctttatcgcacagcaacaaggggatgcttgggcatgtgcatcaaagatatgtgattctttgagcttgtcacatcaggttgatgacagatgtttggcgccatatatgacattttgcatctcaaggggaacaatgcaaggaggccgcatcaattttttgagtctgtcgatgaatgaataagagtgcaaagccgagtaacgacaggatgcttgttttgggcgcaagcgttgtatgataatgatttgggttggctatgaagactgatttcttctgtcgtcaacccatgtaacgaacttaatgtcaggtacaactgcggttctcggacataaccaatatcgtatttgttggtagggatatcaagttatgaatgaacggttgtagatttacaagttgaaaaaaaaaaaaaaaaaaaaaaaaaa

SEQ ID NO: 79012 - DNA, 612 bp, Triticum aestivum
  Clone ID: PAT_TA_79012
gacccacgcgtccgagcagggaaggcacagcaacaagataagaaaggatcttcagtggatttgttctggtggatgccaaccgcaggaactagagctcagggtatctacaaactaagagcattgagaagagaaactctgttctggatcaatctcctgtacagaagttccactccgctctcaagatcttcgatactgcactccaatgcccgcaattgctcctcttcgcacagaactttgctcttctgcaatgttttggagacaagagaccacttgggcatctcaatttgcttcaacaagatgcaggatgtggattcgagaagtgaaatgacggatgtatgccttgacttggcaagttgtgtcctctcctctcttgagaaccaacaagagctcttggacagtcatcttcagctccatcaaggtctcctgcatggcgttgcagaggtcgagcacgacgagggaccgccctagctctgcctccactgccaccctttgcagggtcctgcagaggctgacttggttgctgggtgcgcacatcatctcctcaatgcagctgtatatgtctgccagcttcctcaaaccttcgcaagtcgtatcgatggtcgccaagggcga

SEQ ID NO: 79013 - DNA, 590 bp, Triticum aestivum
  Clone ID: PAT_TA_79013
tcgacccacgcgtccgcatgtctgaatccttgaaattcgttgcttactatggtcctggcagtgtccgaacaaacgagaaggggtttgatctgagtgaatttaaatgcgtggacctcatgttatcggaaccagaaaaaatgaacattagtcagttgaaacactggttgacaacacatctttctcttgatcccaacgtgtgcactgtcagtgttgaggcggtgtggacgaaatcctgtaaaacgttttatgggacctgaggcgggtagatagaacgcatgagtggctgtcctggttagcatcgtgcaagcgtcggaggactcaccccgtcgctttagtgctccctgagccaaaggagaatgctttgttagaaggcagcggtgggcatgagcccgtccatggcagtcatccggttgatagagataagcaatctggccacatgcacaatctgacagaagaaggggattatggaagggctggagatattgatccagacaatagcgatgaagatagcggcgacgaggcgcagtcagacctcgcgtactcagttgttagcaccaggcagcatgcagcccacatggcgttggaggctc

SEQ ID NO: 79014 - DNA, 701 bp, Triticum aestivum
  Clone ID: PAT_TA_79014
tcgacccacgcgtccggaatcttccccttcagatatagagtttcatggtacaagtgaatttggtttgatgattttggtatgtcggaagctatccaagtacgtaatgtaccttttcattcaccacccttccatgctgccgctctctatcagcccagcacctaccctggctcaggctcacgaagtatatgatgatttcaccaaggatagtgttgagttggaggtaagcaaggaaacagtggaggaggtagcacgcatgtggacgcggctacttgtttacgctgctggcaagtccaaggcggcgctgcatgttgcgctgctgagcagaggaggagagctcatcacattcgcatggctaatcatggcccactgcgggtttggggatactcgcgttagaagacttcaacttaccaatattgatgcccacatagtgagagaattagattttacaccgcgacacctcttcaatcttcccatggaagatcagatatcggactctgctaatcggtcaaaattggatgatgagaacgcgaatgggatgacgactaagtcagatcgcttcgtggttggtagccgtagctttccatgaggagtttctatggagctctcctggtattctgcatttgttgctcgatcagtcaatgatgctcttcatgaagcacacactatatacttatgcaaacattgtatttttcttgctttgg

SEQ ID NO: 79015 - DNA, 766 bp, Triticum aestivum
  Clone ID: PAT_TA_79015
tcgacccacgcgtccggctaatgtgtgctctgggaaagaatccttgtcaaaaggtgcaataacatgctcagcatattcaagaaatgcaaataatcaaccaacacggaaggttgattgctcgtctgctggaagtggagatactacaccgtcatcaagttcagaaaagaatggcgcttccagaaatggcgtgctaaatgcatatagcgttgcatcacacgtagaagaaacgggcattatcaacagtactggacctaataaggattcccactctcttagagctatttgctcctcaaccactgagcatggtgaggattcctgttctcacgaagccactggctcctcaatgaaccctattgctgtgattagattgtcatcttcttgcatttcttctcaagtgtgcacccttaatgatctcaattgtcaaagcaagtcagacagtagtgcttgtttagcaattgacttgaaaaattctcttgctggagagaaaatggtcgcagtttctttgtcagaagacaacagttgcactccaggtcctgacttcttgcgagagtttgattcccgcaatcaacagaacactgaatgttccactctaaggaaatcagtagagtctacaacatctgcagatcaggtgccacaatttggtaatccacttgatacagaaccagcttcatctgacagcacaacagatttgcatggttctttgtgtaatgaagcggaacttaattcagcagaagaacaaatactgatggtggagcggagtttgact

SEQ ID NO: 79016 - DNA, 356 bp, Triticum aestivum
  Clone ID: PAT_TA_79016
ctccgtccaccggtatccagtggaaaaatcctcatcgccatagatctctacatcctcgggcctctcccgtccaccgccgccgccgccgccctgcacccatggacgtcgtgggcgcagcgtcatggcttgtccaggtcgtgctggagaagctcgtcagcgatggcatggacgccgcctgggccgcggcgcgcgtggccgaccccaaccccgaccccggaggcgacatccaccggctccgctcccgcctgcaaggcctccacctcgtcctctccgcagcccaggagcgcgtgcccagggcgcgcagcgaggccctgctcggctccctgcgccgcctccacgggcttgccagcgacgcc

SEQ ID NO: 79017 - DNA, 534 bp, Triticum aestivum
  Clone ID: PAT_TA_79017
cccacgcgtccgtggtgtgataacccacttggaattccctaccattgctctggctttggggagtctcagagattccaaaaggtcttgcaaggtcaagaagttttccgtccgtaccgaggaagtctggttgatgcacgcatgagaaatggcggctttcaacaacaagatggtccttatgcatctgctctgttggataaatggcgcgctcaacaacagcatgcgttcggtttcgggccaccagcaccagttctaccgtctcagccatcgttatcaccaccttctgtgctgatgtttcagcaggctgatccaaaggtctctcgattcgagtttgggcatgggcacttggataagaacgtggatgatccgtatgctaggtttgtctccgctgaaggcattggaaggggagagcaaatgttgtcgctccggcctcatcttggttcagaagtgatcgatagtggtgttgcagttgaaaacaagggtgttgcacctaccaacagttgcaagatatttggcatttctctggctgaaaaggtt

SEQ ID NO: 79018 - DNA, 641 bp, Triticum aestivum
  Clone ID: PAT_TA_79018
ggtcgacccacgcgtccgactcagaagatttgaaaagcacctttcacaaaaagccttccgttgataacgcaccagaacagaaggtgttgctactatgtggtccagctggccttgggaagacaacacttgctcacgtggcagccaaacattgtggttaccatgttgtggagataaatgccagtgatgatcgttctgcttcatccattgaaccaaaaattcttgatgtagttcagatgaactctatcatgtcagattccaaacctaagtgtctggtaattgatgaaattgatggagcacttggtgatggaaaaggggcagtggaggttattctaaagatgatcaatgctgataagaacaacgattcggacagaagcaatggagctgaagaaactcaagtccaaaaggcttcctcaaggaaaagtcatagaacagcaaaactactgaggcctgtaatttgtatatgcaatgacctgtatgctccagccttgagaaaactacgccaagtagccaaggttcatatttttgtgcagccaacgattagtcgtgtggtgaacaggctcaagtacatatgcaagaaggaaggattcaagacaagttcaattgctctttctgcattagcggattatactgaatgtgacatt

SEQ ID NO: 79019 - DNA, 614 bp, Triticum aestivum
  Clone ID: PAT_TA_79019
gtcgacccacgcgtccgaatcagaatgctactaggacattcttaattttggaaaatcagatcaaacaggagatatgattggtacctggtgatacaattggagaaagggatatgatatgtctggcaatggtttaggaaggtattcacttatccgaaacaaaagcataggtatgttcaagcaaggaactgagcatggcagttaggtggtggagtgtgtgtccttgaattgtacatatttttttctctgaaagaaattcactgcgtagatcattgtagctattctcgatgtttttatctgttccaatccaaatttgatatgccagttgcttgaaattcttgagacactttgccctttggagtagcggcttacagttataaagatacatatcttctgaatttgtatttagcctatggattatagtgcatttatcttgccatttttatttagcctatgtgcattcgttttagtcccagcttccatgttatgatgtgcttgcttcaaaagaattgtgtgaatttatgtcaccaaatcaaagatagccagtgattttttgtgatacactttgatgtatactttccaaacacgcttgtcgtatttaagacttaatagtctac

SEQ ID NO: 79020 - DNA, 390 bp, Triticum aestivum
  Clone ID: PAT_TA_79020
gtcgacccacgcgtccgggcagtctgaatttctgaaaagaaaaaccattgacggccacaattgcttgcggttctggatccctagctcacgattgacgacggcggcgattagtcctttctccagttaacgttgcagctgccacgtgcaagctctttatcctgtgcctagaggaaatggtgccgcaccctatccaccactatgaggatggggagagcgaaggtgggcatggcgcttaacactgaccagatgaacaccctatggccgccaagggagagtagccttcccttccagcccgtcagtccagactttatgcaatcaataaagaattgcaagtgcaccattcggatacgcgatagcgtgatcggcgaacctaggtaggtcatgggtaat

SEQ ID NO: 79021 - DNA, 745 bp, Triticum aestivum
  Clone ID: PAT_TA_79021
gtcgaccccgcgtccgtgatgtaattgttgtcagcggagaaactggatgcgggaaaacaactcaggtgccacagtttattttggatgatatgattgagtctgagcttggtggtaattgcaacattgtttgcacacaacctaggaggatagcggccatttcggtagcagaaagagtgtctgatgaaaggtgtgaatcttcacctggctctaaagattccttggttggatatcaagttcgtctcgacagtgctcggaatgagagaacaaagcttctgttctgtacaactggtatccttctgagaaagttatctggaaacaaagacttaagtgatgttactcatgttgtagtagatgaagtacatgaacgcactattttgagcgacttcttactgattgttcttaagagtcttgttgaaaaacgctctaatcaaccaggaagaaagctgaaagtgattctcatgtctgcaactgttgattcaagcctattcgcacgatattttggagattgccctgtgattagtgttgaaggaagaacacacccagtttcaactcacttccttgaagatgtttatgagaaaatggagtactgtcttgctttggattctcctgcatcaggagcatacttcgcacagcatggagaaaagtggaagcatgctagtagctcagtgaataaccggagaggaatgaagaaccttgtcatgtcctcatggggggacgagttcatgctttctgaaattatgttaat

SEQ ID NO: 79022 - DNA, 654 bp, Triticum aestivum
  Clone ID: PAT_TA_79022
gacccacgcgtccgcagccgctccacaagcttctagaagccgccgcggactcctccactcctcttgccgccgcccgcctccacgcccacctccttcgctcgggccacctccactcctcccaccacctcacatctcatgtcctcgcgtcctaccctcccgccctcgctcgccacctgttcgatgaaatccccgtcccgaccccgcgccttgccaatgcgctcctccgcgcgcgcgtccgtgcgggccagtggcgcgacgtgctcctcctcctcccgcgcctccgcgtgcgcccggacgccttcacgctgtccctcctgctcaaatcctgcgccatgctcccctccctcgcccacggccgcgccgtgcacgcgctcgccgtccgatcctgcgccgcttacactgacgccttcgtggccgctgcgcttgtgcagatgtacgcgaagtgcggcgacatggttggctcaatcaacgccttcaatgcgttcgaggaaccagacatcgtcctccggacttccgtggtgactgggtacgaacagaacgggatggcacaggaggcactggagttctttgcaaggagtgtgattggccagggtttcatgccgagtccagtcactcttgtgagcgtgatctcggcagcggcacagttgaaaaatg

SEQ ID NO: 79023 - DNA, 649 bp, Triticum aestivum
  Clone ID: PAT_TA_79023
cgacccacgcgtccgcatctgtggattctttctcatctgattttcgttttattgcttcatttactcctttcctcctctgtatctgattgcttgggtgttttgttgttgttctgtactgtgtgtttgcaggtgagggcttcgttgctgacggattgcggtgctgtatctagtcctttcgagtatggtttgtccagtttgtcgttgccctggtgccgcatgccttccatttgtgccaaccgatgaagtactggaagttttttatgttgttcttgatgagtattgctttaggaggacgtatatcccatgcaatgtgaggggtttcttagccgattatattgcagagcacaggcatattgcaactacttacaagcacaagagaactgagcctgctatactcatttatgagagtaggtcctatgcttcagaatttaagcatcgaggcaactactcaaagttttgtggcagtgcttggtttgagttcagcaatgattatgcccttcgtgctgaagatcggttggtctttaccctggacaactcatgctttgacctaaaagtagagactttccgtgatggtgaaaggattcttcctttaccttctgttgcttttgaaaacctcagtaatgcaaggtatgaactagtttgctctgct

SEQ ID NO: 79024 - DNA, 189 bp, Triticum aestivum
  Clone ID: PAT_TA_79024
ggtcgacccacgcgtccgccttgataaggagccccctcatcaaggaggccgatctcaagtcctacgagtctgtcaaggcggacctgcagcaggcgcacgcggaggcgcagaacctggcggcggcaaggcagcatttattggcggatgcgcagaagctgaacaaagttcctcactagttctagatcgcga

SEQ ID NO: 79025 - DNA, 752 bp, Triticum aestivum
  Clone ID: PAT_TA_79025
ggtcgacccacgcgtccgcgtcttgcatggacaatccttccaaatttcaatatatgcattcatgtttctcttaacttctaacttctaaggcacgaagactggacattcctatggtgactctctgatttatggtcaaaaagttgttcacatttgtttttgatttctcccctaaatatctgaagacaaatgatttttatcattggctataccacataattcaaatagtccctaatcttgcccatgcattttttgtttaagtttgactttcgtatgagataatctggagaaatttatgttgtttccggtggcaaagtgcaacatgaactgttgttgcaagtccaccatattttctcaaattttagaagctattcattggcatgtattttattagttttattagtgcttccattactttctattaaaatatgcttaatgggctaaaggctgtaccttttcagaaagttgcagtgtgtggtatgtttgctgaacttgtgatggaagttcttcacgcaggaccttcgtccatatagattttaactttaaacattattatattttggacaaatgatgtgtttactgaattgtcattgtttttttgaagttataccattcgtaatattgcattgtagatagacaaaaagatataggtattaatttttgtggctctagcataaatgtttatcaccacggtgacatttcttgttcaatttagataaggaaaaaaacaagtattaaacagaaagtagagagga

SEQ ID NO: 79026 - DNA, 623 bp, Triticum aestivum
  Clone ID: PAT_TA_79026
ggtcgacccacgcgtccgcccacgcgtccggagagcttccactccacacccatccgatctgcttagatttacaaagcttaaaactgatacggaaacaaatcctttctcaatccggtttggcaatgctgcttcgggcgacgtgccagagtttctggatatattgcatgctgacgaggagttctacaacgagagtatcgaggagaatgaactcaaggagatgtatttcagtgtggtgaggcctgcacttattcccagatgtctgattttcccctatgaaattgggaataaacatgctccgggtctgcatgaggcctacaaaacgatcaccaaacgagaggagccactctacattagctctcgggatctcatgatcaccttgagctctatggcaaaccagcactgggttcatttactgaacttcatcagtgaccagcgtgatcttgtcattgaagattggtgtaactcgtacggaacattgttcggagctgggcgctacgatcatggcttcaactgcgcccccaccggtgaaatgtgctttaagggcgagtgtgatgcatcattgaggggtggaatggcaagaatctgttgtatcatttggagaggaaaccaaattgttgcttgcc

SEQ ID NO: 79027 - DNA, 701 bp, Triticum aestivum
  Clone ID: PAT_TA_79027
taccggtccggaatttccggtcgacccacgcgtccgggtctctggcaggcgagtgttctatagcaccaagaagaggaatgctgtctcatggacagcattaatgtctgggtatgcatccaatgggaggccagatcaggcgctgaggtgcatagtttggatgcagcaagaaggaatccgaccagatcttgttgcggttggtactgttctcccagtatgcacaaaattgcgagcattgagcgaggggaaggaaatccatgcatatgctttgaggaggtggttcctgccaaatgtctcattatgcacttcactcatcaccctgtacggtgcatgctgtcatttagaatactctcgcagggtgtttcatgctatggataagaaaactgtacgagcttggactgcattggttgatgcctacctaaagaacagagactcttcaactgctattgaagtgtttagatcaatgctgctgtcgaaccgtcggcctgatgctgttgccatcaccaggatactgagtgcctgctctgatattggagcattacaactcggcaaggaagttcatggtcaggtgttgaagttgcggatggaacctctcccgttagttgcggcagaacttgttaacatgtatggcaggtgtggggacctgaaggcagcacagagggtgttcaatcgaacagagtccaagggatccctgacgtgcactg

SEQ ID NO: 79028 - DNA, 248 bp, Triticum aestivum
  Clone ID: PAT_TA_79028
ggtcgacccacgcgtccgaactagttcgagctagtcgcacgagtccaacagtagaccaaatcatagtctaacagccccccgcactgtcaacgtgggcttgccggacgttgagactggatctagattcatcaaatagcgtggttggcagccctttggtgaaaatgtcagcatactgatgaagaagtgggaacatgcagaaccctaatctcaccaagcgaaaccttgacacgcaaaaaaaaaaaaaaaaa

SEQ ID NO: 79029 - DNA, 676 bp, Triticum aestivum
  Clone ID: PAT_TA_79029
ccacgcgtccggagtttggaggtgtttagcaagaaacaaatctcacccgcacagaccatcccctcccaactttccccacctcctgttgctagggttcgggaatggcgaggataccgacgctcgtcgcgtttgccgtccgccgcgcggccaccgccaccaccgccgcggggaaggccatctgggacgccaagggggttctcatcgtggggggcgccgcggtcgccgcctgggtctaccgtgccgatcttggtcgcctcgccgaccatctgttttcacagggccgcacccacactccagaggatagggatcagagggtgagggcaaagcgagcggccaacaaaggggcccggaaggtggtgcgggacgcgcacggactatactcaaagaaccacggccgggcgggcggacactgaatccagactacaagagtgggggagacataatggataaagggcgtaaatcaaatggtgataaaaaggcgttgtacaaatggtgaaaagttttaggtgaagacactagtggtttaatcaatttcctgttatattgctcaatctgtgacttgtgcggtcatctatttctgttgaatccatgacttgtgccgtcgtcatctgaaattttgaaataatgattgagtgatgccaacttcaaaaactagttctagatcgcgagcggccgc

SEQ ID NO: 79030 - DNA, 720 bp, Triticum aestivum
  Clone ID: PAT_TA_79030
ccacgcgtccgggatgacaagttgataatgagcggagtataaaaactgcagctggctctactttttccgatgtacactaaaattcatagcatcaactagtgtcgtgagccatgtgctactaaaaaatctaaacaaatatcacatagaagtgatatggtgcgtaattattatttttgaactggatatgtgcgtaaacttggtaaaaatgggataaaaatcatggagacatgcagcatgattattgcacataatattgcgagccaatcgccaaaccttgctgatctgtttggttctggtcctccctgtaaagtttggttgctatggggacgttgcagttgttcacctgtcatcctgctttgtgaagacttcaaccctgagccttaaatttgaaacacccacatgatatttgcatgaatctatgcatagcatcagtgattactccaaatgagttctgaacccctcatctgttcactatgtggtactacttcatttatcatttcctctctgatattaatagggaagactacataggagttctttcattttgtttgtagatggagtttgacaggagaagcatagaagccatttttgcaccatgtgtgtttattttatcagcatttactccctccgttccaatacaaagttgagtcatctattttggaacggagggagtagatatcacttggaacacttataaaatgtttttgatgttccaataca

SEQ ID NO: 79031 - DNA, 730 bp, Triticum aestivum
  Clone ID: PAT_TA_79031
ggtcgacccacgcgtccgaacagtatttattaatgctggaatatttattgtactaaatgtatattagcccgggcacaacatattatggaatgccaagttgttcatgggattggctccatgaattggaatgccaagttgttcatgggattggctccatgaattggtaaagcctgtgaattcgaattgtaattcaaattcagcgtgcaactcacacgtacgtgcttatgggacagtttacagatgaaactccttaatggttactaatgatcgtggttggttaagttaacctggagtctttgtttaaacagattttatctgaacatttatctgcaatttatacagtttgaaattaactggaatagcactatataaaggtccctaacccctagcctcaattgatcattgtgagcggaaccacggaaaaggatcaaggaataggggttagaccgtgtgcgtatatctggaactgcagcgccgcctcacgatcgcgcgggcagttcgtcttggtctgcgctgcctttttcccttccatccgagcacatcggtcacttcagactcctttctgtacgtctccacaaggtacaccatgttggttctgaatctgtttatagcttagtagtaaaaattgcagtttattgttgaaacagaacacatccgcaaatctaccgggccggcttacgacaggctccagccactcgccacgccataataagacgcccttgaactctcc

SEQ ID NO: 79032 - DNA, 661 bp, Triticum aestivum
  Clone ID: PAT_TA_79032
ccacgcgtccgagcgagccccagaaagtttccgatcgaatcgaagccaaggctttctcgtcctccgagatgcagatctttgtgaagaccctcaccggcaagaccatcacccttgaggtcgagtcctctgacacgatcgacaacgtcaaggcgaagatccaggacaaggagggcatccctccggaccagcagcgcctcatctttgctggcaagcagcttgaggacggtcgcaccctcgctgactacaacatccagaaggagtccaccctccacctggtgctccgcctgcgtggtggaatgcagatcttcgtcaagaccctcaccggcaagaccatcacgctcgaggttgagtcttcggacaccatagacaacgtcaaggcgaagatccaggacaaggagggcatccccccggaccagcagcgcctcatctttgctgggaagcagcttgaggacggccgcacccttgctgactacaacatccagaaggagtccaccctccacttggtgctccgcctgcgtggtgggatgcagatcttcgtcaagaccctcaccggcaagaccatcacgctcgaggtcgagtcttcggacaccatcgacaacgtgaaggcgaagatccaggacaaggagggcatccccccggaccagcagcgcctcatctttgc

SEQ ID NO: 79033 - DNA, 534 bp, Triticum aestivum
  Clone ID: PAT_TA_79033
gtcgacccacgcgtccgggcgcggagcatccacgagcttgcggtgacgtgccaccagaaaaaatcccagaggcagctcgtgaacagtgtgttccccaagctcgcggtgtacaattctgaggatccttcggtggctccatctcttctcatgctccatcagcaatgtgaggacagaaatgttctgcgctatgtgtactattatcttgcacgaattctgtcagataatggctcccagggtttaagtgctgctggtggaatccccacaccaaattgggatgctcttgcggacattgatgttgctggaggagtgactcgggcagatgttgtgcccagaatagttgatcagctttcagcagaatccaccagcgacgatgttgagtttcatgcgcggagacttgcggctctgaaggccctaacctcctcttccacaagcagttccgagatgttggagaagcttagtgagattgtgtttggcattttggaaaaggtcgcagatactaaacagaaacgaaagaaagggatatttaccaagcaa

SEQ ID NO: 79034 - DNA, 694 bp, Triticum aestivum
  Clone ID: PAT_TA_79034
ccacgcgtccgtggacatccaagagctagtcgtcccctccaaagtccgaactccatcccaaccacgcggttcctctcagatctagggtttccatacagagagagaaatgcggggagattaattggaggcgagagatgggtcagcagcccatccaccggccgaatgccgacgcagccgcgctccctcgtcgcgccgtcgtcttccttttctcccagtctggcgcgtcgcgccgcatcagcaacacctgcaagggagcttcgtggccgtccgtcgctcgagcgctggcagcggcgccggcttcctaatttgctcttgccggccgtctggccggcgactgcggcctctgctgcacttgtttgcagttccggaagaggccggcgaataaaaagcagctccttttcgagctgcgtacagaaatcgacccctttctgtattcatttcggacggagatcagctccatctctttctcggtcaacccccagcagaattaaggggatcgccttccaatttcgagtttgctctccaatttctgactcctaagttggaagcttgaaccaagccattatatatcccctccaagcggtcggcgccgaagccatcaggttcagtggagaccgagccacccgcgagtcatcaaaaaacacatccggcgacgaggacctccctcgctcctcctcttggtcatcggctgatc

SEQ ID NO: 79035 - DNA, 627 bp, Triticum aestivum
  Clone ID: PAT_TA_79035
accggtccggaattttcgggtcgacccacgcgtccgcgttgtcgtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgt

SEQ ID NO: 79036 - DNA, 400 bp, Triticum aestivum
  Clone ID: PAT_TA_79036
tcgacccacgcgtccgagctcacacgacaatattcatagataattcacaaaaagattcagatatacacatgttgagtatgtttatgcatccaaatgattgagatcacatggacaaactttaattacctaagctctgttcgtcgtcgtctgttagtcgtcctcttagcctgatgtgttcatcggtggaaatgtgcgtgctagtgtttgttcgtgtcgtggtcgatgtagtgtgtctgttctgatgtcaccatcttgctgtcatcagtaactgaaatgaaaatgttgctatctgttctaagatctgtgccatttgatgcttgtttttcattgtcaaaaaaaaaaaaaaaaaaaaaaaaaaaaaaaaaaaaaaaaaaaaaaaaaaaaaaaaaaaaaaaaaaaa

SEQ ID NO: 79037 - DNA, 620 bp, Triticum aestivum
  Clone ID: PAT_TA_79037
ggtcgacccacgcgtccgccctccaggaagagtgcctggtggtgtcacggtacatgtaagtgatgaggatggtgatgttgacattgagactccaacgtctttgcagtggtggcttgatatctatcctcatcttgctgaacacgagaaaccactggaatgcacacaattaccaggagagaccatatttgttcctagtggatggtggcattgtgttctaaaccttgagactactgtcgcagttacacaaaactttgtcaatcaatcaaattttgagcatgtatgtctagacatggcacctggtcactgtcacaaaggagtttgtcgtgctggcttacttgctgttccaggaaaatctattagagatattgaaaatcatccgcctggaacaatgagtgcatggaaccacaatgacatgactcgtgcagaaaaaagactgaaaggttcagggtccggaagagcttcaaacagtgcaaatcagtgtgcttcatttgagttctcagatgtccatgaaagtttggagaaccaagttttctcgtatgatataggtttcttatcccaatttcttgagaaggaaaaagatcactatacttctgtctggagtcctactaatccaattggcc

SEQ ID NO: 79038 - DNA, 633 bp, Triticum aestivum
  Clone ID: PAT_TA_79038
cggtccggattcctgggtcgacccacgcgtccgaaccgccgccacccagaaattcaagcacccctcccacgtctccctccatcggccaaccccatccagattccggaccgccatgtcgtcgtggtttcagactttcagtcctcctactacgacggggatgacgtcaagccggcggtgacgacgcattggcgccgtgactatggctatggctacggcgggggagctgccgcggaggacgtcaagccgcgtccgggtcctccgggagcaggagcaggagcaggccgaggtgtacatggacaggacgatcgggcggcgttctcttggccggcggccgaggagttcaagtcgacgctgcgcacgcaggagtccctcgccggcctccgcaccaggtacggcatcccggaggggttcggcctgtacctcgccggccccgcccaggcagcgtgcgcgccgccccctcccgccgctcgcggagcccgaggcggcgccgcggcggtgccgatctgcgtgcacacgcaggcgttcgtcgcgggcatgcgcctgccgctgcaccccttcttcagcgacgcgctcgcgcacttcggcatcgcgccgtcgcagctcgcgcccaacgggtggcgcgtcctggccggc

SEQ ID NO: 79039 - DNA, 749 bp, Triticum aestivum
  Clone ID: PAT_TA_79039
gtcgacccacgcgtccgcctttttttcgcccgagcaaattgacggtcaccgccgccgcacctctcgccgctggccactgccgttgacgccaacctcccccaagtctctgatgtctccaccgatagcgccgcttccgaccaatcctacgaggccagagcgccacctccgggcttctcccatccctgatctggagaaccaacctcttctcctccctccaccccgatctggcagcaacaccgggagatcggcgcggcgcggcgctggcgaggggaggccctgcagatgagacgatggtggaggtaagtaaagtcgatggagcttgggcgcggggtggccaaggatgccgtcgcttgtgctccaatccacttgccatctgtagctcgtactagaattggttccgtgcgccaaaaaatcccgttgcaaaaaggagatccgcatgcgatgctggacatgttatgctactccatttgatccaagctacttcagccgtgattgattttggtggcggactgggaggagacaaacaaggatggcaaaaacattaagatgaaataggaaaaacaaagttgttaggaaaacagaagcgcaacaaacaaaaacattgatcttggaccagctgagtgatcaaggtagtgtgatttacagttgataattcttttacccaaagcaccgacatgatcgagacactggttgtcctggttgccatataacatgtgcattatagttagtccagttgggctacacggctg

SEQ ID NO: 79040 - DNA, 693 bp, Triticum aestivum
  Clone ID: PAT_TA_79040
taccggtccggaatcctgggtcgacccacgcgtccggttgcagagctacaagaacttacttcactatgtggtggacttccgaaagttatagttgagatagccggctcattcgccaaaaatacagatcgatggaaacatacactttgtaccaaaaataagtttatgctagagctcgagaacaacggagagtttgacagtctaaagggtctgtttggttggatgaattcatacttccgcaaatgcccagattctctcaagccatgtatcttatatctaccaattttccctcgaaaccaccacattcggcggaggcgactagtaaggcggtggattgctgagggttactccagggacagccatgaagaatctgcagagatgactggggagaaacaattctgtgacctcattaatctgagtataatccagcaggcatctgcgttgggtttgggtggcacaaggatggtcttttgccaagtcaatggcttctttcgtgagtatattgtctcgcgccaaatggaagagaaccttgtgtttgaacttaggggcagttgtgccttaaccacccaacgcacagggcgtcaccttgtgatattagagagctgggtcagagatagaattgtgttcgagagcattgacttctcacgcctccgttcactcacggtgtttggaaactggaaatcattcttcgtttct

SEQ ID NO: 79041 - DNA, 526 bp, Triticum aestivum
  Clone ID: PAT_TA_79041
gtcgacccacgcgtccgcattaccctttcttgctaaggtacatatgttgatttctgttgtgtaccacgtgtttgctgtaatgcctagaggagattatgaagtgattttctctaccaattaaacaaataagcattccatacttagattttgaagaacgtttgtttatgcagggatttgctaggaaaaaccatctccggaaaaatagggccaaatttgaattctaatagagttgaagagacatagagaaagagacagggataatacttccttgtgggcttcctgagaatctacaatgaagaataagaagggtgtagtaactaagtatgcatgtcataactaattctattgaaaatagttattcaggaaaattaagctatattgaaatgttgcatgattcagatattgggtctatgaagatttgtttatgccataaaaatgcataaataaagtctcgtgtggctatgtaattcacttgttatatgtcaagttcgagctcctaagaacagggtgaaactgtttgttccga

SEQ ID NO: 79042 - DNA, 734 bp, Triticum aestivum
  Clone ID: PAT_TA_79042
ccacgcgtccggtggttagatgtagaagctgtttcactctggaaccatcagcacaccgcactactacgatctaggccttggtggccttcttgggggacttggtggccttcttgggcgacttggcggcggtcttctcggccttctcagcggtcttcttggggagcagcaccgggttgatgttggcaggtaccggcccagtgtactcggggaattcatctgcaacaagaccgtcgccgatgagctccaccggatggtgaccgaacgccaatgcaaccatttcatatttgaaggggcgcaggccgtcgggaagagaagcatggtgctggcccttttaagagatgcttttggtcctgatgatctcaagatagaggaaatcacaaagagaatcgagctgaagggagaaatcgccaaacacattgatgttaaagtgaagatttcagatcatcacgtggaggtaaacttggctgatttacatggctatgagaagtatgtcataactactttgttgaatgagtcaatcccaccaccggacttgatttgcgatcatgctaactgcaaagcattatattggttggtttttgggaaggtatgcaggttgcaacaaagttattttcagctgctccagttcttcaaaccttgatgccgttgaacatctatgcaaggttgtccgacttaaaccaccttcatttgatgaggtacatactagataatcaaggttctagagttcattgcta

SEQ ID NO: 79043 - DNA, 629 bp, Triticum aestivum
  Clone ID: PAT_TA_79043
gtcgacccacgcgtccgcgttccgatcccctcccacctccgactcctcgtgagaatcctccccggcgaagccaagcggagcggagatccctaggccggcgccatggatacggagcccttcgacgaggcggacctcctcgccctcccggcctcccccgtcgcctcccctccccgccgcctcaagcgcctcaagaaatccttccagaccgccgctgccgccgtctccccccataaatctccgccgccgcagccgccggcggaggaggaaaccctggccccgcacctcgggtctccccctcctcctccgaaccactccccaccgccttcagaggaggaggccgtggccccgcgcctaggatctcctcctcccccgacgacgaacccctctcccccgccgcctccgccggcgccagacgcggaggcggtggccccggcgccgtcctcgcctcccgtccccgtctcctcgccgctaccgccggccgacaccgccgaggacgacgatgaggagggggatgacgggctcgacccgctcttctcggagtccgccgggggcgggggttgggacccgctgggtctgccgacgggagaggacgacgacgaggaggaggagatgctggcgggaggagggct

SEQ ID NO: 79044 - DNA, 572 bp, Triticum aestivum
  Clone ID: PAT_TA_79044
tcgaccccgcgtccgcgcatctcctttcccctcgatccccactcctcttctcttccacctcgagccaggggaggagcccccgcgcccgtttccccagcgccaccggcgacgaccaagcctcccccggcgtgccccttctcctcctccgcctgagccaggagctgccactattctccccgagctcctccctcctctcgctcgagcccgcacgaaggagcccctgcgtcggcctctcttttccccgcgaccagctccacgcccgatgccctgccgccatgccctgctggctccggcgaggcactgcctcccctccgccctgtgtgcctcctcatcgtcgccttgccgcgcgccccttgagcgccccgagttcgccttcctccccgatggcacctgaggccccatgtcgccatggttgctgcctggtgttgtgtcgtgctgccgccgtcaagtaccgtctccggccatggcgcccacgtcggtgaccacgtgcaggccgctgctccgagtcgtctctgtcttcctctcgccctcgagctcctgctcatcactaccgtcttcggctgctcatgccg

SEQ ID NO: 79045 - DNA, 638 bp, Triticum aestivum
  Clone ID: PAT_TA_79045
cacgcgtccgtgaaaccccgcgcgcgcgcgcacacgcacgtacggtagataaaaagcaggtagcgccgccgtcacgtcgtgctcgtcatgggcgtcgacgccgcgctgcatggggcggcggcggaggcggcgctgcatggggcgctctcgctgcagccgcacgtggccggcgccttcttcgcgctcgcggcgtgcaccgtggcgctcgccgccctgctggccgtggcgcgcacgcgcccgccgtggtggtgcgactgcgccgtctgcgaggcctacctcacggcgtcctgggccggcgagttcgacaacctctgcgactggtatgcgcacctgctgcgccgctcgccgtcgcagaccgtgcacgtccacgtgctccgcaacgtgctcaccgccaaccccgtcaccgtcgatcacatgctgcgcgcgcgcttcgataactaccccaagggcaagcccttctccgccatcctcgccgacctgctcggccgcgggatcttcaacgtcgacggggacgcgtggctgttccagcggaagctcgccgcggctgagctggcctccccggcgctcagggctttcgcctccggcgtcgtggcctccgagctgcggggccgtctcgttcccctgcttgactctgcatg

SEQ ID NO: 79046 - DNA, 721 bp, Triticum aestivum
  Clone ID: PAT_TA_79046
ggtcgacccacgcgtccgtctgacatcgacattgtctccaacgctagttgcaccactaactgccttgctcctcttgctaaggttatcaatgacaggtttggcattgttgagggtttgatgaccacagttcatgccatgactgcaacccagaagactgttgatggtccttccagcaaggactggagaggtggaagggctgccagcttcaacatcattccaagcagcactggtgccgcaaaggctgttggcaaggtgctcccagagcttaacggaaagttgactggaatggccttccgtgttcctactgttgatgtttctgttgttgatctgactgttagacttgcgaagccagcaacctatgatcagattaaggctgctatcaaggaggagtctgagggaaacctcaagggcattttgggttacgtggatgaggaccttgtttccactgacttccagggtgacaacaggtccagcatctttgatgccaaggccgggattgctctgaacgacaactttgtcaagcttgtctcctggtacgacaacgagtggggatacagcacccgtgtggtcgacctcatccgtcacatgcacagctccaagtaaatgagaggcatgaagttactggggagagtggtttgccccagaggagtgttcaaagcctttcttctgagaataaatttttgtatggaattatgtcagctaaaaaccttttattggatgt

SEQ ID NO: 79047 - DNA, 436 bp, Triticum aestivum
  Clone ID: PAT_TA_79047
taccggtccggaattcttcggtcgacccacgcgtccgcgtgttgaatcagatgaagcggcggcacgtgttccggcggctcggcgtgagggcgcgcgtcctggacacggcgcgcttcagcgggttttgccaggacagccgggacgcccggcaggtggccaccgtgcacgccaactgttgccggacgatgcgggccaagatcgctgacttttgggccatcctcagggccgctaggcggctcaacgggacgacacagctgaggtggccgccgcactcgcagtgcgctaaatcatggatatgagacgattcgttgagagaagtagaagtgcgtacatataatttcctaatcagatttgctatttcacgtctagatataaaaaggtaccatatatacatttctaaccatatgatttagtcaaaaaaaaaaaaaaaaaaaaa

SEQ ID NO: 79048 - DNA, 620 bp, Triticum aestivum
  Clone ID: PAT_TA_79048
cgacccacgcgtccggctgaagaaagctacagatgccgagtcaaagataaatggactgaccaacacaatgctaagttttcaagaaaagttgactaatatggaagctgaaaatcaacttctccggcagcaggctctgttgcattctcgcctgaaaacaatatctgagaacactcctcccaaatctaattcgactaatggcagcccacactatgaggaacagatgacacctcatggcactcctcgagcacccaaggattatgggaacttcgcacatccaagggcatccttttctgagaggcagcatgatactgtggatgcacttataaactgtgttactgaaaatattggctttagcgaaggaaagccagttgctgcaattaccatatacaaatgtcttgttcactggaagatctttgaaacagaaaaaacatctgtttttgataggcttattcaaatttttggttctgcgatgcagaatcatgatagcaatgaggatcttgcatactggctatcgaactcatcgactttattgattatactacaaaagagcctaaaagctgttggctcaaccggaaccactccacataaaagaccacagaatcagtcatcgttccttggga

SEQ ID NO: 79049 - DNA, 576 bp, Triticum aestivum
  Clone ID: PAT_TA_79049
gtcgacccacgcgtccgctgctgcatatatttccctatatttaatagtgtatgagatattggagtacaccaaaaggtagaaggtttgaggttccggctgtatcctatattaggattaaaagtttgtcttcccactaatgtctgcttctcttgtggacgccagtgtgtggtggcgtgcagtctgtgcaccatatgttggtgaatcgaagtctgattaggctagttactatcacattcattttggcacaacaaggatgaataattcaacgtttggtagcaaaggcagttgatagcaactcaaatacacaccacacgtgcaatatctccattgttgaccatgatcctggtgccgcaccgaggattcctgggtgcatccaagtgcggtggaacgccatggttgtgctttcgggtcacggaccacagttcagacctccctcccaatcgcatcatgtgtgccctcgcaatcacctggtgaggggagggtgatggatgagctgtggagcaattgcattgaggagtaggtggtgctcttatgaaatgtgcagacataggagattggaggcgagacacacttgac

SEQ ID NO: 79050 - DNA, 469 bp, Triticum aestivum
  Clone ID: PAT_TA_79050
tcgacccacgcgtccgaccgcctccccaaccaattcttcttcaaactcccgccacccccaacggccgcttccatggcctcgtcctcctcctcctcctccacctcctcctccatgcccgccaccgctgcctcctcctcgcggccccccgccgacgcggcctttcctgttctggggagtttgccaccgcgtcctcccaggggcgggagagcggcgccgccgcgtcctctgaggaggagcaaggaccgtcggcgaggagggaagacgcccagctacacgttcgacagggacaccgtcggcatgtcgcttggttcgctctacgggcgcgcggacgacaccgcagcggagacgactgcggccatggccgaggcggacgccgcagcggggacgacctcggcgactcctccgacctctgtcgttccggccacgacgaccatggcggggacgatctccgcgcgtccaccgacctgcg

SEQ ID NO: 79051 - DNA, 282 bp, Triticum aestivum
  Clone ID: PAT_TA_79051
aaaccacacccccgcgccccccgtggcctccctctcccccctcgtcacgcctccgcccccgcccccgccccgtcgccaaattacgcttggcccctcgcccgccgcggggatccctaccccggcgccatggtcgacaccaggcgcagctccgcggggaagcgccgggcctcgtcggaggaggcctcgcccccgacgcccccgcccgcggcggccccggactcgggcgacgcggcgggggcatcagcgtcagcgcccggtgcggaggccgcctccccatcgccg

SEQ ID NO: 79052 - DNA, 751 bp, Triticum aestivum
  Clone ID: PAT_TA_79052
tcgacccacgcgtccgattttgagggaaggtgatccagtggatgagatgcaatttattctccatggttccttggagagtatgactactgatggaggccgaagtggattcttcaacaaggtccagctaaaggagggttctttctgtggcgacgagctgctcacttgggcattggatcccaagtctggtgctaacttcccggtttcgtccaggacagtaaaggctcttagcgaggtcgaggcattctccctgcgtgccgacgagctgaaatttgtggccagtcagttcaggaggctgcacagcaggcaagttcagcacacattccggttttactcgcagcagtggaggacatggggagcctgcttcatccaggcggcctggcgccgctactacaagcggaaaatggccgagcagcgccggagggaagaggaggctgcgaaccggcagagcagcagcagcggcccgagcctgggagcgaccatctacgcgtcccggttcgcggccaacgctctccggggagtccaccggcttcggagcaaggctgctgctctccccattgtgagagtgccgaagccctccgagccagattttggcgtcgacgtcgacgacgcggactaacaaaaacagaccatactgggaattacctgtgctaattaattaagctgatacttcaggcatgtagattgtgtacaaaattcaaaagacagcagcggcacacaacattgtgatgatgattgtaaaagttttactgct

SEQ ID NO: 79053 - DNA, 658 bp, Triticum aestivum
  Clone ID: PAT_TA_79053
tcgacccacgcgtccgagggatcctcctagcgccgccgcaactcctcctgtctcctcctcgtgttccccatcgagccaatcaccttcggcccttgttttcagatccactccacccaccgccacctcccactcgatttggaccgccagatcgcggatccgacggcccaggaggctcccccaacgccccagcgctcgtccctgcctcccggctgcggctccctcgcccccgctcgatctggccgctgagatcccgagcgcctcgaccccaagctccaccacccgccggtggcctcgatggtacagcagcagctgccgctagaccggactccctcctcgcgctacctccttatttctcttctttccctgtctcatctgtcgctctctgttgcactgcatgctcgaacaggaggccgtggagtcgccgtcttcaagccatcgactggccaaaacttccaacgccggtgaagaccttctccagtcctcgaaccgcacggggtttccgcatcgcatgcacttgccgcccgtcgccgtcaaatgccagcgccgccgtgcttctgtcgtccgcgtcggcaagtccagcgcccagccgcgccgacctcctgtagctcgtcccagcgctggacctgaagcccgcgattcccgtcggacctcgcctcgc

SEQ ID NO: 79054 - DNA, 518 bp, Triticum aestivum
  Clone ID: PAT_TA_79054
gtcgacccacgcgtccgggcgagttcatcgaagcacttgccgagtatccaaacttccgaagttgaaagagatatagctcggccactgaatccgctgctggacgtgagcggacgccgacgagaagctgcacgagtgtaccccatttgtcttctttacctttgcagttccggcggtcgtcgttgtcgtcgtggctgtctatttgggatcatccattgctgcaaagtgtgagtggaggaagagagagtatttgggatcattcattgctgcaaagtgtgagtggaggaagagggaggcgagccatcggattgcaatggacggtggattacatcagctacagtaccggtacagttagtacttaactgtagaggatccgaacccaggtactcctactagtatatacgtggccctggctcataatcagattcgagccatcggaaatgacattgtccggttcgtccatgccgattactaggaaaaaaaaaaaaaaaaaaaaaaaaaaaaaaaaaaaaaaaaaaaaa

SEQ ID NO: 79055 - DNA, 693 bp, Triticum aestivum
  Clone ID: PAT_TA_79055
tcgacccacgcgtccggttctcaagcttacttctccatatgattggaactgggaaacatcattgttgcttggtggtctgcttagtgccactgatcctgtggccgtggttgcagttctaaaagagcttggaacaagtaaaaagctcagtacgattattgagggagaatccttgatgaacgatggggtttctgttgttgtctatcagttattcttacaaatggtgctcggaagaagcttcaatacagggtctatattgatgttcttatcggaagtttcacttggagcgtatgtagaatgatttttcaatcaatgccaaatatgcctaccatgcttctaatactaactggtgcaagatgcactgaagtactctggtattttgaccgtcacagctttgggaatgttctatgcagcttttgcaaaaactacttttaagggcgacaatcgccgaagtttgcatgatttctgggaaatagttgcttacattgcgaacacacttattttcatactgagtggggttattattgcagatggcgtgctaagacataatgtccattttgagaggcacggtaatatcttcacttatctttgtctactgtttgttttcatgcaaaactgcaaaacaagcatgtctacttcattttaatttctccttgttcattgccaactgaacctttctttcgtttattataaagc

SEQ ID NO: 79056 - DNA, 193 bp, Triticum aestivum
  Clone ID: PAT_TA_79056
tcgacccacgcgtccggtcgacggtggcatgcggcagtagcagctacaactacctcggcgcgctgctgggactgatgatcccgtgcaaggcggcggtggcgcccttcagcccggcgccgcccacggacgactgctgctgggcggtgcgcgagctggggcagccctgcctctgcctgctccttgccggcccgcc

SEQ ID NO: 79057 - DNA, 769 bp, Triticum aestivum
  Clone ID: PAT_TA_79057
tcgacccacgcgtccgacgactatttgaaagagtataagcaaataattatatttagtacaaatgcgataggggacatgtgtttgaacttcctctggttttgagagagtttagccactccatatatttcctctctggcaagtcattttgcctatgatatattgtatccctttctttctaacctgaaagttagcatgtcaattttaaattaattagagctcatttcttcgcatggttcactgatccatacttaaaaaatgaacttccatttagttcataatgtgttcttggcttcttgataactggaaataagtgtcctatgtttctgcgtttaatgcagtttcccaatcgtagattttactgatgaaataaatacgtcgaaaggggattggacatgttactgactaaggagatagcgctaaacttttgtattgattatgttgctattttcatacttcagtcaagttcttgccttatgtgatgggcaggttagtttacacttcctgaatgcctccgtattctgttatggcactattaaaacttctatcccatagggcacacaacattcagagggaaatttgtctgttcttaataccttgcttgtccatacgactattggcttttgttgcctgtgtagtatttttttaagtgtttgtaaatcatatatattctgtagattgtatattttttaatattaaggaacccaatttttgcgtctccaattgtaaaactgactctctctctggaattaggagattaactcattatatg

SEQ ID NO: 79058 - DNA, 738 bp, Triticum aestivum
  Clone ID: PAT_TA_79058
ccggtccggaattcttgggtcgacccacgcgtccgcccacgcgtccgagcaaggcgagtctggttcaacagatattaaagtctcgggtcgggagaagttattacgtgatcagcctgaacttctccagcaatttggcatggacatattacctaccatgacacaggtgtatggctccagtgtaaatggaccaatacgtcataaatgcttatctgtcattgctaaattaatgtattacagctcagcggaaatgatcgaaattctccatggcacaacaaacatatccagcttcttagctggcatcttagcttggaaagatccacatgtgttggttcccgctctccagatagctgaaattctgatggaaaagctccctgggacattttcgaagatgtttgtgagggaaggtgttgttcatgctgtagaatcgcttatatgccaggaaatctcaagtccaatgctttttcaagtaccacagcaggacaaggatattgattctggtacatgtacatcttcacgttcaagacgcagccgccggcgcagcagtgctgggaatactgataataattccttggatgaaccaaagggttcccatactactattgccaattcaccaccaagcacgctagaaggtccaaatactagaattcgtgcttcagttagtgatcgtgcgaagtcattcaaagataagtacttcccctctgaacccggctcaagtgatattgcagttactgatgacct

SEQ ID NO: 79059 - DNA, 322 bp, Triticum aestivum
  Clone ID: PAT_TA_79059
tcgacccacgcgtccgcggacgcgtgggggcgcctgttatccatccaccacgcatagccttctccttccgggcctcgccgtcttctctcttccccaccgccctcgcctcaaaaaccccgccccctaaaaaccctagccctcgaattcgccacccccggccggcccgcccggagcgcacgggcccctcctccccccgcgcatggcgtcctcgacggctgccaacctctgggtgctgctcggcctcggcatcgccggcgtccttctggcggcgaagcggctcaagcgccccgcccgcccggaacacggcgccttcgtgtcgctc

SEQ ID NO: 79060 - DNA, 726 bp, Triticum aestivum
  Clone ID: PAT_TA_79060
cacgcgtccgcccacgcgtccggagaggtcgagcggcggaggagggggaggcgattccttgtgttcatggtgatttcgagctcatccacggcaggatactgacttcttcctcttgtttctcgtcgtccgcggctgctctgctactaactcaatgggcagactacggaaagcctgtcccaaggatgtccgcttgtttcttcagtcgagagtgctgattcttcaaaagaacctttcgtgcctaacgattttgctgatgataatgctatgtctttggattcttctggtgatgatgaagagcttggcaaagcactttacaatttctatgtgaaaaatgtcaagcacctgaagaggaaattgtcttctgttagtagaaggaatgttaggcagaaacgatcttctgattaccctgtttgttcgacgttcactcgatattctggaaagttcttctcaggagttgttgatggcatgtgttctaggtacaaggattcagaagtatggcatgggctgtctccttaattttgtccgggccgaggttcctcttaggctagttaagtggcttgcatctaggttcgacgttcctgcttctgagtttcagttgaaaaggaaattcatacccttaactaagtatgatatccatgacatccttgacctcccagtagatggtgagccacttgtttcagatcctgaggctggtcgtgattttatcctctctcatttcaatcttac

SEQ ID NO: 79061 - DNA, 738 bp, Triticum aestivum
  Clone ID: PAT_TA_79061
gtcgaccccgcgtccgaatggacaaggaaaatgtttcatcgcctgaaaatgataactgcaaggaagacacagatagtgatgatcaggacccactgaaggatcagaaagtaagttcttctgcgacaagggtagccactggagctgcatctggagacatgagccccttgccaaggagcccagacactgaggttgatagatctccttggttttcagcattgcggtatgagcagccaaaaagaccccgtgctgattttagaagtaatccagtaagagaaaatcatgttagaacagggcttgctgctcaatcctccccttcaactattgttcagtcttctcttatgaactttctatcactaaacaagaggaagcatgaagacagttgcaatcttattactgaagctccagtgctgagaaggggtacatgctcagggcaagtgagaagaacaagtttagaagcaaatgcacctggtatttcagatgccaactcacttcagcaaattagcctgtgggatcattctccacaaccttttgtacctaagaggacagaagtttcattacagcattctgaaccacctaatgttgggtctcctagtactgaagctccagtgctgagaagaggtacatgctcagggcaagtgagaagaacaagtttagaagcaaatgcacctggtatttcagatgccaactcacttcagcaaattagcctgtgggatcattctccacaaccttctgtaccta

SEQ ID NO: 79062 - DNA, 526 bp, Triticum aestivum
  unsure (1)..(526): unsure at all n locations
  Clone ID: PAT_TA_79062
ccggtccggattcccgggtcgacccacgcgtccggtcatgaagtagattgtcttacttatctcattatataagtttggtagcttcgtattttgttaatccatcatttcaaattcaaagtagcttctcaaatggaactttgtggctgctctaaagtattagttatgaagcaactaatcacacaacgttattccatgtgtagtattgtatagaaaacataacgttgaaaacaatcagtacaatttgagttgcttaacaacgcttcaaaagttgaagtagaaattcatagtacttcatttactattctcatacatatgtggctactagaaaattaacaagtactgcaaacataaaaagttaagaagcatcagcacacacttatgttggtcacttgtggattgcggacttagaatgacagtactagtacacttgaccggacaatacatacttactacaataaaaagtacaaagaagcatcagctcgtaatcccccccnnaaaaaaaaaaaaaaaaaaaaaaaaaaaaaaa

SEQ ID NO: 79063 - DNA, 749 bp, Triticum aestivum
  Clone ID: PAT_TA_79063
ggtcgacccacgcgtccggtgactttctaatgactgcagcccattttttcttcattgttctttggtcttttttgggagatttaacaagtttctgaaccattatgtaaaagaattggaatcactgacatattaaattcagccacaattgcatgaacgagtgagtgctgagtagcgaacccaatttttgccatttcagatatctagcaacgtaataataagaccactaaaactaataatggtactatctcttacaaattaatttacccttacaacggattgaggcaatagattaccgagcctgcatcatgatggcccttctttatgtcagttgtcttggaccagttaaaggtaaccgcatctttcttacaattttttggactattaatattttccctgtctgagccaaccaaaagatactttcatgcagctatttctaatttaatttaaaccaagatgactatcaccagtcccttttttagttttcatgcatttatcaaggaagctactttgttacttggaatgatagaataactacaatgtagatatgctgattttgtgtttgaatcagtctgttctgctgaatgcctcttttatttgccaagctccaatggcttaccaagatgtggcttttttcatggagagtagtgtttgcccaaaaactaccgtggaaccaattgtgcctcagccaccaaactttcccaagtatggatatacgacctacaatgtacacagtatcaaagccgcattaa

SEQ ID NO: 79064 - DNA, 181 bp, Triticum aestivum
  Clone ID: PAT_TA_79064
cgcgtccgatgctttcatactaatgtttgcatggataaaaggaaaggttgttttcttcggtcatagtgttgtgaaacaacagtagaagaggagaccttcacatatatacaataagcgatggtaaaccgctcttgactatatagacaacaataaaatctaaagattgtaaactacatcataa

SEQ ID NO: 79065 - DNA, 708 bp, Triticum aestivum
  Clone ID: PAT_TA_79065
cccgcgtccgcgaaagtgctcctggtgaatcttgtgcggtcaaacaagatcctgctagctgctccagagagagcttatttggtatagactatataaaatcagcgtatagagacaaaaaggaagcacataaaagcacgaggaagaagaaaagaccaactaggctaaaacaacatggtcaactccatcaagtttctcaagaaacatgcgccaatggactagcttcagatttaacaggtgactattcaccaatggattgttctccttatcaggcagcagttgaacaagcgccaagaaaggcatccgtgagttgtgatcagtccactgacatttgtgatagcagtgtcccaaatcagaataccacttgtgctgaagatgatctagtttctgcaactgagcacttggttattgatgcagatcttcaaacgtgtcaagatgaaggcagagatcccattgcggatgcatctgagagtaattttggtagcaacttttctagtttcgatggagaaataaatttctgtgatgcaccacagcccattttcactaatatgaatgttgatgcaaatggtgaacctaaaatgtacacaacagaagcttgggttgatggttctggatgtaatgttagtgggccgacttgcgaagagaacaactccagaacaccacatgagtctggtgaacctgttaattataaatcaagctcggcaaatttga

SEQ ID NO: 79066 - DNA, 709 bp, Triticum aestivum
  Clone ID: PAT_TA_79066
gtcgacccacgcgtccgccagtgtaaagatcaagaagatttgggtgttcgtgcgccaaccggaaaatctctcgtgtccatcttcttcttcctccggttttgagtgagaggagaggtagccaggccctagcggcaacaacaattggtattcagagccaagttcgaggggcggccacggcgcgcggcagcgtccgcggagcgcgcaacggacatggaggctgcagcgcgtggagagcgtgtgtcgattgcgacgggcgacgagtccgcggtggtgcggcgcgatgccgtgcgcgcgacgagcagcggcggtcgcggaggcgaggaggtcacggagtacctgcgtggttgcgcagaggccgcggcagctcggcgcgacggcacggagacacggcacgacggcgcacagagctgcgggtttcggcagcaacagcgagtggcactcgacggggcgcagcgcggcggtagctgcatcggcggcggtgcacgacagcggccggcgaggtggccttgttgcacggcatctgcggcggctcgtgctgaaagcacacggtggcatcgggcggcagcaaccatggcgacgagcttgtcgcttcgggcgcgtgtatgggcgcccgccgagtgcgctgggcgcgtcgggtccacggtggatcgtgcgtgtggtgtgcacgggcgtgtccgtgcacgagtgcagcttgtgtgcgttctgttga

SEQ ID NO: 79067 - DNA, 430 bp, Triticum aestivum
  Clone ID: PAT_TA_79067
tcgacccacgcgtccgccgccgcccgaggccgaggccgccgcgccgccggcgaggaggacgcgcccgccgcgcgcgtgcagccgccccctggcgccgcccgcgccctaccccacgcccccgccgcggcggccgggcccgggccgcccgaggaagatcgtggaggaggagcccgaggaggcggagccggacgcgccgcaatgccgcgtcgtgacgccgctcgtcgcggagcccgcggaccccggcgagctgccgcggtggaggctgcggggcatgtgggagctcgcctgcgtcctcaacttcctccaggtgttccggccattgctgaacatcgcggtggagttcacggcggaggagctggaggacgccctcatagtgcccaatggcacgttggaaggcttgcatgtgccgctattaaggtcgattcccccc

SEQ ID NO: 79068 - DNA, 756 bp, Triticum aestivum
  Clone ID: PAT_TA_79068
ccggtccggaatcccgggtcgaccacgcgtccggctaaatgtgttgcacaattgctcttccctgaaaatgaagcaaaagcaactgagtacacgacaaggataatcaatggggcgaaatttgcatgcccagtccacaaatgtgatgtttgtaaatatggtgaaaacaaggaggttaaggagctgcaatttgctgtttgccgacggtgcccaaagtcatatcatcgaagatgtctgccaaggaaaatcgtctttgatgacgtaattgagaatggtgtgtgccttttccaaagggcatgggacggtcttctgccaaagaatcgcatcttaatatattgcctcaagcacaatattgatccaaaccttcgaactcctctaagagatcatattaagtttcctgatgatcctatcactaaaaaatcatccaatgtgaatggattgagaagggttaagatacgacgccttgatgactgcctccctgtcccatcatccagtagcaaaagacccctcggtacatcaacttgttcttcctccatcaattcgatagcgaaaaggaagaaagaacatctgcctggaggtacaaaacatcccagtatgcaaaaatcagtcatgtcagtgatccccattagcacattccctgaggttgacataaacacggcgacgaggatttatgactttgcacagaaagcatcatcaaatataactattgaggatgtacagaaacagctagttgtttcgtctacgtacacatcatttatg

SEQ ID NO: 79069 - DNA, 315 bp, Triticum aestivum
  Clone ID: PAT_TA_79069
gacccacgcgtccggcagggcagacgggcaggtaggagggattcggcttgcctgctttctctccatgctcccatttgtgctcccacttcatcctacggttgtctttttttctcttttctttctaatttaatcatcccctccctgattttaaggagatggaggactacaacctgaacttcgcaggacactagaaaagggaacaccgattgacagtcacctgacatttatagtcgatagatgcattttttttgtcacatatcactagaggtggcctttacattaggcgatatctgtacaacaatcatgtctaatgag

SEQ ID NO: 79070 - DNA, 587 bp, Triticum aestivum
  Clone ID: PAT_TA_79070
ccacgcgtccggagggagcgaaaggaggaggcgctcgagcggcggaggggacgaggcgattttagtctggttcatggcggtggcgagatccctctctcctcgagcttgagagttctccccgattcgttgggttgtcccgttgatgatgaagagtttgataaagcactttacaatttctatgtgaataataaagtcaagtacctgaagagaaaattatcatctgctggcagaaggaatgttgtaagtctttcttcctcttccgttaatcattgggtcatttgtatggtagctacactataatcctacaccttttttacaacgtaaatttacccatatctacattgtaatccgatgcccctttttttacacagtaatttgattgatagttactgtgtaatttgtatgttagttacattgtaacccttactcctctttttacagtgaaaattacctatatctacactgtaatccgatgacttttttttactcactaatttacgcatatcatgtgtaattttgtatggtagttaggctgtaatcctacccctttcttacagggtaaatttacccatatctacaatgtaatt

SEQ ID NO: 79071 - DNA, 509 bp, Triticum aestivum
  Clone ID: PAT_TA_79071
taccggtccggaattttgggtcgacccacgcgtccggcgggcgggcctcgtcccgcacatcaagcgcgagatcaccatcctccgccgcgtccgccaccccaacatcgtgcgcctcttcgaggtcatggccaccaagtccaagatctacttcgtcatggagttcgtccgcggcggcgagctcttcgcgcgcgtcgccaagggccgcctcaaggaggacaccgcgcgccgctacttccagcagctcatctccgccgtcggcttctgccacgcgcgcggcgtcttccaccgcgacctcaagcccgagaacctcctcgtcgacgagcgcggggacctcaaggtctccgacttcggcctctccgccgtcgccgaccagttccaccccgacggcctcctccacaccttctgcggcaccccctcctacgtcgcgccggagatgctcgcgcgccgcggatacgacggcgccaaggctgacatatggtcctgcggcgtcatcctcttcgtcctcatgg

SEQ ID NO: 79072 - DNA, 639 bp, Triticum aestivum
  Clone ID: PAT_TA_79072
accggtccggattcctgggtcgacccacgcgtccgaaggtctgaagctggagaagtgttccttcgaccgtgtaggtgctggttggtggtacgcgtgctctcggccgtgtgagggatcggtgttccgcggtggtttgatcacgatggcgaggtgctgcggcagcggcggtgtgacccaacagttgggcctaatctgttgacagagggtggaggtgcgtgacggttcggatgaaaatcctgctcgtcttcggtcggagctagcggcgacggtgctcgtgggtgtcgttttcctctttggaggcgtcgccgtggtgtgtcgacatctccctttcttgatcgggttgtggtcttcgggcgaaagcctttggtccgttgcaggaccggcgatggcggcggtgtggcgtcgttcctctgttgaaagtatcgcaagtgaagacttggcttgggtactgtttgtggttcttcggtgcttgccgctgttcgagctgaccttcatgggcgctatgcacgcagccaccggcgtatccaagacgatggctttcacgggtccggccgagtcctgctatccactcgccgtctcctctttggcatccaagggtgggtagtgcgttggcaaggagtttccggttagagttgttgc

SEQ ID NO: 79073 - DNA, 264 bp, Triticum aestivum
  Clone ID: PAT_TA_79073
cacgcgtccggggggagagggggggggggggtttggaaaacatgtttggcgtgtagattacatatggtatgtatgtatggttgttacaaagagagggagacttgttgaaagatgtgttgctatagtaagtaaatggagaggttatatgtatgtgtgtatgtgtaggctcctgcattctctttgtagcaattcgtgtgttgaagtaagcgtaggataggctgctgcttgttgatttgttttgtgattgataaaaaaaaaaaaaaa

SEQ ID NO: 79074 - DNA, 521 bp, Triticum aestivum
  Clone ID: PAT_TA_79074
cccgcgtccgaggtaggtatgggggcgggagagggcgggggccgccggcggcgtaatctcgatggggacgacagcgacgaggagtatgtcttggaggaggaggaggatgaggaggaggtccacgagctggagtacggccacggaggaagagacgccgcgtcctctagtgccggcgaggagggaggcggctcggacgcggagtacgaggtggacgacgaggacgaggaggaagagacgccgcgtccaaagcggccggtgaagaggaaggcgaatccggctcccgcgcggtctcgccggcgcaggtatgaagacgatgacgattactcggaggagctggaggaggatgaggagattggtgaagatctcgaccaggaagaggagccgcgacggcccaactgtgagacgaaatgtggtggccgcagccagaaagcgaaaatgcctcccgtggctcagcgatctaatcggccgaggcatggggaggaggaggacatggactttgatcctgacttggacgagggggg

SEQ ID NO: 79075 - DNA, 675 bp, Triticum aestivum
  Clone ID: PAT_TA_79075
ccacgcgtccgcgggatcatcattcattcacctcctccgcctctccgctttgctctgctcggctacagcacctcgccggcgccgaggcaaggttggttggcggcgggggcggcgtcggtctggccagcaggcgcccgggtccatggactccggcgaggcacctgatgagcggattcgcgaggaagggggtttccggaggagcgaccggagtgccagcgataccctgactcggcgtcacgcagatggagcaggctcagacgctaatgggcatgaccgcggcctcaccaagcgcgcgaaggacgaagtgccggactcaccggagccgccgccggccgtggggcctcgccgtgtccagagcagagaggagcagttcgtgtggccgtggatgggcgtgctggccaacgtgcccaccgagcggagaggcgggcggcagatcggggagagcgggaaccggctcaaggagcagctcgccgccttctgcccgcacaaggtcgtgcctctgtggagccacagaggccacaccgggaacgccatcgtcgagttcgggaaggactatgcctctctcggcaatggtctcaaatttgagagtcactttgaggcacagggccgtggcaaacttagctgggaggcgagcaggtgccgaggagcgccggagatgatgttcgggtgggttgc

SEQ ID NO: 79076 - DNA, 167 bp, Triticum aestivum
  Clone ID: PAT_TA_79076
cctccccctaccccaactcctaaaaccctagcctgccaccaccccgtcccctacccgtacccactaccgcttccctcagtcgctccccggccaccgctccaagccgagagccgagatggcttccgcctcgccgtcgtgggtcatcctgggcagcgtgccgcgggtgt

SEQ ID NO: 79077 - DNA, 201 bp, Triticum aestivum
  Clone ID: PAT_TA_79077
cgtccgggcgaaccatgtactcagggcgcgcttgtctcaaatgcgaggaaatttacaaacttagcccccgtttcaaatttctactacatcacagcaacattagtcggttggggataggacggtaatctcgcatacaccgaatatttgccgacgagagtttgttttggcgcccaccgcgtatgaatatgaatcggggaggga

SEQ ID NO: 79078 - DNA, 280 bp, Triticum aestivum
  Clone ID: PAT_TA_79078
tcgacccacgcgtccgggtggccaacgacgcctcttcccctggcggcagtgatggtgctgatcctccaagaggtctgattgtatttattttctttcgtgtacaaaagtctcagtgcattttcagtgcaaaatgtatatacagtccaaaaactagatcgtattccttgtacagagcatgcatgttttacttgctcataagaaatccatatgtattgataatcaagttcatttcttctggtgcaaaaaaacaaaaaaaaaataaaaaaaaaaaaaaaaaaaa

SEQ ID NO: 79079 - DNA, 336 bp, Triticum aestivum
  Clone ID: PAT_TA_79079
gcgtccgatcaatgacatttcctggatacacgggtagttaatgacatcatccaaaccacatttgaaatcaaattgagcgtcttgagaagccctattctccacttgcagcaaatccagttgaatagccacccagtcaccgttgttgttcttagggactccaaatttgattttctttaggaccactgcattcaaaacaaagaacttggcaaagccaacatcttgctcacagccttcgtaattcagtatcaccatttctttgagatgggtccccaggcattcgactgaatctagtgggccatacagagacacgtctttcacatccatctttgaattttt

SEQ ID NO: 79080 - DNA, 469 bp, Triticum aestivum
  Clone ID: PAT_TA_79080
gcgtccggtatttcttccactggttcggcagatgataaaaaactttccaagaagaatgagctaattgtttggctgaggttaacagcttgccagaggcaactatatgaagcttttctgaacagtgatcttgttcattcatcaatgcaaggatcaccattggctgcaatcacggtattgaagaaaatatgcgaccatccattgatattgaccaagagagctgctgagggcatcttggaaggcatggaaggcatgttggataacaaggatatgggtatggtagagaaaatggccatgaaccttgcagacatggctcatgatgaccaagcgctgcaagtcggcgaggaggtctcatgcaaattaattttcatcatgtccttgttgcggaaacttcttgaagagggacaccatgtccttatcttttcccaaacacgcaaaatgctaaaccttattcaggaagctatattactgg

SEQ ID NO: 79081 - DNA, 242 bp, Triticum aestivum
  Clone ID: PAT_TA_79081
cgacccacgcgtccggcacgatgatgactcagctccaagccacgccgctcagaaccctagccctctcccgccggcggggcgccggcgcggcggcgcggccgatggcgggctccgtgcggtgctccgccgcggccaggagttacagcattacgctcctccccggcgacggcatcggccccgaggtcgtcgccgtcgccaaggacgtcctctccgtcgccggctccaaggaaggcgtcgagctc

SEQ ID NO: 79082 - DNA, 206 bp, Triticum aestivum
  Clone ID: PAT_TA_79082
cgacccacgcgtccgatttgtagctgtcatgtcacagattaaactgatgctcttctactactagaccattcaagctcatggtcaggatcaacaatactaataacctgtaggtacaatggtacagtagcaagcaaatagtgcaataatcccaccacaacgcatgaaaaaaaacactatcgtactgccactatcatcccttcaactga

SEQ ID NO: 79083 - DNA, 492 bp, Triticum aestivum
  Clone ID: PAT_TA_79083
gcgtccgggaccactaaccccgtcgacccccctaaactgacaccaaaatgtgtggtcgcaacccaaaccaacccacgaacccaactcgaccttgccggagatggcaagggtcaggtagcgccgttgggcaactgtcaggcaacgccaccgggaggagcgaatattgcccaataacatctgaccgttcaaatctagatggggacgcccaaggcagccgacaactccggccgcaataggtcagccttgcactcccacgcatacaacaccaccacttccaaccttagttgagctccaccgaacagtcaccgaacccgcctcgacaagctcgcatctagggaagacagtcagccggagtcacacacgcgccacaacccccatgggtgcgcacctaggaaacaccaccccgtcgtcaaccaccatcagagggcacatccgaggtcaacaatccacttcaaccatagctcccggctcttgtcgtcactggacaccaac

SEQ ID NO: 79084 - DNA, 619 bp, Triticum aestivum
  Clone ID: PAT_TA_79084
gcgtccgtcctaatgtaccttaggccgaattgtaaaaatatatgttagccaagattggtgttgaacaactggaagatgtatgaacaactagaatatgtatattcccgttgtaacgcacatgcaattaaatagtgtatacaaaaataattatggtcctcccaacgtccaccactgaatatctctgcacatttctgaactttgattttatataaaacaatccaatttatcttctctcttatgtccttgatttcactatgacttgaatctctttctctgatttcttgttcctattgttgtcctgtatacatgtatattggttcctttcattattgtttcctgttatagataacagtactatgctggtcaagtgggtagatgagagcaattgggcgttgcaaggttatccagttcataataacacttgctgttggtgttcgtgttttatgatttagcctgtaccttaataaccatgaagtaatttgtaagccatgtaatagattatatttgtagttcttgtcaccttctattcaaatatactgggttgtttcatttcattatttttcctgttataagtaatagtactctcaatgctggccaagtggacatgtaatacattttt

SEQ ID NO: 79085 - DNA, 368 bp, Triticum aestivum
  Clone ID: PAT_TA_79085
tcgacccacgcgtccggtgaagtttatcataaatttatgttctagatacaaacgtgttagcacaaaagttattggaggtcgcgtcgctcctccaggggcgacacgggcggaagccccaaatcccgccggcctcccctcctccctgccctctcccctcgccaccgtcgaaggacatggccgggcgaagcccgtcgcctggacggcggtggcggggcttccccatctcgcggcgacgcgggtgtggccgatctggtgcggcggccacggtggtggtcctcggtgcatcttgcgcgagagctcggctgggcgcggatctggggccgctctgcccggatctgctcgtggtgggcgcggcgggggctctttga

SEQ ID NO: 79086 - DNA, 361 bp, Triticum aestivum
  Clone ID: PAT_TA_79086
gtcgacccacgcgtccgggcactatgttcctacaaaacgacagtggttcaagggctaacatagggcgatcatcagctctacaaaattcagagaataacttaaaagcttctacaggaaggctctcagtttctcaaaattcagattctgcacccaaagagattaagccgacagctccaagtggcttggtcccaagcactcctcaaagggtcggaactggctccagtactagaacagctggaaattcaacttatgcatctggtggcaccacattaaagagaagttcactgaagagtaacagcacttctaatcttcataatttcagtaaaactgacgtggtgcctgctgctgttatcatcccaag

SEQ ID NO: 79087 - DNA, 191 bp, Triticum aestivum
  Clone ID: PAT_TA_79087
cgacccacgcgtccgcgcccttctatcccaacgacctcgccgacctgcccgaccacatcgggggcctgctcgacaccaacgcccgcgcgctgccgtccggcctccgggtgcacctcgtgcaggcgctcatactgctggtcaatcggaagattgttgatctggaagacaccatggagttatttatggagctt

SEQ ID NO: 79088 - DNA, 346 bp, Triticum aestivum
  Clone ID: PAT_TA_79088
tcgacccacgcgtccgccacaagtttcttctccacgccccccgcgagttagcggaattgccacgcgactcctcccgccgcgaccgcgatggagccacccgcacccggttcacaaccaccggtcgaggaggaggaccgcgtcgaagaaccggcctccaacgcctcctccaatggggatggcgccccgaccgctgctgcgccgccacctccccccgcgacgcccctccacctcgaccaggccggaggcggcgccgacgggtcgacctccgccacggtggtggacccccggaagggcaaggagacgctgttgcccagggacattcctcctcctccgaaccccgcggact

SEQ ID NO: 79089 - DNA, 368 bp, Triticum aestivum
  Clone ID: PAT_TA_79089
ctcttgctctggaagcttcagggaacactctcagtaattacgtcaatggcttttccagttcaggacatacgcaagaaggatcaaatgtagagagtggtgagaaaatacagccctgaaaaagagaagattagtggaagctgtttttgaagcatctgttgtcaaaaaacatgatagatgcaggccacttgctcaagttgtacagagtagcgtcaaatttcctcgctcttttcagtgcaatgatgattctggaactgttgtagttgaaggaggtaaggatcctttgcctgctatctgtcaggccaaaagaagtggtgccacatacctgtctgctgattctggtgatgcacatagccgtgacttcatacctg

SEQ ID NO: 79090 - DNA, 456 bp, Triticum aestivum
  Clone ID: PAT_TA_79090
ggagagggcgcgctaggagggacttcaggatcgttggggcgaccctgccactcgactggagcacaaacaacacttctgtggctgatttctgcaggcgaaccgtggctacgctgtggcattaccatggagggtgtgtggttggacgggtggttgacaaggatttccgggtcatgggcacccagtctcttcgcgtggtggatgggtcgacgttcagtgtgactcccgggacgaatcctcaggccacggtgatgatgatgggcaggtacatggggctgaagatgatcgcggagcggcacagcaggaggcaagtgaacacatcatcgtacaacgaattggaggagtaaaaccctcttccagtgcttgtgaactgatccaacgcaccaagcatttcagtgatatcctatggagtgttggagtgcacggtattttaatgctcctgcatccggtgcataactg

SEQ ID NO: 79091 - DNA, 289 bp, Triticum aestivum
  Clone ID: PAT_TA_79091
cggcgccgcccacgccgccgcctccggggcccgtccccgccccccgcgccgacgagggtccggcattgccgatcggacccgcgcgccgcgtcctcctacccctcgcgcccgccgccgacgccgcctgctcaccgctagctgatggatctactagggaaccctttcaagggggtcgtcgccgatgccccagggagagcgtcttggtacaaggacgactgggttgcagggctccgaactggcttcaggatattggcacctaccatgtatatattctttgcctctgccctcc

SEQ ID NO: 79092 - DNA, 330 bp, Triticum aestivum
  Clone ID: PAT_TA_79092
tcgacccacgcgtccggttatcgtatcacaaccaaccaccgcctccagcgccagatcaagatgcagctctccctcctcccagatctagccgtcgaacccaaccccttgggccaccggtcaaccatggcgccgtcactgcctccaagcctgtgtcgggagcccagctcctcccctcagcgtcggcgtggctcacggcccgcatcctccaccgcccttgaacacaccgctccggccttcttccacagagccggtggcagctctgccttccaccagctggccagtactcctccagttcatcacgaccatccattccaccgacatcctcctcca

SEQ ID NO: 79093 - DNA, 276 bp, Triticum aestivum
  Clone ID: PAT_TA_79093
acccacgcgtccggaatgaggtcctgaggtcggggcccggaggaatgagcgccggcgctccgccggtagggttcagaactgaaggctggcactggactgggggaatgggctggcctcggctgcatccatcatcagtgggccagtggaaggcttcagcccaggcctaggtttggcccagcccgtttaagcccagttcaacttcaatccacgagacgagagagcaaaacctacctcccactcccctcaacgccgccgccactcactcctcttgctgga

SEQ ID NO: 79094 - DNA, 597 bp, Triticum aestivum
  Clone ID: PAT_TA_79094
cccgcgtccggacgaccccaaggtctggcgagcggtgagagggaaggaggattactttgaaagattcttctgattcacttttctcttgtggttggagagttttgtggccattctactgatatttgagtaagtatacaactaggcgaccacccatcagaagccaggtatgctggtggttctctggttttgatgtgtaacaggaaggaggattcttcaagttcaagatcaaatccagctacgtttcatcaacaaaaagctagcacgctctcagtcgtacccatggctccatgagggttcaggatctccatggttaaaaagctttgatgacaagttgacaacctcaacggccaagtcatgaggtcttgttttttagtgaggatccatgaggttattccgattgtttcagattctgaaatgcaccaggaggtaaccggcgttgattggatctaagccattacgaggcagcactgtaagtacaataaaattatctcctggaaggacaagcttcttaatttgtgacgacgacaaggtctgccgagcaggaagtgaactttctgatgatactaaggaaagtatacaactaggacgccaccaacc

SEQ ID NO: 79095 - DNA, 464 bp, Triticum aestivum
  Clone ID: PAT_TA_79095
tcgaccccgcgtccggaggccatgtactagtcatgacaaactgaagattcaatatgatgatctcgaaaatgctgataattgtggtaaattggaggagcgtgtacgtgcctctatattggctcttcctgataaacttggactgagatgcccaggccggctaagaattaggccacgtcctcaacaaaagactttggtcgatgacactgctcttttacctggaactgctgttgatgtctggcaatttaatggctggtgggaaggagttttagtgagtacagatgccggttcatctgatggcctgcaaatatatttcccaggtgaaaactttttttgtgtatgccagctaaatgatataagaatttcaagagattggatccagagtcgttgggtacatatagaaaggaagccagatgtgctgtcgagaataccttcggctggtgtccaaactaggcaacttgataaca

SEQ ID NO: 79096 - DNA, 252 bp, Triticum aestivum
  Clone ID: PAT_TA_79096
gacccacgcgtccggggagacatatattgaaatattcttctgaagccgcagttgacacctatgaagaaatagctattatcataccaagaggacgacgtactgttgagcttcatctttcatttctgcgactccatggacaagctgatgatattaaaatccaatatggcagcatcgttcgcctttttgttttaccaaagccaaacagtcctcatacctttgtggttatcactcttgatccgccaatccgtaaag

SEQ ID NO: 79097 - DNA, 488 bp, Triticum aestivum
  Clone ID: PAT_TA_79097
atagaagcggtggagtccttatctacacacgaaagcactgacgaagaatctgctatctacaaagatgctaaaatgctccctatgcctcccatgtacgatgtggaaatggatttccaatcttcacaggaaagcccagaagtgtatgacatgtctccaagcatccatccgcacaaacttacatcagcgacctctgagctagctttccacaaccgtgaaatcatggaggttgctttggtgagtgtggcgacgggggtcctgaagcccgtcctggagaagctagccgcccttctcggcgatgagtacaagcatttcaaaggcatacgcaaggagatcaatttcctcactaacgagctcgctgtcatggaggctttcctcctgaagatgttagaggaggaggatcctgatgtgcaagaaaaaatttggatgaatgaggtgcgggagctgtcctacgacatggaggatgccatcgacgacttcatgcaaagcgt

SEQ ID NO: 79098 - DNA, 450 bp, Triticum aestivum
  Clone ID: PAT_TA_79098
tcgacccacgcgtccgatttttttttgggaaaggggatctgctggaaactggagatgctctgagatcgccgccgctcctctccgagtctgggccacctatgctgcgcgccgccgcgaaccctcccctggggtgaggccggagcttctccggaggaagtccgcgccgcgcctccctcgtcgctcgtctcgtccgcgcaagactttggtgggtctgcgttctcaaaccctaggtgctgctaatacgaaggctgcggcttcgcaccctcgtgttggagtttctggtcgccaccccaaggtcgagccgtcgccaacggtctctctgattggcataaaggcatggatagggaacggaaggagctgatgaagaggaggacatcgggccatttgaggtatcctgaacttaagaggcagaagcaacgtaacccttatgttgctgctagatctacctct

SEQ ID NO: 79099 - DNA, 356 bp, Triticum aestivum
  Clone ID: PAT_TA_79099
tccccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttggggagtccaccggtgtcttcactg

SEQ ID NO: 79100 - DNA, 134 bp, Triticum aestivum
  Clone ID: PAT_TA_79100
attctatgccggcaaagtgaagttgaaaagattctcaatcttcacacttgccgacatggaactcttttcagtcttcacagttgctgatgtagactgaaaagagttccatgtcggcaagtgtgaagattgagaaa

SEQ ID NO: 79101 - DNA, 240 bp, Triticum aestivum
  Clone ID: PAT_TA_79101
cgtccgctccatctttacccctctctatctcttgaataaaagtcgcgatctttccgacggaaccgacgccaccgcagcggagcatcaaacggttttgcttccccgtgagccgtgactctcctcttctccttccaacgggaacgcaccaccgcatctccatctgcctcctcctccccgcgcgatgggttccggcgtccacgcggcggcggacggcgtcgccgcgctcgggatctcccccgc

SEQ ID NO: 79102 - DNA, 315 bp, Triticum aestivum
  Clone ID: PAT_TA_79102
tttcaccaagatgcaacacatgttcggcactgttttctgtttatagcagcacttcttcttttcttgtcccaattgtatgtagttgtagactcagcagctttcgcattcaacctttcatggtttctatgcgacgtcatccttgtttccttctttggatgttaagctaatgtgtcattttgtgtatcggttgtgttttttctttgttatgcaaaggctatttagatgtaataatattgaaaataagttctctggcaggtttatgtctacagagcctgcaaatattttcctttttcggagagaagagaacttaaaaaa

SEQ ID NO: 79103 - DNA, 321 bp, Triticum aestivum
  Clone ID: PAT_TA_79103
gacccacgcgtccgttttttttttttcttcatttcaacctccacaaaagctgcgctcgatgttatttttacagtaactcacagactcagcacttgttacagaaacacaagtatacagagcacactgttttcaaactagttacaaaatagccttggactgtcttcaaagacactgcccttttcctgcggttctttcacgtggtttgctcctgatttgttggtccatgctaattcaggttcagccaagtcccgtgcttcagtctccagggcagggctcatgttttcttcatgccccgcgagatcccgtcgatgggattgtatt

SEQ ID NO: 79104 - DNA, 614 bp, Triticum aestivum
  Clone ID: PAT_TA_79104
tcgacccacgcgtccggatcaagatattgcaaatatgatgttcgaattgttatgagtgttccaaaaatcactgcgcatggaaagtccaggaagctcagagcttataagattgaaccacctagagatgcaccagttacttgggacaggacaactgctctggagaagttgaggaagtatggtgcgatatatttaactccattttcacaccgtttggcagaagaaattgatgatccagagctccagaggttgagatgcagggtgaattatcacgcactacagtttaagccaaatatcatgaaaacaagcagtgatatagtgaataagctccgttcagaaggccatttcatgtcgattcatcttcggtttgagctggatatgcttgcatatgccggatgcatcgacatattcacacctaaagaacaggaaatcctgttgaagtatcgggaagaaaattttgcaaataagacccttgtctacaagaaaagaaggcttattggaaagtgccctttaactccagaagaggtaggtcttatcattcgtgctatgggatttaataacacaacaaggattaccttgcttctggcaagctctttggtggggaacgcttcatgaag

SEQ ID NO: 79105 - DNA, 685 bp, Triticum aestivum
  Clone ID: PAT_TA_79105
ccacgcgtccggggaaacattctgcttttcattttggagcttgacctgatcatcctttttctttcgataagttgctcgccgtcgtgcgtttctctgctcccttttgtcgtctgttatgctataactcacttggtcattcacaacagcacacgttgtctgggaatgagttgggtatacatcacatgttggggtagacgatgtcacaagctctgaaccaccacaaccaagggcattaagacacacatcattgtgggcagattctctggctgcaggaacaaaagaaaatatgtcggttaggctaatacatgaacatgcatccctttaagcacaaatctggccatatgaaaggcatatcggttcacacctcttgagccttctgtgtgacctgtggcataaagtgatgcaagagtactcctatccgggaacgaaggcacattattgtctgcacgatgtataaacaacaaatctagatgagaattagtcaacatgtgcattaatagagacgtttgatcactgtccatgatgcacgtgtcggatcataccaaatgaacttcctgcaaggccgcaggcacaaatatctgtgagagtactcggaccagggaacgaagcaacatcatggttacagaatgatgggttgtctacataacaaaaccagtacagaatgaggcagttttctgctaaccga

SEQ ID NO: 79106 - DNA, 355 bp, Triticum aestivum
  Clone ID: PAT_TA_79106
tcgacccacgcgtccggcgagagagctttttcctccccccccgacatgacaccgcatctgcccgtgtcgtcccaccccgcccaccacctgctcgacgcgctgcccccgtcgccgcaccaccgccgcctccgcaggcgtcgccgcttctgcccgccgcgccccagggcctcctcctcctcctccctccgctgccgcgccgccgccgccgccgcgccgcagccggcggcggcggcggcggacgaggcgaggacgagggtgttcgtcgtgtcggacctgcacaccgactacccggagaacatggagtgggtgcgccggctcgcggtgcgggcggggccgccgggggccggggaggggt

SEQ ID NO: 79107 - DNA, 576 bp, Triticum aestivum
  Clone ID: PAT_TA_79107
gcgtccggttgctcttgaccctaggaattggagccgcttgcactatatattgtgtcctagtcttctctgtggaggtattttcatcctgaactttatagcaaaccggacacgcatttttgcactaaccatgaatgattgaatagttttgtgtgaccatgtgccacaattaagtgataccctgtttaactggaattttacaaaatcaaccatttgaaattggatctctggtatactaatttttttttgttggagagagataatctccaatcttgaaggggagccttggcgcagcagtaaaattgtgcccttgtgaccatgagttcacgggttgagtcctgtaagcagcctcttgcagaaatgtatggtaaggctgcgtacaaaagacctaaagtggttggacccttcccggaccctgtgcaagtgggagctacgcgcaccaggctgccccctttttttagggaatctccaatctaccagcagataacaatgttgttttaggtcagatttgtgcactatgtgagcatcacactgttcgtggctcatataatcttggaatcattgccttgagaacatttt

SEQ ID NO: 79108 - DNA, 515 bp, Triticum aestivum
  Clone ID: PAT_TA_79108
tcgaccccgcgtccggggcacactctacgccaccgatgttcccacggcccaggggcatgacaatggcggggatgcagaggatggtgccagggttgatgccgcttcagcgcccgttcatggctccaagtccggggcctagtcctacccagcagaaccagaggaccgaggaggaggacctgaaggaccttgaggtgctgctgagtaagaagacatacaaggagaagcagaacacaaaaactggggaggagctgctggatctcattcaccggccaacggcaaaggagacggctgttgcagcaaagttcaaaacaaagggtggttcccagctgaaggagtattgcaccaatttaactaaagaagattgcagacgccaatctggttcctttgtttcctgtgctaaggttcactttcgccgtattattgctccacatactgatacaaatctaggagattgctcttttctggacacctgccgccacactaagacttgcaagtatgtccactatgagcttgat

SEQ ID NO: 79109 - DNA, 286 bp, Triticum aestivum
  Clone ID: PAT_TA_79109
catctctcccgtcccccccgtgttcgtctctctctccccttctctctgtcgcacgtctagttcgaaacctactccacaaacgccgcggattttataaggttttgcggggatcaatcgtatcgaatcggtcgttgcggaaggaagagagaggccggcgacggcatggatcgcgacgaggagaagggccacggcgacagatcgctgctcttcataggcgacgaggacgacgacctcggtgtggaccgggatggcggctcgccaccctcgtcggactgcgcgggatcct

SEQ ID NO: 79110 - DNA, 627 bp, Triticum aestivum
  Clone ID: PAT_TA_79110
cgaccccgcgtccgatggtccaatacgagaaactgctgataacaagatctgctaaggacaaattggaacatcttcaaaaccagtttgtagatttgacatcagaaaacagtggtctcaacagtgaaattggggaactgaagtccagaatcacagacttacaaaaaactcaagaagctgttatggttcagcatgtagaagaatgccaagtggctgaagataaaatcagaagactggaatctgaagcagaaatatctgcctccaatgtgaagtgcttagaaaagttatcttcggaactacaagggagagttcaaaagttactggaggattctagccttgctgaagatcagaaggaagagctgttgcagaagactttgaagctagaatcagataatcaggagcttctaggcagagtgcagtcagttttggatgagaaatctaacgatacagaatcactgcacagcgagattgctaagcgtgaccagcaggttgacacacaagaaaaacagatcagcgagctccgcagtgttcttgatgagaaggaacagttgtatatttcttctgtagaaagggagaagagtttggaggaacaaaagttacagatccaagcatcacttgctgccacagaat

SEQ ID NO: 79111 - DNA, 530 bp, Triticum aestivum
  Clone ID: PAT_TA_79111
ccacgcgtccgccccgacatcgccgccaaggccatcgccgggtgcaaggcgctggtgcgcctcgacctgtatatgaacacgctcgtcgggccgctccccgacgcactggccgacctcccggagctcgtctacctcagcctcgaggccaacaacttctccgggcccatcccggagtccttcggcaccttcaagaagctccagtcgctctcgctcgtcaacaacctgctcggcggcaaggtgccggtgttcctcggccgcgtcgccacgctccgggagctcaacatgtcgtacaacacgttcgctccgggcccagtgcccgccgagctcggcgacctgaccgcgctgcgcgtgctctggctcgccggctgcaacctcgtcggctccatcccggcgtctctcggccggctcgccaacctcaccgacctcgacctgtcgctgaacgcgctcaccggcccgataccaccggagcttgccggtctgacaagcgccgttcagatcgagctgtacaacaactcgctctccggcccaat

SEQ ID NO: 79112 - DNA, 232 bp, Triticum aestivum
  Clone ID: PAT_TA_79112
tcgacccacgcgtccgacctctcaatggcctttccgtccgccgatggaggctctgatgccggatccggcgagggcgtggcgggcgccgactccggtgcccgcggccatgctcgagggcaccaccccggcgagggcgccgactccggtggccgcggccatgctcgagggcaccatcccggcgagggcgctcgcggcgctgactccggtggccgcgcccatgcccgagggtaca

SEQ ID NO: 79113 - DNA, 182 bp, Triticum aestivum
  Clone ID: PAT_TA_79113
gacccacgcgtccgggatgtccttggccatgatggtgacgcgaataccacccctgggctccccatctaaaccgcccccgcctcgcccccccattccctgcgagctccacacagcatcacaccgcatttctcattcttcctccccacgtcgccgtagcagctagctagccgggagggaggggc

SEQ ID NO: 79114 - DNA, 406 bp, Triticum aestivum
  Clone ID: PAT_TA_79114
ttttttttttttttgagatcagggtggacaactggaggctgcacacatttcactgggctttgtgggccttcgagctgtacagcctgtttacgcacagaacgtgtagctcgttgcgcggagcagtggcccaggtaacgctgggcacaatgagtctttgacagagaaatacttggggctgccctccgatgtggggagagcaaaggagggctctttcaaatacttgaaagatcgaatctggaaacgagtgcaaggatggatggaaaagtgtttgtcggcgggaggaaaggaggttcttatcaagtcggtggcacaagccattccgacttactcaatggcatgttttaagttaccccgtggtttgtgtgaacacataaacgggcagattcggaaattctggtgggggagt

SEQ ID NO: 79115 - DNA, 195 bp, Triticum aestivum
  Clone ID: PAT_TA_79115
gtcgtaccgtacgcacccgtcccggctcccgagttgcttgcacgaaacggtgcggcctcgccatctccatccacctcgcagtcacaccagctcagcactcagcagcagcttctgctccgctcgcccccctccacccccaccagcagccagcgaccgagccccccgtccggctctattctgctctactaaccgata

SEQ ID NO: 79116 - DNA, 270 bp, Triticum aestivum
  Clone ID: PAT_TA_79116
aatggcgccagcgcagcaagtgcaagtctcgccacccccgattctcagcgtcctcgagaccaccctcgttactccctcgcccagcgccggcgccgccccgccggagtgctccctcccgctcaccttcttcgacgtcctttggctcacctccccgcccgtcgagcgcgtcttcttctaccgcctcgccgccgacgccgacgtccccgccatcctctccaacctcaagacctcgctggccaaagctctcagcgcctactacccgctcgccgg

SEQ ID NO: 79117 - DNA, 417 bp, Triticum aestivum
  Clone ID: PAT_TA_79117
tcgaccacgcgtccggtctgaggtctctagggagtccggcctggtcatcatcgacaatagtgttgcccttgtagagacccttatggacgagaggcggtggtccgacatgttctcatgtatgattgctaaggccacaatccttgaggaggtgtctaacggcattggtggaagcagaaatggagcattgctgctaatgaaggctgagctacaggtgctctcacctctggtacccataagggaggttatttttctcaggttttgcaagcagctggctgagggtgcctgggcagtggtggatgtgtccattgatggattgttgagcaatcaaaattctgctaccacatccgcaggcgcaaacctgaagtgtaggaggctaccttccggctgtgtgatgcaagatactcccaatggctactg

SEQ ID NO: 79118 - DNA, 473 bp, Triticum aestivum
  Clone ID: PAT_TA_79118
accggtccggattctcggtcgacccacgcgtccggaggccatgccccggaagctggacggcgcggcgggctacgccagcagcgccgagctctaccgcgacctgctgctgctctgcgccaacgccgccgtctacctcccgcgccacgcgcccgaccacgccgccgccgcgctcaacgccctccgcctcgtctccgcgcaggtctccgcctcgctccgcgagtccccgaccaagcgggagccgccgagcggcgccaaccccccaccggcgccggcggtggggctggaccctcggagggccgaggccgacatcgtcgggccgctcatccagaaagctgccaagccgctcatcttctgccgcaagaggagctccatcgccaaggctgccgcggcggcggccgtcgctaggaaggaggaggccgcggagaagcgggacgttgaggaggaggctgagagcgacggcgagaagaaggccg

SEQ ID NO: 79119 - DNA, 373 bp, Triticum aestivum
  Clone ID: PAT_TA_79119
tcgaccccgcgtccgggagaattttttcgtgaaaaagaaaggaggaagacactccgcgagtgacctagctctcggcccatccctctctatcccccgccgccgcaccagctccgcctccgccacttaaatctccggcgaccgccgaagctccagtgaccgtcctcttcaccctctcccggccgccgctatgaggcgctttctcacccatctccaccaccactcccaccgcctccgcccatccccaccactctctcgtatccccacaaccaagaacaacctccctttccttgtctcccgtcgcctcctctccgacgacgcctctcctccggccgccgcgccgtcggctccccctcctcctcctccgggcgccgcg

SEQ ID NO: 79120 - DNA, 406 bp, Triticum aestivum
  Clone ID: PAT_TA_79120
tcgacccacgcgtccgagcgacgtcttgctcaggcatgtggccacggagtccggcagcgcggcgtccggcgggtggttgtcgcggcagctctggctcgaggctcgagcacggttgccaggactgtacaaggacgagcatccatcacggcctccgggtgtaaggttcgtgcgctccccttttttttttgcaaacgcatgggcacagtgagcccgctgcccttgttctccatgcggctgcgatcccctcctctcacaccacatcacatgttttgttgctagacccttcctcctacccggtaaccattatgtttctgatctgattgtttccataatttcaaggcttgtgtgaacctcggtaattcatctttggatctcattctgagtgcccacggggtgtttatgttaa

SEQ ID NO: 79121 - DNA, 390 bp, Triticum aestivum
  Clone ID: PAT_TA_79121
tcgacccacgcgtccgccgcatcccctccttcctcctcgctcgtcaccagggcctccgccctaagagcctcgctgctgcttgctcccctcctccaccggacctttgcttcttctccaccccgacttccttctcttggttgtttatccggccgtcggcggcgactggttccagatctggcgcaagttaggcgagccctgtggtggcgtgaaggggcaggggaggcgggcgacgaggacaagcaactgtcggcccgtcgtgggtgaggctacagggaagagggaggaggcaggcgacagggtgaaggagcacgctggtcctcgtggaggaggcgtcgccggccaggggccatttgccatcgccggcctcactcgccccgtctactctctctt

SEQ ID NO: 79122 - DNA, 499 bp, Triticum aestivum
  Clone ID: PAT_TA_79122
acgcgtccgtaaaaagatcccaaacactgcattaatggtcctggaaatagtggcaagtggacattcctttggagccagttcattccatgtcctcagcacgtgtagaatgcttcttcttaaacttcttgacgtacctggccatctggtggcacaaactggatgcccatcagactgtgtttgtgatcagccaccaaactggaaaaccgaggaactcacgctgtattgccttcgagaagtagagatccaaaacttgagaggaactgaacatgaaactgctcttatgaaacggttattccgttgggcaacagtgctagaaaagatgacagtaactttccatttctcagtcgctgacagcaaggccaaggagttctgccagatgcttcgaagcttctgtaggccagaaatatctattaaggggcaacgcttcgcctaatctagtggtagcataggtaacaatggcctgagcttgttggcaaactttatgtgcaccgcagggcct

SEQ ID NO: 79123 - DNA, 578 bp, Triticum aestivum
  Clone ID: PAT_TA_79123
cacgcgtccgaccaaaatttccaccctcctttacactgagcaaccaggagccgcgtggcacgtacaatttcggccttcctttccaccgccaggctctacgcgccgccgccctcgtcaccgatgcccaggagccgcctactcggctactcctcacgctgatccggcgacgcgcggcgagcaggatgaggcaggtgccttccgtgtgtgtgccctcgaacggcaaaccattcctctgattgcttcaggtcgcaggtgattttttcttttcctcaaaaagagggaaaaacaatcggcctctgcatcgagtgtcaggttgcaagggagggatgattcgcaaatagagcaccaacattcaagtatgatagtttacttacagtcttaattgttcggtatctacgactgcgagaatactgatcgattgttcttaactgaagtccaatgcgttgagtgtacatatgaactctgcctaaccatgttccataggacaagctgaatactctgctgcattttcagctattatgcggtgaaaatgccattcaaaacaaattatgcggagaaaaagataattgtagtttaaa

SEQ ID NO: 79124 - DNA, 644 bp, Triticum aestivum
  Clone ID: PAT_TA_79124
taccggtccggaattttccggtcgacccacgcgtccggagatttgcacaaaatttaccatgaatgattcaaacaaggagatagtgaaggatattggacttattggatcaaatggagttccgtcttttgtcccttcacctgcatcttatcttgagcctccagttattctgaataaaaacaaaaaagatgacatcccaaatgattgggtttcctccttggaggaatgccaggcaatgtctgcacaaaagttagggcaggaggggtccaattctggtcaaaattgttctggtagcacgggtgatgaaaatgtgtcaaaatctaagaagcccgcctctgatagtacttcctgtgaggaagcatcttctgcaacagataagccaacgagattgctagctgttaatggtggcttggttccggagtcatcattgaggcctgttataggaagaaattctcatatcctaaagcagcaaaagataaatttgcttgatatagatgcagcgttgcctgaggaagctttgagagcctcaaagtctcaacaaataagaaggcgctcatggcgcgcttttgtgaagcatgcagaatcaatatccgagatggtactggcgaccagtgtgttggagagtatgataaaatccgagttcctga

SEQ ID NO: 79125 - DNA, 292 bp, Triticum aestivum
  Clone ID: PAT_TA_79125
gacccacgcgtccgggtcatttcaaacgccgagaccctcccccgaatcgaacgctagggtttgctccttccaccgtcccctgtttcctccccaccccacccccgcccccatggccgccgccgccgcctccgcggaggccgccgccatcacgcggcgcctggcctcctgcaacgctggcgcccgcgagcgcgccgtccgccacctcctcgccgacttcctccccgcctccgcgccgcacctctccgccaccgacctgctcaagctctggaagggcctcttcttctgcttctgg

SEQ ID NO: 79126 - DNA, 464 bp, Triticum aestivum
  unsure (1)..(464): unsure at all n locations
  Clone ID: PAT_TA_79126
tcaagagtatcatgcagatgagcaagcaatttgtgctgttggacttgctagagcaaagcctgggatttttgtcgaagcaatccagtacattttanttttagcaactcctgtggaggtgatgcttgttggagtttgctgttctgctagtgctgatggaacagatccgtatgctgaactttcattgcaacctttacctgagtacatgatttctactgatggtgtcacaatgacatgcatcacatgtacagataagggtcagattttcctgtcaggacgtgatgggcatatatatgaattgcaatacacaactggttcaggttggcgtaaacgctgccgtaaagtttgccttgccacgggtttaggcagtcttctttccaggtgggtcctgccaagtgcgtttaatttctcagctgttgatcctatagtggacatggttattgatgaggagaggaacactatctatg

SEQ ID NO: 79127 - DNA, 547 bp, Triticum aestivum
  Clone ID: PAT_TA_79127
tcgacccacgcgtccgcagggagcacactccgaggcgagatacagaggggtaatagactgtgttagaaaggtttatcatgcagagggtgtagctgggttctaccgtggatgcgccacaaatctgttgcggacaactcctgctgcagttataacattcaccagcttcgagatgattcacaggttccttctcaatctaggctctcctgaacctgaacaacatcatccccatccgctgaagcattgactgtaccattcctgtgtcctatccctgctgtcatctgacaagttgaaatccagtaactatcaaacgacgccatttcccttgagggctctcacaacagagattttggtatcgcaacaagtagctgtcattcaaagctcaaaccatagtgtaggacaggaattagtacttgtgtatgaattagtcttgatagcacgcagtgtggaggtatacaggttgtgggggaatagtgatattggtcggtgtgttgtctgatgatgatgaaaagaaaagaattttattgttggtaaaaaaaaaaaaaaaaaa

SEQ ID NO: 79128 - DNA, 285 bp, Triticum aestivum
  Clone ID: PAT_TA_79128
ccctcccctggtccctggctcgcggaggattcaaaccccctgcgacggcatcgccaccgaacgcgagcacgagaccgaccaagaaaggagcgagcgcgagcacggggaggcgccgccccctccaatcccccgccctcccggcgccgcaaaaccctcagtaaaccctagcgccccatcgccacaaccggcgcatctgccgccgcatccatggacttctactccgacgacgactcggaccccgatttcgacgagggcctccaggaggacctcgacctgggccgccgc

SEQ ID NO: 79129 - DNA, 287 bp, Triticum aestivum
  Clone ID: PAT_TA_79129
ctagagctgccgccgtgccgtcgcttagcatcaccaccgacgcctcagcccccctctcccccaatcctctcagcgtgtcgccgccatcgccggtcccggtctacctcattccggccatgctggctctcgtccccatccgcaattttggccattggtttctgaggattttggtctgcagtatgtgagagctttggctgggctggtaataaagtgagaatgcgtggagggcttgagctggtcagctttttggaatgcacttgattactttattcaccaagattattggt

SEQ ID NO: 79130 - DNA, 679 bp, Triticum aestivum
  Clone ID: PAT_TA_79130
ggtcgacccacgcgtccgagttgatccagaatgaactgactgtgaaggtttatgaaactcatgcgcgtttagcattgcaagctggtgatctagctgaatttaaccagtgccagtcacaactgaagaggctatatagagagggaaacaatggttgttattttgaattctctgcctacaatttgctctgcgtcatgctacactctaataacaaacgagacctgctgtcatcaatggcaagcttatcaaaagaagccaaacaagatggagctgtcaagcatgcccttgcagttcatgctgctgtttcatctggcaattatgtgatatttttcaaattatacaagcaggggcccaacttgaactcttgcctcatggatctatatgtggagaggatgcgtttcgaggctataaaatgtatgtctagatcatatcgccccacagtacctgtggggtatgttgcacaggttttgggattcttgccgaatggggatgacagatcggaagaatgtgaaatatggttaaaagcacatggtgctgttctttcagtggataacggtggagaattgcagatagacacaaaggtaatgatctctctctggacaatgtaatacataccttaatgctattcctccaagggatgtatcacttcagttatgcaaagttggattattgtcttgtcatc

SEQ ID NO: 79131 - DNA, 440 bp, Triticum aestivum
  Clone ID: PAT_TA_79131
acgcgtccgatcaatttgtccctctctttatccagcttctaagcatgggaaacaggggagggaaacagaaatatcatgggaaaatttactggatggcattcgctcgggatattgaatatagagaggtgggggggggtccagctactgggctcttagatactcacattgaaaagcttttctgaattctagatcaccgagtcttgaattctctctccaaatggggcccaagtgggaatcatacaaatcttggggtcaatccttcatacctcgctttctccatggtcgggggagggtaacccatctccttcctctttgctggtggcagcaatacagacaatctattggcggagtcattagctgaatgggtatcaccatttagttcttcattctggcctccattcgcagcaactacaacttcaccttcttggtgaaagtatact

SEQ ID NO: 79132 - DNA, 478 bp, Triticum aestivum
  Clone ID: PAT_TA_79132
tcgacccacgcgtccgcccatgttccacgtctacggcctctccctcttcgccgcgggcctcctctcgctcggctccaccgcgctgcccatgttccacgtctacggcctctccctcttcgccgcgggcctcctctcgctcggctccaccgtggtggtcatgaggaggttcgacgtcggcgaggccgtcagggccgtccacaggtataaggtcacgcacttgccgctcgtgccgcccatcatggcggcgctgctgagggccaaggccacgggcgcctcgtcattggactccttggtgcaggtctccagcggtgcagctccactcagcggcaaacttgttcaggactttatcaaggctttcccacacgtcgatttcattcagggctatggcatgacagaatctactgctgtgggaactcgtggtttcaatacctcgaagcacaagaagtatgcatctgtaggtcttttagccccaaacatg

SEQ ID NO: 79133 - DNA, 581 bp, Triticum aestivum
  Clone ID: PAT_TA_79133
tcgacccacgcgtccgcccacgcgtccgaaccgctccgtccattcgaacccccggcccgaaccgactcgccccttcctcctccgctctcgtctctcgccactcgctcccctccctctcgagttcctccagttcgccgtctccaccggctcgcccttagcgccgcggtcttccgggagttcgagagaggcggtcgctgcttgcgacgcgcgcgtgtggcggcggacggacgcgatggtttccttcgacatcaacgaccgcacgaagattgggctgggcttgactgggtttggagttctcttctcgtttcttgggatcctcatgctgtttgacaaggggttcttggcaatggggaatattctcttcgtgtctggtgtttcactaaccattgggctgaagtcaaccgtacagttcttcaccaagcctaagaatcacaagggttcgattgcttttgggatcggacttttcctcgtcctcattggttggcctgtcttcggaatgatggcggaatcgtatggctttgccgtgctgttcagcggcttctggcctactgctgctgtttacctgcaaaagaaccccaccg

SEQ ID NO: 79134 - DNA, 362 bp, Triticum aestivum
  Clone ID: PAT_TA_79134
gtctccacgagagaaaagggggagatggcggagagccctaggtccgcaccacggcggacgcctgccgccaagagcggcgcgggcctgctcagtccccggttccgctcggcggccgagctggccggctgggacgaggagtccatcctcctcgcggcgctcgtcgtcgaggacacgccggtccgcgagtcccgccgcaagaggcggccctccggctcctccacggcgggcggcagcgccggatctaacaccaggaagcggaggtcgcggaggcagtcggcggatgagacaccgatcccgcccgtggcgcttgtgctcgacgacgacgagaagccgaacgaccatgaaggtggcaagaaggaggt

SEQ ID NO: 79135 - DNA, 497 bp, Triticum aestivum
  Clone ID: PAT_TA_79135
gcgtccgcgctttcccccgccgtcgccggcctccgcgcgctcaccggcctgtacctccactacaacgcgctccgcggcggcgtgccccgggagctcgccaggctcacatggctcaccgatgtctatctcaacgtcaacaacttctccggccccatcccggccgagatcggcgccatggcctcactgcaagtgttgcagctgtgctacaatcagctgaccgggagcatccccacgcagctggggctactgaacaggctcaccgtgttggctctgcagtccaaccacctgaacggcgccatccctgccagcctcggcaacctgccggagctgaggcggctggacttgagcttcaaccacctattcggctccatcccggtgaggctggccaggctccctcagatcaccgctctcgatgttaggaacaactcgctcaccggcagcgtgcccctcagaactggccaagctggagggtggattccagtatgggaacaacactg

SEQ ID NO: 79136 - DNA, 282 bp, Triticum aestivum
  Clone ID: PAT_TA_79136
cgacccacgcgtccgtccgtcgctctcgtcttcgaccctaatcttttcccccagccgccttttcaagctcctcatcccctccactacctcgacaacggtggcggcggccccctctgctggcgaaggaggaggggggagatggtggcgcggcggcgaccttcccctcacgcatcccatcccccctcgtcatcccggatcccaccggacccgaggcgtgcgggcgcggcggcgatctgcaagggaagggcgacggtcgaatcgatccagtggatcctagacccc

SEQ ID NO: 79137 - DNA, 679 bp, Triticum aestivum
  Clone ID: PAT_TA_79137
ccacgcgtccgcaagaagaaaaactggactgggaggctagactccagattgctctcggcactgcccaagggctggcttatcttcaccatgactgcagcccacggataattcacagggatgtaaaatcgaagaatatcctcctggacaaggactatgtggcgcaccttgctgactttggcattgccaagagcgtgtgcatctccaagacccacacgtcaacctatgtgatgggcacaattggctacattgaccctgagtatgcgcgcacctcccgcctcaacgagaaatctgatgtgtacagctacggcatcgtcttgctcgagttgctgactgggaagaagccagttgacaacgagtgcaacctccatcacctgatcttatccaaagccacagacaacacagtgatggagatggtcgacccagacatcaccgccacatgcaaggatctcggcgaggtcaagaggatgttccagctggcgctcctctgcagcaagcggcagccatccgatcggccgacgatgcacgacgtcgtgcacgtcctcagctgcctggtctgcccagaagcgcccccgaagccggcgcagccgccggcgtcgccccagtcgtcgacagccccgagctacgtgaacgagtacgtcagcctgagaagcggcagcgccctctcctgcgccaactcgtc

SEQ ID NO: 79138 - DNA, 632 bp, Triticum aestivum
  Clone ID: PAT_TA_79138
gtcgaccacgcgtccgctcaggggttccaacatttcacctgttcaagccatgcttaagcgtccagaagggaagacttgggttgttgagctagagaaggttgaccgctgtgtatttctgaccaccggatggcccaagtttgtggtggacaattctttgagggaatatgagttcctactcttcagacatgacaagaaaatggatttcatggtttcgatttttggtcggaatgcttgtgagaaagcagtccggtcttcaggaagtgctactgaaagtctagaaaggatactccccacttgtaagcgaggacatagtggtgatgaactaacgaagaccaccaataatctcaggcagagtcactcactggttatggtaccagatcaatctgatacaaaaatatttcccttccaagggagtactcagggtaatggacatatctctccacagagcttcgctgacatacatcttcatgaagtagatggtttgaaggacgagttaaagatatacttattgttgaaggtgccaatggatgatgataaagctaaagtaatagctgaagtaatgagcagattgcatgttgacagagctacagttgacttattctgtgctacactctgtttgtataagtgggact

SEQ ID NO: 79139 - DNA, 522 bp, Triticum aestivum
  Clone ID: PAT_TA_79139
ccacgcgtccgatttgttctgaccgcattgcatattgaagtaaactggatggactaatcttgagttcctccatcaagttatattacctcgacaagaaaaggtgcaggtaaaaccatataaagtactatggtgagtctatctcaattgaattagaactcaaattgtagcaattccaagcttttttctacaactgcaattgggtggactatggtatgggtcggtttattaatttgaagggattttaagtgacaacctgctactttttctactggtagtgaattcaaattaagtctgctgtctctatctaatatactgaacctggaagatttgtctgaggcctctatctaatatatgaagaattggctttctattctgaacatcgacctgaacctggaagatttgtctgaggactttatctaatatatcaagaattgtctttctgttctgaacatggaactgaacgtgaaaaatttaccttactgttaactgctgttttgtctcattgccaatatatctgcataa

SEQ ID NO: 79140 - DNA, 499 bp, Triticum aestivum
  Clone ID: PAT_TA_79140
tcgaccccgcgtccgcaccgctacagcaggtgcatacgcaagtggcctctcccccaggtccatcaccgcaggagcaagtggtgcagctctgctcggagctgcgtcgagcgctctcacctttgctggcccagcctacatctagggacctaccgaagcagcagaggaggccgcggcagaagcgaccattggtgtcctctccgcgccggagtgtgaggctggcaaagggcgggaggggctctaaggcctcaaagcagcagacggtgctgatcaggaagctttgcctggccaatgaagggaaccagattgacgatgatgcgctgcaagcctatgtcaagttgtccgataagccactgctcgactgccacgtgagggcgattctggcattatttgggtgggatgcttcggtgctacccttgcagagtgaggaggaaggaagggtcgagggccagtagtactaccaggtgtggtacgtggatttggtgggcatttccatgacttc

SEQ ID NO: 79141 - DNA, 643 bp, Triticum aestivum
  Clone ID: PAT_TA_79141
ccacgcgtccgtcgagagagtggctctcacacacagcgtctcgtcttatcctcctcctcctcgtcttcggcgagctcaggccttccccaccgagttcgccgcatccgcttcaatgtcaagccggcccgcccgccgccgctcgtcggcgtcggccacggcggagaccgccggcgctagggctgccaaggcagcgtcgctggaaaacaagcgggccgccctgggaaatctcaccaacgttgccggcgggaggaccggcggggccgatgcgaaatcgagttcatccaactcagtagcctatgtgaagaaggggagttctgctggccttcccaacgtgaataggaaagtggcttctgccacaaaaccaactttagaccggtttgagcgagcaatatcgcaccatggcaatgcccttcagaaggagaacgtttgttgcccatctgtgcctacgttggcaccccatggcagttggcccggcctgtctcatgattctgtttctatggaggacgatatgctaacatgcaattcagtggaaagccctggtcctctattccttgacaatgcagcttcttcagtggcaacttccttgcgccgttgtgcgaatgataaacttcctgtatctgacaatagggataccacagtatct

SEQ ID NO: 79142 - DNA, 378 bp, Triticum aestivum
  Clone ID: PAT_TA_79142
tcgacccacgcgtccggccgcggcctcgcgcgccgggcggctggagccggccagcgtgaagatgatggtggcgccggggttccacgtgtacgtcgccggcgccggcgtggtgaagtgcaaggtcgtgtgcttctacaacaacagccgcaccggcagccacataattggcgggagcagcgccaacggcggcgaggggttgggaggtagctgtagcgatatgaatgggggtggtacggactcggtgaagagctgtcagagtagcagagtatagtcaaaaaaaagacacgaggattgttatttgcgtggtaaaaacaggacttgcattcaattgatgtgtgaatatggggtgtcaattccgctcttgtgagtcaaaaaaaa

SEQ ID NO: 79143 - DNA, 304 bp, Triticum aestivum
  Clone ID: PAT_TA_79143
ttttttttttgatgcaaaaccacactccgcgtggtgaaacaaacaaacagagacccagcaattttcacaagacccccatggaaacggagctcccacttcacagtcaatgctctgctccctctacacaatcgctccaacttgacccggcaattttctaccgtatacagtgacacgttatccccacccaacacacacacacacacacaagcatcgcctgaggaaggggacagtccgttttcaccaacccgttgcgttttctactggacacacagaagggcatgctacctgcttggtgcgcctggta

SEQ ID NO: 79144 - DNA, 616 bp, Triticum aestivum
  Clone ID: PAT_TA_79144
tcgacccacgcgtccggtccagtcctccccaaatggatttccctcaagtgatgctgctttacccactaaacaaggcaggtttgaccttgagctccgagctgatcattattttgaagatgaccatgcatcggacagcaagcctatagatttccttggtgtatcatcggatacaaaacgtccgaatgatgctggtgccgcattagctagggcggaaggcttggggaggtttggccataatagtgcaacctcctttccgccgagtacaggtaatcttgtaggccacaatcacaatgttgctgacctgaataagccaattctgggcccatatatggccagaacaaatggggcagtatcgggaggtccttcatatactctggagaactcttggcagcagtctccatggagatcaagcacaactaactccagtttcaataaagaatattccaaggacaagcgtattaatgaagccacaagctctaatttctttgatgcaagttccaggataaaacaagaggagaaaccactgatcgataaagggaaacgtgccagcagcacaggttttcttgcacccagatgcaatggcatggatccacaaaaaatgttcagtgctgctgac

SEQ ID NO: 79145 - DNA, 380 bp, Triticum aestivum
  Clone ID: PAT_TA_79145
gcgtccggcgctctacgcccacctccaccgccgcgccgtcctccaccgcgtctccttcaaggccgccccctccgccgtccgcttcagccccgacggcgagctcatcgccgtcgccgtcgggaagctcgtccagatctggcgctccccctccttccgcaaggagttcttccccttccacctcctccgcaccttccccggcttcgccgccggggtcacctccttcgactggtcccctgactccgcctccctcctcgtcgcctgcaaggacctcaccgcccgcctcttgcccgtcaagcggggcaccgggaacaagccctttctcttcctcggccatcgcgcggctgtcgtcggcgccttcttcgccaccgataagaagactg

SEQ ID NO: 79146 - DNA, 376 bp, Triticum aestivum
  Clone ID: PAT_TA_79146
gtcgaccccgcgtccgatcaaatcggacgcccgcaatttccagagcaaaccccagccccaactccggcgacggaaatgcggcgcgggcgcgggcgcggcggcggcgggcggcacccgaaggcgcccctctcctcggcggcggtcgaccgcaccccgatgtcggacgccttcagcatccagaggaacctcgaccacgccttctcccgccgcgactccgacgccttcagcatgtgcagcagccgcccctcctccatcggcacgggggcggcctcccacgccggcggccccatcaccagcctctccgaccgcgcctcgcaggccgccgccctccgcgccgtcaacgcctacctcgccgccgccgccatccacctccgcc

SEQ ID NO: 79147 - DNA, 231 bp, Triticum aestivum
  Clone ID: PAT_TA_79147
cttcagcagcaagaagcgccgcgactccctccgcgagaccttggtgccctcaggggagaagctgaggaggctggagaaggagaaggggatcgtggtgcggttcgtgatcggccggagcggggcggcggagggcggcggcggggcggcggaccgcgccctggacgcggaggaggcggagcacaaggacttcctccggctggaccacgtggagggctaccaccagctgtcctc

SEQ ID NO: 79148 - DNA, 282 bp, Triticum aestivum
  Clone ID: PAT_TA_79148
tcgctttggtttggtttcgcggctcccgtctcccgctcccgctcccgctcgcgccgcagggaccgaggcggccactgcagcaagaagaaccacggtatcaagtttctagtacactcaaatgggtgctagggagaacggggaagagagaaatgaccattcaactcatgtggaagtggaacgacatgctaaactagggaaggaagctgaatcacagtatgaaacagctagggactccttttcatctcaaggtgagtctaacagtaatgaagatactaaagtgaa

SEQ ID NO: 79149 - DNA, 267 bp, Triticum aestivum
  Clone ID: PAT_TA_79149
tcgacccacgcgtccgaagccgaaatgtcagctgcgcgacgggaacgagctggtctggtcgacgcgagcagaacggcgggggcggagacgccgcatccccggcgggaggaggaggaggaggagcaaatgatggtggcgcaaccttcttcctcctcccctcacatgtggcagccagtacgggctcaggcagcaggccaagacgcgccgccacgccacgccgacggcttaacgcgcgaggccgtccgtccgggtggagcgagagcttct

SEQ ID NO: 79150 - DNA, 495 bp, Triticum aestivum
  Clone ID: PAT_TA_79150
tcgacccacgcgtccgctatttgacatagatgtgcttacgatgtcgttcgcgcctaaagatgagcatgaagctcaggtgcagtttgccctcgagagaggaatccctgctatatcagcggttatgggtaccaaaaggctcccatttcctggcggggtctttgatgctgtacactgcgcgcgctgtagggtaccatggcatattgaaggcggtaagctcttgctagaattgaacagactgttacggcctggtggttactttgtgtggtctgctactcctgtataccagaaactgccagaagatgtcgagatatgggaagcgatgtctgctctaacaaggtcaatgtgctggaatgtggtcaataaagtgaaggacaggataaatcgagtgggagtagcgattttccaaaaaccaatggacaaccgatgctatgatggaagatctgctgcaaaccctccactgtgtggagagtttgaaatcccgatgctgcctggaat

SEQ ID NO: 79151 - DNA, 370 bp, Triticum aestivum
  Clone ID: PAT_TA_79151
ttttttttttttttttctgtcaaatacaagttgaaatggtagtccatagactgatcgaacagtgaagtcatgggtggttacaccgactgcctcgtcatctacctagatacagactttgaccggagagcacatgcatgcatcatctctaagcaccatctcaaccagacagaccaaccgatcaacatacatcaccgattcacaattcccccccaacatgttaacgcaaaagccgccttgctatccacaaaattcctcttcatctccattttggactcttaccgcgacaaaattcaggcttctcccagatcgccgcagaacctcactcgcttcctcctctttgatgatccgcgccatctttccgggctcgggg

SEQ ID NO: 79152 - DNA, 389 bp, Triticum aestivum
  Clone ID: PAT_TA_79152
tcgacccacgcgtccggtggagaacatggcatattggcatgggtaatggacttcatcgtctccaagtggaaatagctatgcgtggcattgggttacttaaagtgggcggaaggatggtctactcaacatgctcaatgaatcctgttgaaaatgaagctgttgttggtgagattctgcggagatgtggggattctgttgaactccttgatgtttctaatgagctacctgaattgatccgccgtcctggacttagaacctggaaggtacgggatagagcgtcttggttgggcagtcataatgatgtacttcactacaggaagaatgcaatattgccaagtatgttcccctcgggtaaaggtaccacggacagctgtacggcgggtggcagt

SEQ ID NO: 79153 - DNA, 256 bp, Triticum aestivum
  Clone ID: PAT_TA_79153
gcgtccgccactcggtcactccactgcctcgctcccacgccgacactcgccatgatgcgccgcctccacctcgccgccgccgtcctcgccgtcttcctccccctcgccgtctccgcggccgggggcaaggcagcggcagcggcagctaaggcgcccgttggcccgccggccccgccgaacatcacggcggcgatggccaagggcgggtgcaaggcgttcgcggccctggtggcggcctcgccggacgcgcactcca

SEQ ID NO: 79154 - DNA, 250 bp, Triticum aestivum
  Clone ID: PAT_TA_79154
gtcgacccacgcgtccgaaactaaacaggagttcgtccatgattagtttatgtttttctttttctgtatagtttcaccattgtctatgcatttgtttgtttagcgtgatgttgataagacccttttacctaaactgtgtacatttatttgttgcagatatcaggaaaggcgttaaagtattcctattgttttcaacgaaaaaaaaaaaaaaaaaaaaaaaaaaaataaaaaaaaaaaacgaagaaaaaaa

SEQ ID NO: 79155 - DNA, 306 bp, Triticum aestivum
  Clone ID: PAT_TA_79155
tcgacccacgcgtccgccagctccctcttccccactctgtccaaccatggccgccgccgccgccacccgcctcttcctcctccactccagcccgccctcctccctcccgtgcccaaaccctagccccagctccgcccatacgccccgccccgcctacccgcgcctcgcgctcgcccaccgcatggcggcggccccggcggcgatcgccgggccctccggcgactccgagcgcgacctgagcgcgtccgcggtctcgttggaggcgcttggggccgtcgagtcctcgggcgacggtttggagaggaa

SEQ ID NO: 79156 - DNA, 361 bp, Triticum aestivum
  Clone ID: PAT_TA_79156
gtcgacccacgcgtccgccagccttataccctttcgactctccaccagcccctagagcagagcgaggactcgagcactagcccgcctgctcctcctcctcctcctctggttcaaccgcggttggttacacagagccagccaagaagcgtatacacgggagggagggaggacggcgatgaagtacgtggtggtgaccggcggcgtggtgagcgggctcggcaagggcgtcaccgccagcagcatcggcgccgtgctcaaggcctgcggcctccgcgtcaccaccatcaagatcgatccatacctcaacaccgacgccggcacaatgtctccgttcgagccatggcgaggtctacgttttgga

SEQ ID NO: 79157 - DNA, 291 bp, Triticum aestivum
  Clone ID: PAT_TA_79157
gtcgaccacgcgtccggcagtagtgctggtacacctagttagcagtagcgctctttttggaaaagcactgctgatagaggtaagtagcagtagcgcttttcaaaagaagcgctactgcttatttttcctattttttattgcaacttatttttgttgtatttgtatatgttttatatacagtactttcatcatatgattttatgatcatgattagttagtatatacaatagtgtgtgaaatgaacctaatccaccttcatttcacacactgttatatatagtaagctggatt

SEQ ID NO: 79158 - DNA, 530 bp, Triticum aestivum
  Clone ID: PAT_TA_79158
tcgacccacgcgtccggtgaagcctacccgggccgtctccatggcgtgcaggaggtcttgttgcttctcgccccccccacaaggaggcaaaccttgatgccgccttcctttcaagagatcgtcgacgtcggcacaaccgacagttgcaattgtgcacttgctgttcaagggtaccgaggaagagggggactagatgatggggagggtagctgcctgcagcctgatgcatcacatttggaaggaagcaacccggcggacaaggagatgccatcatcatatatacgccttggtcgagctatctttgccagtctaagtctcaatctggtttggctggatcaacttggacgcccaagtggaggacgggggagaccacattgaccatctcgagctcgatagacatcctcgaccccgaccacctgcaaaagggagagacgcgtctcatggatgcttgccaatgacatgcacacgtcctgctgctaaggacggacggacacgctggacggcatcaactacggcgtggcatctctgga

SEQ ID NO: 79159 - DNA, 609 bp, Triticum aestivum
  Clone ID: PAT_TA_79159
gacccacgcgtccggcatggtctcactccaagggcgtctgttccacaacatcatcaagcacattaatcgaccgcctgcattagcacaagcgacactgctttctcggccctaccggacggtgccatggcatggggaggtcttggcctcaactcatcgacgcctcttcagccgtattttgcctcacaatagtcgattgcctgcgttagcacggggggcactgctacctaggtgtttctacaccaccacacggcaattcaaggacatggaatctatccgaagactcctttttcgaggcattacacctggcatctttcttcctcggtggtacttcagtgctccattgcagcaacagcagattttgggacccatccgaggactcttcttcggtcatattcgtcaagttgtatgtcggccttggcagtattgcgtggccccatcgagatcggcgatccattttgctcgtagctactttggatgtttgtggaaggtcacagtggctgcagcttttatcaacattatgtggtcgtttgtctaccacacttatcttgttcgtgtcccatacaccagccaaactcgtttcttacgctttgagactgtgccttataccaa

SEQ ID NO: 79160 - DNA, 133 bp, Triticum aestivum
  Clone ID: PAT_TA_79160
acccacgcgtccgtccccgtcattctccccagtccgcaaccccacgccggcgcccaccgaggcgctcaccctcctcaacggcaagtggatcctcgcgtacacatcattttcccaattgttcccactgttgggg

SEQ ID NO: 79161 - DNA, 551 bp, Triticum aestivum
  Clone ID: PAT_TA_79161
ccacgcgtccgacgacgactacggcgactacgagggggctgacagcgactggagcgcctcctggctccagctcctcgccgccaaggccgtgcaggagctcgtcctcgtcaaccgccggcgcccgctcgacgtcgtcctccccgccacgttcctgcgcacggccaccctcacccgcctccacctctgcttctggaagttccccagcacggccgggctcccgccgggcgtctctttccccaacctccgtgagctcgggctgtacagcgtcgtcgtggagggccgggatctggacttcatgctcgacaggagcccggtgctggagacgctctgcctcgaagggaacctgttcacgctccggctgcgccttgtcagccaaagcctccggtgcgtgcagatcatcgggtccttcttggaggagatcttcgtggtgaacgccccactccttgagcgcctcatcaatttggaaggctggacccatgaggccggctgcaccaaggtcaagattggccatgcccccaagctgcaattgttggcatacttgcagttggaca

SEQ ID NO: 79162 - DNA, 603 bp, Triticum aestivum
  Clone ID: PAT_TA_79162
gtcgaccccgcgtccgagctcgtcctcttctacgccaagcacggcgacgtggccgccgcccgcagggtgttcgacggaatgccgcaccggagcgtcgtgtcctggacggccatggtctcgggctactccaggaacggccgcccccaggaggcgctggagctgttcgccctcatgcgcacttccggtgacgccaggccgaaccagttcacgtatggcagcgtggccagcgcgtgcgcgtcggctgggtgcgtgaggagcggggagcaggtgcacgcgtgcgcggccaaggggaggttcgtgggggacatgttcgtgcagagcgccctcatggacatgtacctgaggtgcgggtctgtggctgacgcgaggcggatgtttgtggagatggagaggaaggatgtggtttcttggaatgccttgctcaggggttttgtggagcgtgggcattgcagtgacgcgcttgggttgttatcctcaatgctgagagaagaaatgctgcctgaccatttcacatttggaagcgctctaaaagcttgtggagcagtcagtgtgctcactaacacggagctgattcacacttgcataataaagttgggctactgg

SEQ ID NO: 79163 - DNA, 273 bp, Triticum aestivum
  Clone ID: PAT_TA_79163
cccccgcaaggctccaccggcgatctccgtctcagccatggagatggagcatgctgtgatccagcagcaggtcgtggagtaccccgaggagcatgaggtggaggtggacgtggacaacatcatgaagacggaggtggcgtacggttccggggttcacagcaccgcgttcaggtacaagcacaagaagaggtccaaggtctgggaggagtacaagcccatcttcctcaacggcaaggtgcagtttgccgagtgcctctactgccacaaccggct

SEQ ID NO: 79164 - DNA, 532 bp, Triticum aestivum
  Clone ID: PAT_TA_79164
tcgaccccgcgtccggaaactcatatcggaagaatctgatgccttttactactagagctgtgcacaagtggagaacttagttcctctttgcaagataagaactccgcaatcttagtctgcttaatcgatgttgagggtgactccttgttacaaagagtaccagcaatctatggggaccaacctgcatatggcaccaagacatcacaattcctcccctttcaaagtggttcagttgatataatcacctttaaaggtcccaaattgcagacaatcaaagaaatctggatcggccttgaatcaggttcatggagattagatggtttaaatatgaaagtgatccatggagcacggaatacacctgaagatcttgagggaacacttgagctcaagttcagcggtttacagtacacgttcgacaagctcggtgcggtgcttggtgaggatggagcttcagtagtggaagcaaggccaattgctgtgactgacctgtcagggattaacatttctgatcttcaagaggggcagctatcct

SEQ ID NO: 79165 - DNA, 672 bp, Triticum aestivum
  Clone ID: PAT_TA_79165
gtcgacccacgcgtccgacaatgacaaagaaactgagccagtgcaaggattttgggattggccgtgtgttaccatgacagaaaggaaggagtgcgattgcatgtccaggctacggcggtgctggccacggcctcctgcccctcgcgcgcggttatagggcaaggtggcacttggcctagactacctcatctacttcctctccgactcgagttcaccgcgccgcaaccgcagtggcggtgctatctcggtgtcggccacaattctctcaggggagtgtgagatggcaaaactgttggtttcttctttctaaaggaggagcagacgtgtgtcaggactgtagcagcatcgacaacagcaagattgatcacagtactgattcgtttgtcctagtgcctatcagccgtcgatctgcaatctaacggaagctggagtggcgtaccgcttcgcactcaagttccccatccccagcccacagatctccggatgaatggctcacgtggatgtaacgctagtgaatttaccaagcactgtaccttgctgaacatgtcgctatcttacttttccctagctgaacctctttttaacgtttctctggcttgtggagagggcattctagatgtatctgggctttgccccttaagccgttcggctggtgaaccctagctcgctact

SEQ ID NO: 79166 - DNA, 607 bp, Triticum aestivum
  Clone ID: PAT_TA_79166
cacgcgtccgcaacatacatggcatgatggatggagatcagtagatgtttttttgttctgttcacatgctttctaatagtttccataggattataggcatgagctttgagcaataggcataaatctgttgtaatcaatcaaaggcagtgagaacgtttactgaaatctttagaagtggggatcctctgaattgctttgattgaacgtccaacgaggatctcatcttatagtaactctgaaacattgtattggtagtttttatctttacacttttgccttctgtacatactggattgcattgtttaggacatgacacagcgctgcaagcagctcatgagagtagttagcaaatgccaatcattgtatatgtcacttatgcttctcttaatagaaaatagtactattttggagaagggcatctggctgactttcaataaaactcttcaggttttgtttggtgagattctcttcagaaaacaagatttgtattggtggtagattgacagcaactgacagcatcttcgtcatccgcggtggcagtgccgtccgcgcggaatgccttctgcgtccgcgcctccgccaccgacaccgccacgcagccaatgat

SEQ ID NO: 79167 - DNA, 431 bp, Triticum aestivum
  Clone ID: PAT_TA_79167
tcgacccacgcgtccgcacggtccctgcctgtcacgttcggccccgctcactccccagtgatcccactcccaccacggaatgccacctccaactccaagaaccaagcgaccggaagcggccaggctcctcctcctcaccaccttcctcctcctgctcctcacattcctcttcgcccagagcgcattcgccgccgacgaccaccacgacggtggtcaccacgcacgcatgctcctcgacgccaatgcggaggactccatctccggcgtgcagacggtgctgtcggcggccatgaccaaccagtacacctgcctggaggggttcgcggggccgtcggcgtcggaggacgggcgcgtgcggcccttcatccagggccgcatctaccacgtggcccaccacgtgtccaactcgctcgccatggtccgccgcctcc

SEQ ID NO: 79168 - DNA, 587 bp, Triticum aestivum
  Clone ID: PAT_TA_79168
gcgtccggcaaaagcttatcgcacctttgtaccccgagaaaaaaggaagaggaatgatgagaaacgtaagattccggttaatgtgcatgcctttacgtttgcggttttactttggcccctcggaactctattgatttgcacttctttattttgttttgatacgtggcttgtcgtttgttagcatatatttcgtaaaacttaactgaaagatgtgctggagatggactctcttgcacgtagccatggattgttgttttaacaggttaataaattgacttgaggaggtattggtgtcactactaatacattatcatagttctcacttttcctctgcacatgtagtcgggcatacattactgctaaaatgtttaaaacagcaagaatcagaccttttgtggtccttgattccagtcttcagtcccccatttaaacatttttttaggtggtgtatgcagattttgcaactaagctcaatagatatactcattcgcctaaagaattccagattatgaaaactaaaatttctgaatgttcctttgcgtgatcatgttttactctgttcttgcacttactgttacttctacaag

SEQ ID NO: 79169 - DNA, 208 bp, Triticum aestivum
  Clone ID: PAT_TA_79169
gacccacgcgtccgctgagattcctcccgtctcctgcccggcggttcgaatcgcgcctaccgctctcgtgatctggtctcgtcgagggcgcggccgtgccgggcgtcgcctgaccgccggccatgttctggaaggacagcagcgcccggagcagcagcagcagcggccgggagcagagcggcgtcggcccctttggccaggtgcgcgt

SEQ ID NO: 79170 - DNA, 443 bp, Triticum aestivum
  Clone ID: PAT_TA_79170
gacccacgcgtccgcttccaccttctccccccgtgacccaaacccactcccctcctggctcctccccggctgcgccatggccctgcctccccagatccactccctccccgcccgccccggccaccacccaccgtcacccgccaccccctcagcttccccgcgccatcggccccagacaccacccaccgcgacctgctcccgaccaccacccaccacgacccgctcctggccgccacccaccacgacccacccctggccaccacctacgccgcctaccctggctaccccctaccgtcgcctgccccactccaccccgtccggatccgctgatgggacgtgcatcttccattgtagttcccactcttgacctccagaaccagagtgccgtcccatctcctgacctccagcgccggagccccgcccccacctcgatcctgacctcc

SEQ ID NO: 79171 - DNA, 263 bp, Triticum aestivum
  Clone ID: PAT_TA_79171
tcgacccacgcgtccggaagttgaacctcccaaccttaacccaaaaaagttcaccccatctagaagagttaaggatactgcagacacttatctctgatttcatttgacccttccagaaaagtataagtattacagtaatttgtttttatacagtagaaagatcctcatttctattgagatttttttggtgacataaccatattgattttattttggatcctcatttgattgccgtgataaagtatgcagttatgccctactcc

SEQ ID NO: 79172 - DNA, 629 bp, Triticum aestivum
  Clone ID: PAT_TA_79172
tcgaccccgcgtccgaattcagcggttcttccttcttagtatcaatgaataggttgattacagaatatatttgaagattgcagcaggcacaaaatgctcggcaaacaaaaataattagctttgaggttgcctagagagagaccactctcgcatcattaggtgccgcccacaaggatctcccgcggcgaggcatgcacacctatgccacatcattacatgtgaccaggcgcataggagagctgcatacattttgtatggatgtatatagttgcactatactggtatgtatgtcagctgcagtagcttgccagttagtccttggtgaagatgcattctaacctataaggaggctggccaacttgcctccacagagctcccacgactgggccctttctgactgtccgatcacggtaagtttcccacctcttctcccctagccgttagatattgaatgtatgttttaccgcatttctctttccacacgtgtatgaccagtgggccagttcattggtgggtccgatgtttatttatttagtgccagacattgtgatttggaacattgcagagcaataattgacagaagtattagatgagtttgggcaggcatggttgtctatgtagtattttca

SEQ ID NO: 79173 - DNA, 491 bp, Triticum aestivum
  Clone ID: PAT_TA_79173
tcgacccacgcgtccggccgccttattgcaaatctcttctgttcctaaaggccccccaccccacccaaacgaagtgcaaaatgtggtgaatccatgctgcatgaaaaccctttctcacgggcacttcccgcaggagaaacaccagctcacccggtccacctagtcatagggcttattgagctcaagtttaagtaggaccgctggttgtttcctaactcacgtcacacactatttcatagagggagagaactaattccaaaatatgcctactcttaatagatgcagattggcagcttttgacgatgtgatgagctaagtgagccagtctgttagtgtagtacttagcaaccaacttgaacattacgtttagggcgaaatttcgtagtacagtcacccccttgaacatcgggagcagcaatgtcgaccatcccaagcacggaatcattcacaatcgcgcaaactatgtccttaattgttccccagagcttttt

SEQ ID NO: 79174 - DNA, 370 bp, Triticum aestivum
  Clone ID: PAT_TA_79174
ggtcgacccacgcgtccgggaggaacaggctctacgtggcggtcaactgggccaccacgctcgtcttcggcagggacaatacaaggatcggctgaactggcagtgggcggctggctggctctgtttcctcttgagtaaggcaaaggggacgagatgctggccttcaattttgcttaggattaccatttagtcattcacgattcgattcatttccaacgttgtgaaaaatacagagtacgcaacacttactcctagtacttttaagccaaaggtgcattgcgcattttcagagtaatatagataatctgtctaggctattttgcatcctgacatcataatgaccttgtgtcaacaaatccctacatggata

SEQ ID NO: 79175 - DNA, 204 bp, Triticum aestivum
  Clone ID: PAT_TA_79175
cccgcgtccggaaacgatcaaacagatagcttgggcagggacattgtggtcggtcctcacatgttgtttagctaagtgtgtgcggcgagaatgtgttggatttcctataaaatctgtcttgtttgcatgcttgctgaatgtaatgcaatgctgatggacgtgttaatgactcgtttctgaacaaaaaaaaaaaaaaaaaaaaaa

SEQ ID NO: 79176 - DNA, 705 bp, Triticum aestivum
  Clone ID: PAT_TA_79176
ccggtccggaattctccggtcgacccacgcgtccggcacctgacagcagtaagggccaacttgcccagctcattagttccatattggatattatctcaaacatgaggcatctgtgtgcattctatcagatggagaaactaactctagagttgcacaccctgttcatgtctagttctgacaattcaaaggcagtgctgtcccagtgcaaaccatcactagcttcatttatggcaattcttggccacttgaactccagcgaagatgattctaattcactttgttctgcaatgccggatttataccatctcttggtgagggaaaggcactgggcactcgttcacctagcaatgggctcctttggctactttgctgcccgcacatcttttacgcagctctggagattcgttcctggagatgctgccctttcatataatacaaatacaggggtggacattgacgagaacggattcatgttggaactgagagcctttcttcagaaagaggttgctttacgcgctgacaaatggtctgaagagcaggtctgttttctagtttcagaggggagagtgctgaagaaactagttgaaaaaacatctgaaattccacaagctccagagcgcgaggaaaaagctgccatttcaatggatgtcaacacaaagaagaggaagatgccagatggaatcggcaaagggatggcgctgctac

SEQ ID NO: 79177 - DNA, 626 bp, Triticum aestivum
  unsure (1)..(626): unsure at all n locations
  Clone ID: PAT_TA_79177
tcgacccacgcgtccgggacaaacttgccctggcaaaggtcagacggatgggaacatgacaggcgatggagatgattctgttttggatttggcctggaaaatgttgaatactgcaagggtgatagttgccaagagtccagagaagacaatggagaaggttaatatattgaatgctctagctgaaatctccatgacaagagaggacagagacaaatcaatcggttactacttcgaagctttagcgatcttggaacatttggttgggcctgaccattttcgaattgtcgatctaaacctccgcataggtttggcatccaaggttggagatgcaatcagatatagtacaaaggctatttcattatgcatgtcgcatatacataatctggaaattgccaaggaagctttgttggctgatatacataatctgaaaattgccaaggaagctttgttggctgatatacataatctgaaaattgccaaggaagctttgttggctgataaagaccttanagcatctgctgctaaaggacactcangaaagtcgactctggaagatgatatatcttaccttgctagaatgtcgtctcgagtccagaagaagcttgaagaactgaagcaagcaatgc

SEQ ID NO: 79178 - DNA, 438 bp, Triticum aestivum
  Clone ID: PAT_TA_79178
gaggcgcttgaccagatcaacgagcccaagaggccgtcagacaagcccctccgccttcccctccaggacgtttacaagattggtggcattggaactgtgccagttggccgtgttgagactggtgtcatcaagcctggtatggttgttacctttggtcccactggtctgacaactgaggtcaagtccgttgagatgcaccatgagtctctcctggaggcgcttcccggtgacaacgtcggcttcaacgtcaagaatgttgccgtgaaggatctgaagcgtgggtttgttgcatccaactccaaggatgaccctgccaaggaggcagccaacttcacctcccaggtcatcatcatgaaccaccctggtcagattggcaacggctatgccccagtgctggactgccacacctcgcacattgctgtcaagtttgctgagctg

SEQ ID NO: 79179 - DNA, 423 bp, Triticum aestivum
  Clone ID: PAT_TA_79179
ccgccagcccgcaatggagtcccggccgccggctccccgacgctcttcgcctccccgaaaggccgtatctcaccaccgtcacgtactcgccggctcttcgcacctccgaggtctcagctctcccaaagatcctctccaactcggagttcctcgcgtagggaaccggctcacactggcgtgcggaggcgaggcatgccgccgctcctccgaccagccaaccatagcggcgtggctcctctgacaagcggaggggctctcctctcccactggccgacctcgacttcgactcctacagctgcacttcgacttcaggtcacactagccagcattctccgtcgccaaatcttaaccacaccgagttccaccgacatcatcgtgaatctccaatcagataagtcagccttcatgtgtatcgccctttat

SEQ ID NO: 79180 - DNA, 326 bp, Triticum aestivum
  Clone ID: PAT_TA_79180
ggaccagtcacactcccctcttgactcttgtctccactccccgaggacgggggcaagaacgcgcgccccaatgcgccaccaccacctccccctcttcgtcctgctcgccgcgctcgccgtcagggaggccgccggcggcgatgcggacgcgctgcttgatgccaaggccgggctcgatgacccgaccggctcgctcgcgtcgtggtcgaacgccagcaccggcccctgcgcgtggtctggtgtgttctgcgacgcgcgctccggcgcggtcgtcggcgtcgacctctccggacgcaacctctctggtgccgtcccacgcgccctct

SEQ ID NO: 79181 - DNA, 336 bp, Triticum aestivum
  Clone ID: PAT_TA_79181
tcgacccacgcgtccggcaacgggcctctcttttttttgccttttgagaatcagcaacggggggctttgcgtgacgtctggaaggtgtgtgacaaggccggcctacaaccttggttagcaatcctttgcctatctgaaatcaacttccgcccagcccagccctttccttcggtcaatttgaaatcaacccacgagagagaaagctggcaagggcccaaatatacaagcgtgcttctggtctcttccttcgctctgccgtcaccgtcgccgcttctgctcgccgccgacctatggatcccacggcgccgcagcgcggaaccaagcgccccctgcccg

SEQ ID NO: 79182 - DNA, 633 bp, Triticum aestivum
  Clone ID: PAT_TA_79182
gtcgaccccgcgtccggtctatgattcctaccttcaaggccttggatctaaagttggacactttggatacgcaaccctagtgagccccatgcactttacacactacacgcccagacagatcccatccgattatactactcgtgggatcaccttgcagatcttctccttcaagattgccaagatcagtttggacctggaatggccactcctgcaatggccactcaaagtgtatggcgtcatcgccgcacgagacagtgtggaccgcaagcgcaacgttctcttccaccggctaagggacaacttccaagagatcaccgaaaaagactcctttttgtgcttgactggcccatctcgtgcaatctcagccgaatcccctcttgagtttgaagttgaactaaaactcaagggcggcgaagcaaagtctgaagacagcgtgttgatcaatagaaaaggccattacaatggttatgatacccataatggtttctatactgtcacttttgacaactgtctttgcacaaccgagttaagcctgcagaaactgtatagtggagcagtccaagccactttcttgcgtgtcggcattgttaaaggcagtcaaagccctttcagttatggaggcagagttgcttg

SEQ ID NO: 79183 - DNA, 549 bp, Triticum aestivum
  Clone ID: PAT_TA_79183
tcgaccccgcgtccggaacagagcactctatccacactttccttctctcctcacggtcacggacaaggcagcagtagcggcggctacagtttggatcggcggcggcgcgtttgagcaagcggcggcgacgcggtcgagggtaactgtactacctcctactggcagattctccatgtcggttgatcttcacatgtgcgcgcatttatggtcaacgaatataaagaggtttattggttgtttttcatcaactggttggttgcttgtctgtccactatatgtatagatatcccactgaagagaattaaacagcagcatttctctttctcccgtggagtactccagtgcctttcctttgagatcagttaaaatcaagatatcaatggcagacaatacatcagcagctagttcatcgtaaggcggacacaaagagccacagatggaccgacgactcctgaaagcagccgcatctggtgattccacatcaatggaggagatggcttcgcaagatcaaagcattcttcatgggaaaactccgcaagggaacacctg

SEQ ID NO: 79184 - DNA, 502 bp, Triticum aestivum
  Clone ID: PAT_TA_79184
gcgcagtcggcccagatcagagcttttgtcacccatgtctgcaagtggttcaggagactaagtcaagggagctagacgaccagcagggcgctgatcaggccgacctatagggctcggaggacagtctcagcgatgcaccaagcgtgctggctgcgccagccacctctgttgatcctgtcggtccatcgctgcctgcagacctgcctccggatgggcttgttgcgcgtgccttagctcataggcagctgttagaagaggtgcagggggattggccaagcggtgggcgccatcacctcagagacctgctgctgctgtattcaccaacccgtcatggttctcagccttggcacaacaactatcatctttggcctggcaacggtggaaatagcgcggcctccatcatcgcagctggtgtgagctccttcttcaaccatgggccgcccacctacgacctgcctcctctacctgctgctctgccgcctctacctctgtcgctgggatc

SEQ ID NO: 79185 - DNA, 376 bp, Triticum aestivum
  Clone ID: PAT_TA_79185
gacccacgcgtccgcaagaagatacctactacaatcctctttctctttctctttctctttctccctgcgccgcgacgtcctccgctccctgccctgtcttctcgcgcacactaaccaatccgagcgtccggcgacgcggctcccaaatcgccacgcaccgatcgggcccggcgccactggggttcccgtgccattgccccaatcgggaggcattcatctgcgcgccgctgccctgccccgtcgcggcggtggcggtggtggtatgatcagtagagggccacgcggcggcggcggcggcggcggagattagggtcttgggaagggggaggaggttatgaaggcgactgcgccgccggcgaagaggcggaggggcccg

SEQ ID NO: 79186 - DNA, 391 bp, Triticum aestivum
  Clone ID: PAT_TA_79186
gtcgacccacgcgtccggtgggcgagcacgcacaacggcacgctcgccggcaagatgtcggccgtggtggacgccctccacgcgtgccagcaggcgccggccaacggcggcaccggctacctctccgccttccccgccgagttcttcgaccgcttcgaggccatccagcccgtctgggctccctactacaccatccacaagatcatgcagggcctcctggaccagtacatggtggccggcaacggcaaggccctggccatggtggtcgccatggccggctacttcggcgagcgcgtgaggagcgtgatacagcggcacagcatcgagcggcactggacatccctcaactaggagaccgggggcatgaacgacgtgctccaccagctctacg

SEQ ID NO: 79187 - DNA, 338 bp, Triticum aestivum
  Clone ID: PAT_TA_79187
tcgacccacgcgtccggcgggccgagctcttcctcaagacagcacagccaccggggcgaggacggtggggcaagggccggttcgtggtctggtggcggcgtcgatcacggacgtattgttttttgaggaggcggatgcattgttcaattccttgtggaggtagcatcgtggggttgtctagctcctgtgcgggggcagtctgccgacagaacattttttcttaaccgttgatctaatttgcagatgtttgatgtaatgtgtgtgcttggatgttattaagtgggtttgatcgaaaaaaaaaaaaaaaaaaaaaaaaaaaaaaaaaaaaaaaaaaaaaa

SEQ ID NO: 79188 - DNA, 161 bp, Triticum aestivum
  Clone ID: PAT_TA_79188
ggacgttggagcttcgccgcggttgcaatggagcttcgccgcggctgcaatggagtaccatcggggacgtcggagcttcgccgcggctgcaatgaagcgtcactgggatgcaatggatcaaccggcgtcgacggtgcttcaatggagttgccgtggagctt

SEQ ID NO: 79189 - DNA, 306 bp, Triticum aestivum
  Clone ID: PAT_TA_79189
gacccacgcgtccgaaattccccactacaaaccctaccgcgtgcccccttccgcacggcggtgacatgccgccggcgaccggctccgcggccggcctcgcggcggccgtcctcgccgcctccgcgccgcgggccgcggcggaggctgtctcgtcggtcgccgacttcctccgccgccaccactccggcgcggaccagccgcgcgccttcttcgccgacgcgctcccggcgctcctcttccgcctgttcgtctccagttcccccgcctcgccgtgcttcctcgacttcgccgctggcgaccccgccc

SEQ ID NO: 79190 - DNA, 174 bp, Triticum aestivum
  Clone ID: PAT_TA_79190
gccctaaagaggaagttatcaagcaaaatacttcaaattctcataaatcagaatgcaacaaaaatgatccttatattggagatatctccatggcggcccagaaggaacctttgatggatgaattggtagccggcgatgccgtacaaaaggaaaatattattcaggaagatatga

SEQ ID NO: 79191 - DNA, 575 bp, Triticum aestivum
  Clone ID: PAT_TA_79191
taccggtccggaattcttcggtcgacccacgcgtccgcaaagcaataaggatagaagggcaatggaaggaagtagaagaacggaaggtctgcgtcatgaaggaatatgcagatataagagaaggtattgaggtacctccagaaacactggataaaggaatggatttagagggcactggaatagatttcgcgggcaattattctttggattttggaagttgctcacgcaaggaatgtaaagaagaactgaaaaccacagaacgaaatggtaacatcatgaaggaatatgcagatataagagaacaaggtattgaggtacctgcagaaacactgaatgaaggaatggatttagagggcactggagtagatttcacaggcaattattctttggatttcagaagttgctcaggcaaggaatgtaaagaagaactgaaaaccacagaagggaatggtagcgtcatgatggaatatgcagatataatagaagaaggtattgaggtacctgcagaaacactgaatgaaggaatggatttagagggtactggagtagatttcacaggcaattattctttggat

SEQ ID NO: 79192 - DNA, 682 bp, Triticum aestivum
  Clone ID: PAT_TA_79192
ggtcgacccacgcgtccgaatttagttgtcaaatctgtctactattgcctttttggttcacaattagtttccaaatttagtacttaaatgatgctaattttgctgtttgagtaatcgtgcacttgtgataaattcgctatgtttcaggggtggttcatgatcatccattcagaccaaaagcatgttggtaagttgcattcagtttatggtgggaaagatgtattgccatagggaagctacaaaattgaacacttacaggtgcatgggtagtttatttgagttataggtgatggtgctataaggaaagcagtgcttgttgcaaaagctagggagaaggatgtaggacaatcacactctgttgtaccaagatttattgaggaaaaatgttcagttgcaaaggcactgcaaaaatgattctcttctgaccaaacatctacaagtattgttcatcttttactcatatttgctttgattgtgttacagatcctgttgatgctttgcacataaactgaaccatttgttgcactgtagttggtatatgtcaagatgggataggaaatacccaagagcttcttgcttttcatgatgagccaatggatggtagtgatctggtaagtagtgcttatgatccgcaattcctctatgcaaactattcttacgttgaatttcacaagtatatcta

SEQ ID NO: 79193 - DNA, 189 bp, Triticum aestivum
  Clone ID: PAT_TA_79193
ccacgcgtccgcaaaagaattacataatctcgaaacaggctctcacccgctttataaccaactagcacatgtgcccgtgcttgcaacggggaaataaataaatgtgtccttcaaaacgcccatcggtggcatgacgaggtgtagaaaaaaaaaaaaaaaaaaaaaaaaaaaaaaaaaaaaaaaaaaaaa

SEQ ID NO: 79194 - DNA, 401 bp, Triticum aestivum
  Clone ID: PAT_TA_79194
gtcgacccacgcgtccgaatcctccctgccaagcgagccccagaaagtttccgatcgaatcgaagccaaggctttctcgtcctccgagatgcagatctttgtgaagaccctcaccggcaagaccatcacccttgaggtcgagtcctctgacacgatcgacaacgtcaaggcgaagatccaggacaaggagggcatccctccggaccagcagcgcctcatctttgctggcaagcagcttgaggacggtcgcaccctcgctgactacaacatccagaaggagtccaccctccacctggtgctccgcctgcgtggtggaatgcagatcttcgtcaagaccctcaccggcaagaccatcacgctcgaggttgagtcttcggacaccatagacaacgtcaaggcga

SEQ ID NO: 79195 - DNA, 423 bp, Triticum aestivum
  unsure (1)..(423): unsure at all n locations
  Clone ID: PAT_TA_79195
tcgacccacgcgtccggggactctgcgcagagaagagaccccatgttcaaacatctntttggatcacataatttccaaatacatcagtcatcaacgatgaagcatgaggaaggatttcagcaaacactaaggccttgtcttcagtgttgccattctccagcttctgctgaatgaatcgactgccattttggaaattatgtgatccaaaagatgtttgaacatggggactctgagcagagaagagaccttgccaaaaagcttgctggtcatgtgttaactttgagccttcagatatatggttgccgagtatttcagaaggcccttgaagcaattgagcttgatcaaaaaatagaacttgttcgtgagcttgatggacatgttctagaatgtgttcgcgaccaaaatgggaatcatgttatacag

SEQ ID NO: 79196 - DNA, 689 bp, Triticum aestivum
  Clone ID: PAT_TA_79196
tcgaccccgcgtccgggtttactagtcatgcttgtgtttttatcctattattctgtaacaccaatgcagactgtttcttgttcctgtattagtatgctcagtagattgatctattcatgtgtgcactatttccgaaagcacccttttgagcttgagctcatttgagctcggattcggaatttttttaaaaatactcaaaaaaaatctgaattttttcgtggtatactttgacaaatgttccaagtgtttgcacattttcatcatgagatcaggtgctggtcgtagatctacatgacctggatctctggctaggtgtctaggaacgtcgaccgtcatgccctctggtacggtggtgctgatctgaatgccctctggtacggtggtgctgatctgaattaagtccgtctgtcttcagaaattgtactttcagttttacaccatggattcccgcaaaaagaaaaagttttacaccatggtgtttattttcttgggattttccatgaagtgtgagatcccaaaaacttgcttaacagtgtctcttgttcttaaaatggaataatcgaagtgcacactgggatctcaagcctgaacttgtatttccgtcttgttaaatttgatccgttaatacatatctatgaatatgcaaccctttttggttcaatttgcacttatagttattttttaaaggg

SEQ ID NO: 79197 - DNA, 710 bp, Triticum aestivum
  Clone ID: PAT_TA_79197
ccacgcgtccgaaacaacactgttaaacagcgataggaaatgttccacccacagtatctccaaagtaccgcgatatttacattactacgtagagctacagagtactcctacattgaaaggaaatgaaggctggctcgtagtaccagatctctttgcattggtgcaccttgacatttatgattcgttcataggctccagtgacaacaggcctaaacatttggcactgccctgccgagtttgccaaccaagaaaactcagttcttaccgtagggagggagggctggggtagtatgtctcgtcatcgtgggatcgtctggatgcgatgcatgcatgttggaagttgccaccaaccactctgcccaggcaatcaatataggccaagcagtgggcagcagcccagtacacggtacacacgcgcgcaccacgtagtacaaaaccactctcgtctgccacgcatgcacacactctcttctctctccgcagtaaaagagcagcaggctcgcgttttagtactgtccactgttgcacgtagtacttgtacccttgtcacgatgcatttacccctccacatgcaacaactgtggcgctccacagaccgtgcatgcaccttcgtacgtcttcgtgtgcgtccatgcatgcttcgttgcagctacgtgtaggccgtggcgtgggtagaggcttgggttggggttggggggtcatgcatgcaa

SEQ ID NO: 79198 - DNA, 422 bp, Triticum aestivum
  Clone ID: PAT_TA_79198
acgcttcgtccagggggctctggtgacagcctaggcgacctgcggatgccgcccatggcggcgggggcgccggatctggcgctgggccacgcccagcgggaggaccggccagtggtgggtggctactctggacaggagtggagcaccttaagaagacgggggagggagatccttcgccgtgctcgtgatccggaggcttgcctgcgtcatatgcgggataaagtgagtaagtttttcaattcagagctgggcaagggggatttgaaggtggccatggctgggatgaccggcgcggtgacggaggcggagttcacggcctctgattttgccatgaaagatgcggatccggcgagtaaaggggcggaagaaactgcactttccctgtgcgttaaatccaatttgaccctggttaaggaggggct

SEQ ID NO: 79199 - DNA, 580 bp, Triticum aestivum
  Clone ID: PAT_TA_79199
gtcgacccacgcgtccgatcatatttcacttgtacattgcctggtaagtgttgtttgttgtctaatcttgccttctaatcaaaggatgataaatgcagcaaagttaactcggaggtaaactggattagctctgttagacaacatggtatttgacaaaaaaatactttatatacttgcagtctatctaggaacattcggctcgaggcatttgggaaacactttaatgagatgataagtatgatttagcatctcctgtatgcgatccagatggatattgacgatcgaggatggtggtccttggagctcttctgacgccccaggtggagaccttcacttagaattacagcgctttgatgatcttcaattgcatgttttgttgccttttatttccatgtgtttttatttacttcgggcaccgattgtttgaatactttactttatttcccctttcgtattgcgtggctaaataacttttgcgttgtggggctaaatcaccctctaataatttcatgattgtgtgcatcacgaggaatgtggtagcacccaaacaggttgtagcaaaaaaaaaaaaaaaaaaaaa

SEQ ID NO: 79200 - DNA, 451 bp, Triticum aestivum
  Clone ID: PAT_TA_79200
gtcgacccacgcgtccgcccacggtgcgcccgtctccgcgtcctacgggctcctcgggaacggcggcgccgccgtgcccgtcgcgcccgtcttcaggccgccggcgagccgggcgcgcgccgagccgccgcgagccaggagaggcgcggggccggccgattcggcgccgcgtgacgaggcctccaggccggcaacccgggcgcgccaggagccgccatcgcccgtgcaggttaggaggagctcagagtttgcccattcaggcccccagaatgaggggtactccgactctgacgacgactcccggcgctccgtgtcgcgcgagtctgcgccgagttaccagggccagagcgacggtggcaggcatgccatggctgcgccggaggggaggaggtctcatgtggtgaccttcgggctggcagatgatatcaagtatgaccagagcagcgagctc

SEQ ID NO: 79201 - DNA, 233 bp, Triticum aestivum
  Clone ID: PAT_TA_79201
acccacgcgtccgccagtgtgttaccagcggaggctggcagacgaactcgatctccactccgccgccacacccaatcccaggcgcccccgccgcgcccaatcccgatccagcagcgcagggcggggggaggtcgcggcggcgcggctcgatcaggctggcctggctcccgctccggctacccctcccgcagccagctcgggttttccggccagcaccgtgtttctgagagatg

SEQ ID NO: 79202 - DNA, 509 bp, Triticum aestivum
  Clone ID: PAT_TA_79202
gcgtccggacaactctgacacaacacatatatcgcaaccaacaggtgcagaatcattttccagtcaggatttggatgtgtgtgtcattcaatttcaatctggataaggtgctagaacagattgaagtaggtactcgtccagttgaaagtgaaaaggagggcagtacaactgaaaagttgattgaagaaagattgaaatctaaaaggttcttacttgtattggatgatatatggcagattagtgatgtgggtgactgggaaaaactcctgtcgatactcaaccaatcacaagaaaagggttccatggttctagtcacaactcggtttcgagcaatagcacaggtggttaaaacaactggccattcaatagaactggatggtttaaattctggagagtttagaaagttgtttctcacatttgtctttggcgatgagcaatgtccaagggacaaacattttctgcttgagaccggagataagataatggaaaaactaaagggctcccctctt

SEQ ID NO: 79203 - DNA, 678 bp, Triticum aestivum
  Clone ID: PAT_TA_79203
ggtcgaccccgcgtccgaggccggcgcgctcgaggtcgtccgcctcctcctcccgctctacgacctcgaggccgccaagctccgctcccgcctcgacctcgacgccttccacgtcgccgccaagcaagggcacactgaggttgtcaaggagtttttggggcgttggcctgagctttgctcagtgtgtgactcgtccaacacttgtccactgtactctgctgccgtaaaagatcacttggatgtggtgaatgctatattggacactgacgatagctgcataaagattgtgcgaaaaaatgggaagacatcactacataatgccgcaagaatagggtaccatggcattgtcaaagcactcattgagagggacccggggattgttgcagtcaaagataggaagggacaaactgctcttcacatggccgtgaagggtaaaaacatagatgtggtggaagaattgctgatggctgatgtttccatactcaatgtgcgtgacaagaaggcaaacacagccttacatatagctacacgaaaatggaggccccagatggttcaacttctgctcgcctatgattcacttgaagtcaatgctatcaatagtcaaaacgaaacggctatggacttggctgagaaagttccctatgcggagtctaaaatggaaatcatcgagtggctatc

SEQ ID NO: 79204 - DNA, 603 bp, Triticum aestivum
  Clone ID: PAT_TA_79204
gtcgacccacgcgtccgcccacgcgtccggtggcttcccctccccaatccccgtccattcgcacccccttcccctccggccacactcccccgctagccagtcattgaccgtgccggtgatccccggccaaggaagggatggcgatggaggcggcgataatcggcgcgttgctgaagaccgcgctgccgaaggccgtctcggtgctgggcgggagcagggatgtcgaatccatccagttggagctcagttacatcgaggccaccatccgagaccaccgcaagaagaccggcggcaaggacacgagccacctgcgggaggcctggatccacgacctgacgcgcttcgcgttcgacatcgaggactgcgtcgaccgcttcctgcagcaggtgtcggaggacggcgaggcgggcttcctccgccgctccgttcgctccgccaagaacaccgtgtacacccgcacggtgttctcccccaagatccgcaagctcaagaccagatccgaggagatacaccgccggctcaagcgctacatcgaggaggagacgacgggggtgacagtgacacccgacggcgcggcgtcgatccccaccgcaggggcgcacg

SEQ ID NO: 79205 - DNA, 546 bp, Triticum aestivum
  Clone ID: PAT_TA_79205
tcgacccacgcgtccggttcattgtttttattgaagagagatgggccggtccaccaccgatcgcttcgccatggcgcagtacctcctagtggctctcatcgtcgtcgtcgtcgcgagcaacagcaagcacgaggcagtcgccgccaatacgcttttcgtcgtccagctgcaaggacacggccccgctggccacaagatctctgtgcccttgcggaaacatgacttcttcctcaccggctgcaccgacgggagcggccattgtcaggccttcccaggccacgagcacctgtttcctgcgtccacgaccctccctttcgccagaagctaccgccagcacatcgacggcctcctgaacctaccgtgcgtgcggctgagtagggacgccatggtgcacgcgaccccggttctcccagcctacgccgagctggcggccatgaaggcgatgctatgcgaggcccagcttctccagtccatccgcgagacggtgaccggcggatggatgaacgggatcatcgtcgcaccccagcacctgcatgccctacatcg

SEQ ID NO: 79206 - DNA, 475 bp, Triticum aestivum
  Clone ID: PAT_TA_79206
gaccccgcgtccgctcagcttaacaaaaaaaaaggccccagccctcctctcccgcgaatcgtatcttaccccggcgactgctcgcagcctcgcagcctcgcagccaccacatacggcgcccgattccggctgattccggcgactcccggcggcgcgcaacaaacccacgacctccccttgctccgctgcttactcccatccgtccagctccgcggcgcacggtctgtcgcgctcgctcgcgaccctaagccgtgtttcgggcggggcgtcgccttcgtcgccggcgaggctccggcggactccggcggctcctctccgtatcctccctcgcccccacgcgcgtctcctcttcctggaacgcgctcctgcgcccggtggccatggggcgcaggggcgcatcgggctgggcctcctctgcttccgatttggggcagcagccgcgagtctccatggacgaggaggacgaccgggaccc

SEQ ID NO: 79207 - DNA, 437 bp, Triticum aestivum
  Clone ID: PAT_TA_79207
gacccacgcgtccggaaccggtgtgcatgctccaccggcggcaccctctccccgccctgctccgcctcttctccaccacctgccgccgccgctcccgccttccctcgcagccgcatcccccgaacaccgacaccctcccgccgcggcctgtggcgaagaaagtccccttcaccgtgtcggcgcacgggaggtcgtggagcgacccctaccactggatgcgcgacacctccgaccccgacttcgccgccctcctcgccgccgagaacgcctacgcagacgccttcgttggtgctgccggaggcggcggcctccgcgcgcgcctcgctgccgagatgcgcgcccggctggccccttccgccgtttccccgcctcagccctggggcccttggtcatattaccagtatgtgccaaacggaatggagtacccagttttgtcc

SEQ ID NO: 79208 - DNA, 433 bp, Triticum aestivum
  Clone ID: PAT_TA_79208
tcgacccacgcgtccgctgcaacgttgccgaggctggctggcaacgcaaggcaggcgactaacttgttgcagcggacggaatcgatggaagctgcgaagaacgaggacgcgggtagcgcgggtgaggaggtgatcccagcctacaagaggaggggacggccacagaagcttttcaagcacgacgtcgatgaggaagaggatgtccccaagggtgaagacgacggcgactgcacaaaataagagattgcgccacgcagggagtcgacgggcgcagctgggaacggagggaagaagaggcggcgacagtcgaagcgcggctcggcgtcagcgacggaggagaagggcggcgcgccagcgagggcaccgaccggattccggcacaatgggagccggcggaacaacacccctcagagagctgcggaggcgggggtgg

SEQ ID NO: 79209 - DNA, 598 bp, Triticum aestivum
  Clone ID: PAT_TA_79209
tcgacccacgcgtccgaaggcttgataccggaagtggtgtccggtgtagcaaagcggttttcagatcgtcgtttctccggaacagcaagattgttccttgaacacaccaagagggtaactgccatgattactgccgtgatcttgagtaccagattcttcgttgcagttactcgccaatgcgattgccgagctactcttcagttacagtcagagcaatctttgtggcatcagggacatggtcaggtgacggcgttggcttgtcttataaaggcagacttcgtttcttgcagctgatgagattcaagttgctgcttttgtagcgaagcacacttcggttcctgcttttgtagcgaagcagatttaagttaccgcttttgtagtttactccaacacaaatttgaaactagcatgttcttgatttgttgcgctgatgtagtgatgttcttgcgctttcttgtgcaagtatcgatttttgctttctctgtcacaagctattctcaaaactaagaattctttgaaaaaattacacatgtagtagatgttaatgtgatatgtacactttgcatttcttctaaagtaatacacattttgtgtgaaa

SEQ ID NO: 79210 - DNA, 441 bp, Triticum aestivum
  Clone ID: PAT_TA_79210
gtcgacccacgcgtccgcacaccggtctccagcgtcgacgccttcgacaacttcagcacgaacatgcactgggtggtggagcccatccccgtcagggccgccatgcctctccttcgacctccgactagggtcaggcttcccttcacccgaagagtcatcaccgtgttgccgatgccgtcgcgggtgatcgtgtacgtgcgggcgggcgccgacgggagccgcatcgcccgcggcgccttcgtgttcgaggggaactccgtgttcgacctgagggaaactctgatccgccgcctggaggccaccatgggcgtctccgacgtcgccatgtgcgtcgaagcgggtgctttcgggcggcctaccccactcgtcgtcgacctgccccgcagccgccagaacctccacatcctcgtcttcgcgggcgggacgccagcccacgcgggg

SEQ ID NO: 79211 - DNA, 576 bp, Triticum aestivum
  Clone ID: PAT_TA_79211
tcgacccacgcgtccgcccgcctctaccaggtcggggagcaggatctggcgctggggttcaagttcaacgccaagggcaccatcgactgctacgagggagagatggagctgctcccggagtcccgggcgcgccgccgggagatcgacttcaacatggtcgacggcgatttcaaggtcttccagggcaagtggtctgtccaggaggtcgatgatgctactgaaggtggggaaatttcatcagggcaggaatttcagaccacgctttcttatgtggtggagctagagcctaagctctgggttccagttcggctactggaagggaggatctgcaaggagatcaaaaccaaccttatttgtatccgagaagaagcagagaaggtccaaaggttactggacgagtgataactaggatgaatcctgaaggctttcttacaatgccgttcttgattatagttccgtgtccgctacttaacagagggaatcagataaacaaaaatcagcatgcttcttgcatcgaggtgatgtggaatggcccccagttgtgttgacatggctggataaccaatggagggacct

SEQ ID NO: 79212 - DNA, 558 bp, Triticum aestivum
  Clone ID: PAT_TA_79212
tcgacccacgcgtccggaacagttttcacagcgtgcagttgctgcccagctggaaaaggatcagctcatgttaaagctcgattcagcacgcaatggaaaatcgtgggatgatattgaaaatgccggtagtgagcaggatgtggaccttatgaagacctatatatcgaagattcagcagttggaggctgaagtaacacggcagaagttctccactgcctgtagaaatggtttgcatgatcgacttgcactggataagggcatgcttctagacgatctaggttcaggttgtgaagtaggaacgctcgaagtgtcaagtgaagttgatgaagaagaaaaggaaagagaacattcatccatacaggagaaactggatatggagctgcaagatctagataaaagacttcagcaaaaggaggctgagatgaaacaatttgcgaagagtgatacctctgttctcaagcaacattatgagacgaagttacatgagatggaacaagaaaagaaggcttttcagaaagaaattgaggatctccgtcatgcactagcaaaaatatcttc

SEQ ID NO: 79213 - DNA, 529 bp, Triticum aestivum
  Clone ID: PAT_TA_79213
ggtcgacccacgcgtccggagaggatcgggactgggcgcgacggcggcgacgccggagcagtcgccagccgcgcagccggcgggcggcgccaggacgcgtgggcggagccacgatcagagcggcccgccatgccccacgaacggacgcgtcggcggcggccctccccacccctcaagctccggccttgcgcgccggcggcccgagacgagctcgaaggcagcggcggcgaccgcacctgctgcgagccggcggcaggaccccgctcgtggggggctgagccaccggcccggccgggctgggcggtgcggcagggagcgacgggaggagaggggagcggctcctcgtccgcgaggtcagcccacctgacgcgaaggacaggcgcgggggcgggcgaggagggcggcagggcggcagacgctgccggagccggcggcggggaggggagcgcggtggacggggaggcgagagggccgacgaggggagcgacgggagccagcaccgcggccggggccgcgtcgccgttggcgt

SEQ ID NO: 79214 - DNA, 611 bp, Triticum aestivum
  Clone ID: PAT_TA_79214
ccacgcgtccggttgaaatcaattttgtgggctccttattcacgtgtcattgtctagttgactttcttcttgacaccgctagattttttgattgtccataagctaaacgaacgagttgtggttcctggactcagggttcaactaaactcagccaaaacaagcttcaactctcttcttcttctttcttgaggataaatctcttcttctaactcgtcttgccatagtgatggaaggaaatgaatagtagatggcaattaatttttgctactatgactattcacatctgggaagactgaatcatttgctagctaagcttgagcgtgcataacaatgaagccaaaagatggccttaactgaggaaaagaaagaaaaaaaactacaacgggaaaatctgtcacatggagagtcatttaacgctgcaaaagaacaccttgtttgcctcccaatcccatgtattgtggctggaattaaggaatcggatttctgaaaattcaagggttttggctggcactgaaattggaatccctgattccatcccaaaatccactgatgcatttcacagcgaattgggattccaaattgtaacttagttatttgcttcgactcgcaat

SEQ ID NO: 79215 - DNA, 327 bp, Triticum aestivum
  Clone ID: PAT_TA_79215
gaccccgcgtccggacccgtggtgtctgagttgttgggcgaagcttttcttcatgctctcggcttccttatcctgccttccccttctcccctccaactgctagatctagagtagccccgttaaagcccagacaaaaaccccgctgcgagatctgcgcatctcgccacaccacaaccacaacgggcatggcggcgccgcgcgtcctcctcctccttgccgccgcggccctcctcaccgtctcctacggcggggacgcttcgggcgagggcccccgcgggcgcaagctgctggtgctcgtcgacgatctggacgaccgctcatcccact

SEQ ID NO: 79216 - DNA, 471 bp, Triticum aestivum
  Clone ID: PAT_TA_79216
tcgacccacgcgtccggtttggagctagcgatctggcgactttaagataatcaaaccggaagcgcactactatcctggtcttgtggtgaagaagctagaccccaaggaggacagcaacggggcggagcagtgctccctgtcgctctcccttggcctggacccgagatgcttccgtgccgccgtctcatcgtcgtcgccgagcgaaggcagctgcatcatctcgtcgtcgtcgccgccgcccccgaggaggaggagctccagccactactccgggcactccggctgcttcgacgcccagggcatcaacttggagctctccctgtccatctgtgggtcgtagacgactggccgaaattttgtgcatcgatctgtctgtccgtcactcgtttggtgcatggtgttaggatgattaggtaatggcaggttgttaggttaggattaggagttcagtgacgtttattagagttagca

SEQ ID NO: 79217 - DNA, 343 bp, Triticum aestivum
  Clone ID: PAT_TA_79217
cacgcgtccggcgtgcggttcccggtccctgtacgtcctgccccaccactccggcggcggcggcgccggtggcgttgcaccatcctggtgccacgagcaatggtgaggagccgctctcccaagggcggagatgacggcaggcgacgaagcactcctaggagaagttctgatgagcaaggaggaaggaaggaaaaaggtcctataagcctcttggtgcgtaacatccctcataactgcagatatgaagatcttcgagttccttttgcaaagtttggtcctgttcgggatatttacatgccaaaagattactacagtggggagccaaaagggtttgcttttattg

SEQ ID NO: 79218 - DNA, 329 bp, Triticum aestivum
  Clone ID: PAT_TA_79218
tcgacccacgcgtccgcccacgcgtccgacaaatcgagcgagcaccaacctgcccgccccaaccctagacgccgtcgaccgccgccgtccccgacgtcgccgccgccgccgtccacgacctccgcgagggatggctcttgggcggcttgcctccagggtgcgcggctcggctctgcaggtgcgggctgcggctccccgcgcctcgccgccggcaccctgcccatgcgttcgtccgatgacctacagcagcaagcccgtgcagggtgagcagcagggcaagggaccttcaaggccaattgacctcctgcgtgagtccaaatggaggaatg

SEQ ID NO: 79219 - DNA, 730 bp, Triticum aestivum
  Clone ID: PAT_TA_79219
ccacgcgtccggatgaatgatatactgcgtgctgagtatacagaggaggaggtgaaacgggccttagacaacataggtgacctgaaagcaccaggacctgatggtatgccagccatattctttaaaagattttggcaaattgttgggaaccaggtcacaaaggaggttcttcaaatattgagaggaggagaaatgcctgaagggtggaatgatacgctaatagtattaattccgaagaatgccaacccagcaagcataaaggatttgagaccaatcagtttgtgtaatgtggtgtataagctggtctccaaggtaatcacaaacaggcttaaggtaattattcccgacatcatctcccctaaccagagcgccttcgtgccagggaggctaatttcggataatattcttttggcatatgagctaactcatttcctgcagaggagaagaagcggcttgatgggctatgcagctgtcaaattggatatgagcaaagcctatgatcgtgttgaatggacatttttaaaagatatgatgcaacggctaggctttaagcggtgttggattgaactgataatgcgttgtgtctcaactgttaagtaccagatcaaggtgaatcacgacacaactgaaataattacacctcaaagaggcttgcgccaaggagatccactctctccatacttgttcctcatatgcgcagaggggttatctgccatgttacatgaagctg

SEQ ID NO: 79220 - DNA, 519 bp, Triticum aestivum
  Clone ID: PAT_TA_79220
tcgacccacgcgtccgcctagagaggtcaaagactcccaaaccagaccagagtgagaaaccaaagcgaaagcggagaaggaacaaagagattgacgaggacgcgcagcggcagccaaatccaagaccgcattgctcgctcgcccgccgccgtgcggctgcgacgctcctccggggaccccgcgccattctcctgccggccatctctggtgctgcgccgtggtcccgaggtccccaccgacgctgggaccagcgcccgcggctggtggcgagccccactgatggccgcttgccgcgcgccggcggccaacggagcaagtgttggcgttcctgttgcggcagagcagagggacggcggggtccgcgcgaggcaggccgggcgcgccggctctcgctgcgcctagggaggcagcagcgtccttgctcgtcttttcgtcgccctctctccccccgtcgaagaagctagggtttgctcgttagggttccgttgggctgtggggctgcggggatggcggtggggg

SEQ ID NO: 79221 - DNA, 461 bp, Triticum aestivum
  Clone ID: PAT_TA_79221
ttttttttttttttaccggtatggcagaaaattttccaatgcccataaactctctccaacaaatagcagacagtcgattttcacaacagaaaaaggaaaaaaaaagactcggtaaactgagttttggtatagtttcttcccgtcgggccagccagggaaggcagataactcaagaggatggatggatggatacgatttcccaatggagaagacagcatcttattcagcaaactgactgctggtatgctctccatcaggccagccagggaaggcagataactcaagaggatggatggatggatagcagctgcgccactaggagaaaatatacaatgggtgaagtttctacagccagagagagaaagcaaaatgagtccagaatggcagttcaacataaaatgagggttgcaattgtacaccccactgactccacccgggccacacatgactcttgactcatg

SEQ ID NO: 79222 - DNA, 680 bp, Triticum aestivum
  Clone ID: PAT_TA_79222
ccacgcgtccgctcacacactccgccctcccctcccactcccgctcccgctcccgccaacttcaaaccgccgccaccaccgcccgccgccgcctccctcccgctcccgcccccgcgcagtccgccgcagcgaactcctcgccggggacggcatggcgtcgcacggctcgcaccccacgctgctcgagcacatgggccggaccggcgcgcccgccgacctcgccgtcctcgtcgcccacatccaggccgcctgcaagcgcatcgccgcgctcgtcgcgtcccccggcaacgccgacctctcgcgggccaagccggccgctgccggtgccgcgtccgcggccgggcgcgacgcgcccaagccgctcgacgaattgtcgaacgagatcatcctgtcgtcgctccagagctccggaaaagttgcggtggtggcgtctgaagaaaacgatctccccgtttggttgtgcgacgatggtccctatgttgttgtcaccgacccgcttgatggttctcgcaacatcgaggtgtcgatccccactggaacgatatttggaatatatgataggctggtggaactcgaccagcttcccgtggaggagaaagctcagctcaattcgctgcagagcggttctcgcttggtcgctgctggatacgtcctgtattcatctgccaccattttctgca

SEQ ID NO: 79223 - DNA, 614 bp, Triticum aestivum
  Clone ID: PAT_TA_79223
ccacgcgtccgagctgaagcagctgacagtgctgaacctttcgcacaaccacctcgccgggatgatccctccagagcttggggaaatccaccggatgaactcgctggatttgtcggagaacgagctctccggcgaggtgcccgtgcaactgcagaacctcgtgctctctgctttcaacctgtcgtataacaagctcagtggacctctgcctctgttcttcagtgccactgccacgtaccagcagagcttcttgggtaatcccggcctgtgccatgggatatgcgcaggcaacgacgaccccggtgccatcccggccgccagagtccacctgatcgtctccctcctcgccgcatccgcgatcgtcctgctcatgggtttagcatggttcacctacaagtacagaagctacaagaagcgtgccgctgagatcagtgctgagaagtcaagttgggacctcacgtccttccacaaggtggagttcagtgagatggacatagtgaacagcctcgacgagaacaatgtgatcggcaagggtgcggcagggagagtatacaaggtggtagttggacccagcagtgaggccattgctgtcaagaagctctgggcaagcgatg

SEQ ID NO: 79224 - DNA, 478 bp, Triticum aestivum
  Clone ID: PAT_TA_79224
ccacgcgtccgcgctcacagccacccacaatggcggcggcgtgaccaacctgccgcggagagttttgccagttcgcatcttgttttccctaccggtagttcggattcttctcctctctcccgcagaggccgcagtttttactccaccccctcacctgtggatgccatcgagaggcacgccgagaccacgggcggcctcgacagcaacgcgctccctcccgctccgctcgtcctcgtcgcgcgcgcgtgatgctcgccgtctgcgcgcggcacgggcccgccaagctcccgctcccgccgctcgcgggcgaacgtgccgcctgggtcgccgccggccggtggtggtgctggcgccccgcggcggcgcgccgtggcgtcgccgcgcgggcgtcgtccttcaattcccggatcgggctcgattcccagaattctcacacaagggacttatcccagctgttgtgggtgggtccagtgcctgg

SEQ ID NO: 79225 - DNA, 378 bp, Triticum aestivum
  Clone ID: PAT_TA_79225
ttttttttttttttttttttagcatagcatcagttcagtgagtaatacgcaatgagatctttttttttcatacgtagtgtttgcagcgacgttctaaaccttggtgggaaagttatcgacagggttcagtacctaacgtaggatgtagagtgcagacacgtacgacgagagttagtcagtcagacagagagacggcagaatctacaattgccagctggtacgttcccgcagaccagctcgtgtggcgtggggtggcaggtccggcggggttccttcacagctggggagggggaggggggtaccctggtggcgcccaggcgtgctggggcggttgtggcttgatgccccgggtgcgcatgtattccaggaactgcccag

SEQ ID NO: 79226 - DNA, 743 bp, Triticum aestivum
  Clone ID: PAT_TA_79226
gtcgacccacgcgtccgatgctttgcgcatctcactttgtcatgcacattaattcatgctttgcagagttcactttgtcatgcatattaattcatgctttttgcagttcactttgtcatgcacatattaggtgcatgttgatgttaagtttgcacatcatcttgttgcttatttgtagagcaatgtagaaaatcctactgttaaagtaactcatcttaggtcctaaataaatagtgatactccgtgagcagcatagatgagatcagtggcgaatccaggaagacagtgaagggtgtgctcaaacttaacaacgagaaactaagcatcattttaattaaagagaaaagggcattatctcctaattttttttatccaaataagctaatatttgccagaatgctactgaaaatatatgtcttattactgtcatcttatggttttctgaaaatatcaaattttgaacggaaatttatatctatctagctaaatagtcattatctccagtcctttcgctccaaacaagctgaaactttcttagattactactagaaacatgtagtatttgatacatttaaaaaatcaaaattttcaccaaaatatgaattagttagcaaaatatagccattattacttaatcctttttcttcaaataagctcaaaattagccagattactattggaaacatgtagtatttactatagttgttctgaagtttttaaaaaatagaaaatttgattatata

SEQ ID NO: 79227 - DNA, 214 bp, Triticum aestivum
  Clone ID: PAT_TA_79227
tcgacccacgcgtccgagaacatatagcatatgaagatcaatggtggcagatctgatttccagaatttgttttcaacttcagcctatgtggatgtggcctccgagttcttgtgcttgttggattgtttgtctgaggcctcctatagaggcgtgcctgtaatttttctactacctagctagacgttttgattgagaaaaaaaaaaaaaaaaaaaa

SEQ ID NO: 79228 - DNA, 250 bp, Triticum aestivum
  Clone ID: PAT_TA_79228
taccggtccggaattcttcggtcgacccacgcgtccgggaaaggaatgtcgaggcaggacaggaggagcacacacttgatgatcatgacacatacaccatttgactgtaaatgacttgttcattgattgtaaaaaccatgaagagcgcagagaatgtatagctgcaggagacacgacaaccaactggtagtctgatacaaacataaacaaatataactgatccaaatgttgtacagaaaaaaaaaaaaaa

SEQ ID NO: 79229 - DNA, 403 bp, Triticum aestivum
  Clone ID: PAT_TA_79229
tcgacccacgcgtccggttcgacgaccggagcgcgggctacaagcgccggctcgaccgcttcttcaacctcttctacctcgccgtcacggtgggcgccatcgccgccttcacgctcgtggtgtacatccagatgcaccgcggctgggccgccgcgttcggcgcgctggcgctcgccatgggcgcctccaacgcgctcttcttcgcggggacgccgctgtaccggcacaaggcgcccgggggcagcccgctgaccagggtggcgcaggtgctggtcgccgccttccggaagcggggcgccgacttcggcgacggcgggtacgtggggctctacgaggtggccggggccaagtcggccatccgcggcagcggcaagatcgagcacaccgacgacttccggtggct

SEQ ID NO: 79230 - DNA, 423 bp, Triticum aestivum
  Clone ID: PAT_TA_79230
cgaccacgcgtccgcatgcttactttcatcagctctgaagatttatccttcttaaaaaaccagataatatttttggaagagcttgagatgggcatgtctaataagcacgaagaagataagttaactgcatccactaactacaatgggccaccatcaatggcacttccccttctgccactcccctactcttatcgtgcaagatgttttcagtaaatcctcaactattgtattcctttatatgtctaccctactcttatcgtgcaagatgttttcaataaatcctcaacttctgtattcctttatttgtctaccctgaactgcaaagatctgaatttgatatccatgtttcaaatattattttcatttgcaggttgagcattcctccccaggttctacctccatccaattcttctttgttgctgg

SEQ ID NO: 79231 - DNA, 452 bp, Triticum aestivum
  Clone ID: PAT_TA_79231
tcgacccacgcgtccgaattaaactctgcatgggggacaggaggtgtaggagcgccgtgagcagcagaggaggtccgacggccggacggcgggaggaggaggaggaatggaggaggtaccttgcgccggagaggctggaggtgctggcgcagctggagccgtgggcggaggcgaacatgctgccgctgctcaagccggtggacgaggcgtggcagccggcggacatgctcccggacgcggcggcgctgggcgcggacggcttccaggcggcgtgcatcgagctccgcgccagggcggagggcgtgccagacccgcacctggtgtgcctggtggggaacatggtcacggaggaggcgctcccgacgtaccagagcatgtccaaccgcttcgagggcacccgcgacgccaccggcgccgacggcaccgcctgggcgcgctggatccgcggctgg

SEQ ID NO: 79232 - DNA, 401 bp, Triticum aestivum
  Clone ID: PAT_TA_79232
gtcgaccccgcgtccgggaggcggcgccgacggtggtgggcggctacgagctgcgcgagcgcctcggggggcggcccccggccacgtcggtgtggcgcgcggtgcggctctcgacgggcgcccccgcggccgtgaagcaggtgcggctggccggcctccccgcccgcctccgcgacagcctcgactgcgagctccgcttcctcgccgccgtcagccaccccaacatcatccgcctcctcgacgtcgtccggaccccgggctgcatctacctcgtcatggagctctgcgaggggggagacctggcgacctacgtcaagcgcgccggcggcagggtggaggaaagcgtcgccaggaatttcatgagacagatcggagctggtttgcaagtgctccgccggcac

SEQ ID NO: 79233 - DNA, 637 bp, Triticum aestivum
  Clone ID: PAT_TA_79233
cccgcgtccggttcgcaaccattgacctcccttaaacggaacaagggatcagaattctcgcgcatgattaaagaggcgaagcatcttggcttggccttaggcatcccttgcttggatggtgtcgaggaagcagaagcacagtgtgcattgcttgatttaagctcattgtgcgatggctgttttacatcagattcagatgcttttctttttggggcaaggacagtttacagagatgttttcataggggacggtggttatgtcatttgctacgaaatggaggacatagagaaaaagcttggttttggcaggaaatcactgatatcatttgcgttgcttcttggttgtgattattctaatggagttcatggctttggcccggtaagtaccagatggatagtttctatttttggactgctgactcttaatactcagtaagttcgtttagtgtgattgcattgcacttgctcttatactttactatctgaaactctatagtctgtaatggttcttttaagtacttcaggaagcagcatgtcgtcttgtcaaatctgcgggagatgattccatcctggatcagattttatctgatggagtaaaagctacaagaaagtgtaaagggaaaaaggctggcattggc

SEQ ID NO: 79234 - DNA, 584 bp, Triticum aestivum
  Clone ID: PAT_TA_79234
cgacccacgcgtccgcaagtaacacaggagcttgcttgaaagccactattcaaggttacgtggatattctgtgcccggtgttcttgaaggatatcgcaagggccattgtatctgctggaaaatcatttcagcttgttcagcatgcccaaagcacacaccatactcgaactagtgtcacaaatggttttgacattgatcagcgttccaatcacattactcgacagaattggccagacatattaagctctgaaatccaaaatgggcatctaagatgtgaaggtgctcttacgaattctacaggtcagtttggacatgatgctcgcgaaatgggggtgttaactttgtctgagattttcttgatatgcttatctggtctgttggaaaatggtgaccatgtttatgaatacttaagaaagctgcgtgctggtagtgctccagatatccaagcttttttggaatgtaagagtgaggaggcatgtgcagaaaatagctccgaaaagacttggttaaagctcctaagagatgccatctcaggaagaaaatatgatgatatggagaaaaccttgtccaaagatgctgttacg

SEQ ID NO: 79235 - DNA, 398 bp, Triticum aestivum
  Clone ID: PAT_TA_79235
cgacccacgcgtccgacgccccccgtccccgccgcggaccagcagcggcttccagagaaacccgccggagcgcgcggcttaatggcgctcgcgctatccacgctccccttcgccccctccaccccggcgcccgcctcgttccgcccccgcggggcccacttcgccccctcccccgccggcaggagcgtcggagtcggcctccccctcgcgtgcgcggcgccgcggaagaaccgcgggcggaggcggcgcggcgggggcctggtggtgttcgcggcggccgactactacgcgacgctcggcgtgcagcgctccgcgaccatcaaggacatcaaggccgcctaccggaagctcgcgcgccagtatcatcctgatgtcaataaggaacctggagcaaccga

SEQ ID NO: 79236 - DNA, 493 bp, Triticum aestivum
  Clone ID: PAT_TA_79236
gtcgacccacgcgtccgccttctcgtaccttgcctcctcccattccttccccccttactcgcacggaggtggctgcaggagatgcgtggcagaggaggttcgtgcagggggtgatggtggtgggagtggggagtaagaaagagcatggaggcggcggcggctaggaagagcgtgtgcgtgaccagcgcaggaggcttcatcgcctcgtggctcatcaagctcctcctctccaagggccactaaatggtccgcggatccgtccatcccagcccctcgaagatccaacctcagctcatgctcgcgctgctcccaccccacgacgccgtctgcgtcgaactgaaagcccacggaggacggggacgaggtcagggtggagatgtggatcattttctttggatccccaactgaagagtttgaaggagtttctgcagagcacctagatgtcaatgaatgtgcgtagagtccaggcccctgccatggctctgcaacttgc

SEQ ID NO: 79237 - DNA, 691 bp, Triticum aestivum
  Clone ID: PAT_TA_79237
tcgacccacgcgtccggggaagctctgtatggttgcagcagatgactctgacccaaagataggaacgcttgttgttcgtgtctggggagccgatgatgacggtgttgagaagtggatgctggaagatactttttcactgagtaaatttgttgatgtcaccaagtcttcaacagagtatgataccacggtgcagattgaggcattcgtcgatggctttctgtacctctgtattaagtatggtgagcataccgagtctctggtatccctctgcctggaaacaggaaagctaaacaagatatttgatgatacatatacaagccctgctcatccctacatcatgtcatggcctccttctttggtttgcaacaaggaggattcacaaaccaagattactggaggcagtgttgaggacgctggttctgtgggcacaaaagaaactccctctgttttagtcacagcgccacaatcgcacaaaattgattgatgacgatgaagccaaagtcatggagatagagttttttttactttgtattggggatgataaaaactcagcaagcaaaatcactgcatatgcataactgacaactgtgagcgatcgtaagttgagaataagtgttggcttagatagctttagggaaaaggcagaaagagagttgatggaatttatgctatcttgctgtggattgagttt

SEQ ID NO: 79238 - DNA, 227 bp, Triticum aestivum
  Clone ID: PAT_TA_79238
tcgaccccgcgtccggaagaacctgctgccagcatggccaaagaaccaccattggcacagggtgaggctgcatcagatgaaaagcaagataagggagcgctattctatgaacctcctcgcttcccaagcatggatgttccatttgtcagctgtgatcttgtaacttctggcgatttgcaagagtacagtccccttggcattcggcagttgatgcgctcaaccatgag

SEQ ID NO: 79239 - DNA, 497 bp, Triticum aestivum
  Clone ID: PAT_TA_79239
gtcgacccacgcgtccgcgagagcagcagtaacccccacggcaagcgccatgtccgacgaatcgccggcgacggccgcggagaagacccagcaagacgagcaggacggcggagggtggggaggctggggcctctccgtgttctccgagatctcccgcagcgcggtggaggtcgccaagagcgccatcgccgacatccagcagccgccggagcaggaggcgggccccggagagggggaagacaaggggagtaatgagccggagggggaggaggaggacgagcgccgcaaggcggcgctggataagcctgcaacgctgccgccgagctccaccaggaccatgccgggctctcctccttcctcgtggcgcctctgcctccggtcggcgccagcgagtagctccactggagccatgccccttcgtcggatggcctactttgcctccctgtgctcctatcgcatagaagtctggggttccaagtccacgcccctccctctcg

SEQ ID NO: 79240 - DNA, 512 bp, Triticum aestivum
  Clone ID: PAT_TA_79240
ttcgcgaccagttaatctatccacttacagcagatcaggaaaccgaaccacttagctatggtggttgatttagaatacttgctagaacgctaccctctcgacaaggaagtgaactggggtgatgagttgtctcttggtgagcaacagagattgggaatggccagattgttctaccataagcccaagtttgccatcctggatgagtgtactagtgctgtgacgactgatatggaagaacgtttctgcaatagggtccgagcaatgggcacatcatgcataacaatatctcaccggccagcattagttgcttttcatgatgttgttttgtccttggatggtgaaggagggtggaaagttcaagataacagaaatggctccttcctccctactgaattggagtttgatgcattgaagtcatcagaaactgaccgcaaatctgatgcacttgctgttcaaagggcttttagtgctaatacaaaggaaaatactttatcgggccccaaggaacattc

SEQ ID NO: 79241 - DNA, 570 bp, Triticum aestivum
  Clone ID: PAT_TA_79241
tcgacccacgcgtccgctcgcgcatcccacgcacccaacccagacctagcgaccgccatggcgccgccgccgccgccgccggcggcggcgctcccggacgagctcgtcgaggagatcctcctccgcctcccgcccgacgaccccgcctgcctcctccgctcctccctcatctccaaggcctggggcggcgccgtctccggccccggcttccgccgccgcctccacgagctccacggggcacccccaatgctcggcctcctccacaaccaggccagcgagccaacccgcttcttcgcccccaccactgcctcgcccttctccttggccgccccggaccccagctcctggctggccatcggctgccgccacggccgcgccctcttcctccccaggagccaggaggccaggaaactcctcgtgtgggatccaatcacgggcgcccagcacctcgtgcctgtgcccgcggcgtcggagtgccgctacttgactgcggcggtgctctgcgcggccgatggatgcgaccatcgcggctgcctcgggggccctttccacgtgcttttcgtcttcccc

SEQ ID NO: 79242 - DNA, 586 bp, Triticum aestivum
  Clone ID: PAT_TA_79242
cgacccacgcgtccgcgcctgcaccgagcatcttccgcgtgtgctgcgatacccaccggtgctgatccacctcgacacggtgaccttctacccgccacggcctgccaacgtggcgatcctcggtggcgggggaggggacgaagaaggggcgccgccgccggaggagatgccacacccgtggcaagatgggattgcagacgacatcaccaggacaaggactggattcgggctaacgctggccgagcgcagggcgcagcgggggagcggcggcccttactccggccgatatcaccgcgtccccggcgttctgcagccggaggacatctacacggacgcagcggcggtggcagacccggctgatttccacgtgcgtgcccgacgggagagcacttacggcgttcccaccgccaacgtgcatgtgcatggcaccctgcaggcggccccaccggaagctgagggcgtgctgaccgctaacccctccggaccggtaacaggagatcaaagcacgctggcggtcactgcgcctggcccgttggctgacgggtatcctgctgctgcgcctgctgcgggttgcacgcctctggcc

SEQ ID NO: 79243 - DNA, 606 bp, Triticum aestivum
  Clone ID: PAT_TA_79243
tcgacccacgcgtccgatttgttgtgtcacgctgcaggaaataccggtccttcccctaagagcatgtcttcatacagtccatggatttttactgtaggcgcttctgcccatgacagggagtacaacaactatgttgtacttggcaacaatttgaccatttcaggagttggccttgctcctggaacagatggtgattccatgtacaatctgattgctgcacctcatgcactgcaaaattatacaactactccaattgaaatgtccctaggagagtgccaagatccaagccacctagataaagatctgataagggggaagatactggtctgcagctattccataagatttgtacttggcctctcttctgtgaagcaagctttagatacagcaaagaatgtcagtgctgcaggaattatattttacttggacccttttgtccttggtttccagctgaacccaactccaatggatatacctggacttataataccatcatctgatgactctaagatattcctaagttattacaacgattcgcttgtacgagatgggccgtcagacagagttgtcaagtttggtgcagttgcaaaaatactaggaggtctg

SEQ ID NO: 79244 - DNA, 477 bp, Triticum aestivum
  Clone ID: PAT_TA_79244
tcgacccacgcgtccgcgatccccatcctctcgtccacaaccctagccccttcccctcgatcctcatggcccatccctcctccttgctcgtcactgccgctacctgctgctccctctccaccatcgtgcctgcttattgatcacaatatcccctctacctgattgagatcgggcgtaggttaggcgagcccgatggtgggttgggtgaggctatagggagagggaggaggccggcggcgtggtgaaggagttgacttgccctcgtggaggcggcgccatcggccagggacggcatttgctcgtcggacgacgtccgagctcgtctcaccctcacagcgacgaccaacaactcaagtaggaagggtgaggggccatcaagatctagcccagggcatgctccctggcgcccgcacatagaggactggccgctggtcgccggttggtcctcctgttctctcctcgtgccaccgtcctgca

SEQ ID NO: 79245 - DNA, 630 bp, Triticum aestivum
  Clone ID: PAT_TA_79245
ccacgcgtccgccaggccgttgtgtagctacatgcatgtttgtttttgctgggtcaagcggctggtgtgggctgcccacgttctaaggatgaccttgcatgtagctagcaggttgttagttggcgcatgggttagtgcatggagcgtgtgctgttagcggccggttatgatgggtagtgcgtgcgtgcgtgagggcaacgcctgatgagtctggctatataagccatgtattggtgttgtgtagagtgccgagtagctaggagagatgtagtcttcagtagtcactgtgttgttgggcgtcggtatgagccgagtctaggagccaaagatgaggtagtctccgtcaggaccgtggtatgcgtccggtcggctgtgagagagctcctctgggtaggctgcggtgtgttgccgcgtctggcgtatgtgcccagtaaaataaggccattcgtgcgactgggcgtatgtacgccaaaaatatctgtgtccctcttcttccacctatgtccgagcgagtgtgagagagagcggcaacaacagattcaagacaatctatagaaagcaaaatgatgtttaaatgtagtgcagcttgcaaatcatgagacttatgagataagagcagcctattatatt

SEQ ID NO: 79246 - DNA, 331 bp, Triticum aestivum
  Clone ID: PAT_TA_79246
cggcggggccgccgccgtgggcgccgaccaagtccacggtgttccggtcctacgctgctgcggtggtgggcgaccgggcggaggcgccgtccgcccggggcaatggggttgccgcccgttcaagcaatctacgcgccgtcaggaagaggcctattgttgcaagattgaccagagacatcgtccaaacttttgaaaaatgcaatcctgagtttaattacgtagattcactaaatcccaagcacttcctcaccactcctgcagttcctgttcataatgatggccttgataatgcaaattctgacctaatcttgtatgtcaacttggaattggt

SEQ ID NO: 79247 - DNA, 642 bp, Triticum aestivum
  Clone ID: PAT_TA_79247
agagaagggggaaggaaaacccaaccgaaaaagaggaaccagggcagcaaaaggagggggcttctccggcaggcgaagcgatcagggtgtttgaagaaagacagacccacgatcgtgcaatgcaggcagtacagacccgtaatcttcgggaaacccagctaggaggagtgatctttggttgcaagcatgagacaattgaagagtgcttcaataaacagctgtttggtctgcctgcgttgcattattcatatgtgaggaatgtcaaagctggcctacctttatttctattcaactacactgacagaaagctgcatggtgtttttgaggctgccagtcctggtcagaactccattgacccatatgcttggagtaatgatggcactttaaggacaccttttcctgcacaggttcgcatttgcacaaggactcgctatcagccactctttgaggtccaatacaaaaaagtgattcaagataattattatacacatcactacttctattttgagctagaccatgcacaaactagagctttaattgctttgttcaagtcagttggtcctctcaatttcaagcaagtcccagctgtttcaagcaaaaggagtctgcctgtacctttaccatcaactaacaggatgtcat

SEQ ID NO: 79248 - DNA, 349 bp, Triticum aestivum
  Clone ID: PAT_TA_79248
tcgacccacgcgtccgcgctgaaggatcgtcgtcgtcttcttggccggcgctccggcactggcgccgcaccaccgacttctgcggcggcggcggcaccgtcgccccctccgcctccgtcgtctgctacggggacaccgtcacgcagctccacgtcgagggcgccgcacagggcgcgccgccgctcccgctcaacttctcccttggcgcgctggtcaccacgctgtccaggctccccgacctcagggtgctcacgctctccggcctcggcctctggggccccttgccggggaagctggagcggctcgccgggctggagatcgtcaacatgaaccgcaactacctctacgg

SEQ ID NO: 79249 - DNA, 430 bp, Triticum aestivum
  Clone ID: PAT_TA_79249
tcgacccacgcgtccgcccctccccttccccctccagatcacaccaccaccgtctccgcccccaaatccattcccaggcccgcgtctctgctgccgcgcgcgagctcgtgagctcgggctgggttttagggctccaggtctccgcgtccccgcgccctccgcctaccggggttagggttacgccgcggtcgtcggggaccgtgtggctgcggggcgccgcgggccgatgcggcgatcgccggcgatcgagacgctctagcggaggggatctgctgccgctgcggtttctcctgcgatggccgccgacgcgctctccatcatcccgggcgccgtgctgcgcaacctcgccgacaagctctacgagaagcggaagaacgccgcgctcgagattgaggggatcgtgaagcagctgtccacggcgggggagcac

SEQ ID NO: 79250 - DNA, 371 bp, Triticum aestivum
  Clone ID: PAT_TA_79250
tcgacccacgcgtccggccgaggaataaagctttcgtcgaccgcaagcagaagaaaccaaaccaaaccccagcccagctccatggcgacggtggcgatggacatctcgaagcccccgccggccgcgtccggcgacgagtcggccaagggcgcgcgtggcggaggcgaggggctgcgccagtactacctgcagcacatccacgacctgcagctccagatccgccagaagacgcacaacctcaatcgcctcgaggcccagcgcaacgacctcaactcccgagttagaatgcttagggaagagctacagttactccaggagcctggctcttatgttggtgaggtggtgaaggtcatgggaaaatcaaaggttct

SEQ ID NO: 79251 - DNA, 579 bp, Triticum aestivum
  Clone ID: PAT_TA_79251
gcgtccgccaggattggtacgccgagttcgtcaagcacctgcttctccggcgggaccgcaagtcgttgaacacgctccggctgcactggaaccacgacgacgccaacacgtggatcgttcatgctctcaggcacaatgccacagctatccagctatccgcgaagcatcaccgcccaatcctcaagctggaatgcacggtcttcctttctggcaacctcaacatcttgcagctcgccaacgtgtccttggacagccgctccctctcggggctctgttctaggtgtacttctttggaagaactagagctcaggaaagctctcatatatgccacggagattcgatcaacctcactcaagcgtttgaccatggtcaactgcaaaatctttaacgacctcacggttgatgcttcgaatcttgcagccctgcgctgcatcagaccttgcagttttgttcctcagatcaagaactcggggtcactagtggcagccactatcatgcttgatgacgcttgcttgcaacatgctcgcccatggtcagtacaggatgatgaggacgatggcgacacatatactgatgctg

SEQ ID NO: 79252 - DNA, 442 bp, Triticum aestivum
  Clone ID: PAT_TA_79252
tcgacccacgcgtccgctctatgtgcttctctccatggacagcatcgccatggccagatcgatcattaaagccctagtattttcccttgattaagttcagaagatgccatacggcggcagtagtttgccaaattactaggaatgaagcacaacaaagacgatgataatatgtcgttcctggcaagtacataggtctggatttggtggcttcggctcacacatatgaagcaggatggggtgacaaagtagggtggggtgaagattcctgtccggcgactttcgcgtgttgtggctggcagcgctccacttctttctccccctgattgccgactacctttaattggtgtatatgcaagctaccgagactattcttgactagaatatgtatatgaatgtgagcaacagagttctttactcctagaaaatgcacgcgccaatgaaa

SEQ ID NO: 79253 - DNA, 477 bp, Triticum aestivum
  Clone ID: PAT_TA_79253
tcgacccacgcgtccgcggagacgaagcgtgctctgacaagatgcccgtgaagaacggcgggcatgctggaaactcgacgcccgtaaagaacggcaggcatgctggaaactcgacgcctaagagaagaccgggtgcttcgaaagccccgaggagaaggatggtcaagatctccagtccaacactgtacagaagcagagctataatgatgaaaaggaggtattcctgtggtgcaaagattgtagaacccgaagaacccatccctgtctcttgagagttagctcccctccccaagtaaattttatcttgctcctgtgaagatcaacagcagctggatgaagaacctatcatcgtcccttgagttatctcccttcctcaagtaaattttatcttggtcctgccaagatcaacagcagctggatgaagaacatgtcgtcgtcccttgagttatctccccaagtaaattttatcttggtcct

SEQ ID NO: 79254 - DNA, 363 bp, Triticum aestivum
  Clone ID: PAT_TA_79254
cggctccggtgacgcgacagcgcaaggcagccgatctcaagaccccatgacgccgccagatctgtccccgccgcctcctttctcagggcccactggacgttcgaaatcccccacggtgagaagttatgttatggaaactgaagacttgtttgtgcctgtttgggtaaaaaactacagtgagaaaagaaggaagaactgggtgccgtcatcgtctgatctcaaactactttcgctcaatcgtcttaaacagcaacaagcttgtgaggataaccgcaaggtggctgtgaaggatgtaagttggaggaagaagtgggtggtggcgtggatggatgtggtgagtaggaagatgtgtgtgtcatatac

SEQ ID NO: 79255 - DNA, 620 bp, Triticum aestivum
  Clone ID: PAT_TA_79255
cgacccacgcgtccgagatcctaacttactgagatcatatattgcaaaccacgaggaaagttctagagaaggcatttctcttcttgggcttctgattgaaggcattgcaactgacttcggtggcgaaatgctctgccagtttctggaaattctgaaggtgctgctggatggatgtactgcggatacggttacacaatgtagagacttcatcgagctattttatgagaagtgttttgataagttgatcaatataatagaatcgtcaagagttgaagaatattctgcgaagcttgaaatattgtataacatttgtgagctcttatgcttttgtgcacgtcatcacccctacaagatcaagatcaccttttttggaagcaattcaatggagaagatccttactctaacccgtcgaagagagaggtctttggttgtggcagctgtccgaatcatgcgtactattattggtgcttgcagaaatgacgagcttctaattagccatgtcattgaattcaacacgttgaaaccaattattgaagtatttgttgaaaatgggaatagatacaacatgctacactccatggtcctcgaactgttggacttcataagaaaggaaaatctaa

SEQ ID NO: 79256 - DNA, 623 bp, Triticum aestivum
  Clone ID: PAT_TA_79256
gtcgacccacgcgtccgggggcaaggcgcagcggcggtctcgtccacctccaccaccaccggcgagcgatgtcggccgcggggaaggcgaaggcaagcggcggcaagcggggcggggccaaggaccccgacgaggcgccccggtccgacaagaggcggcgcgacatggacgattccgaccccgagctcgagctcgacagcgacttcaagcagatcgtgacgatgctgcgccacatcaaggacaaggctcacaaggacggccagaagaagaccgagcaggccatctccagcgttgcaacagagattcaatctatggtacaggacaccaagacaaagtttgagaaggaaaggcagaatgttcttaaagctctaacgaaggcttccaaagagtgtgaaggttcattgaagaccgagtacacaaagtttcaagccactcatgacaagttctccaaagacaaggctgcacacgtacagaatttcaaagatcttttctcaaagtttgaagttgaaaaggagaaactgatagttcagtatgaactgcaaaggaagaaggaaaagaccactcttgctgatcttgagaaaacagtttcggagaagataacagatgcagaagaatctctgaag

SEQ ID NO: 79257 - DNA, 578 bp, Triticum aestivum
  Clone ID: PAT_TA_79257
taccggtccggattcctgggtcgacccacgcgtccggttacttaaatggagttgatacacatggaatcctactttttagaacattagttgggaagatttttgggagcatcggatcagttggaggtggattggctctaggaaaagaaggtcctcttgttcacactggagcctgcattgcttctcttcttgggcaaggtggatccgcgaagtaccacttgaattctagatgggtacagatttttgaaagcgatcgagatcggcgagatcttgtgacatgtggatgtgcagctggagttgctgccgccttcagagctccggttggtggggtactatttgctctggaggaagttacatcctggtggagaagccatcttatgtggagagtattctttacatctgctgttgtggctgttgtggtgcgatcagcaatgaattggtgtgacagcggaaaatgtggtcattttggggctggcggtttcataatctgggacatatctggaggtcaagaagattactcttaccaggaacttctgccggtggcaattattggtgttattggtggactccttggagcgcta

SEQ ID NO: 79258 - DNA, 471 bp, Triticum aestivum
  unsure (1)..(471): unsure at all n locations
  Clone ID: PAT_TA_79258
cgacccacgcgtccgggctcggagctgcccttgtccttcttcctcttgggctcgctcccatcctcgtcctcctcgccttcttcgtcgtcgtcatcctccccctcctcgtcgctatactcttcgtcatcttcgtcgtcgtcctcgtcaccatcttcctcgtcgtccccgtcgtccatgtccacgtcttcgtttggcttgggggcagggccgccgtcggcgtagatctcggggtcgtggatgaggagggcgcagaggccattggcgaggcggaggaggcggtaggaacggttgtcgctgggggacttgaccaccagctcgtcgtcgcgcgacaccgccgccgccatctcggccgtccgccgccgccttgtagatacnaaggagggggggaggtggtgggagataggtgtgcggcgggcagtagcagcgcgggccttctcccctgtttccttcgtttatatcttgggcttgttt

SEQ ID NO: 79259 - DNA, 492 bp, Triticum aestivum
  Clone ID: PAT_TA_79259
ttaagccggagaaaccacaattccacggtgattcaccattcacctctgccttaaccgatcttactgctcaggaggagtcttctgtcgacaaggggaacagcaaagccgcggcggcggcggtcaggaaggaatccaagctggagaaaccacaagtcccagattcaccattcgacttctccgatcttggtgacgaggaggaggccagtgccaagtggaacagcaaacccacggcggtggtcaagagggaagtcaaggtggagaaacccgacccagatttatcgttcgcctctgctttcaccgatcgccgtgttctggatgatgccaatgacaaggggaagaaaaccggggcaagtgcttatggcggtgccaagtcgggcaagagggcagcatcaaagccctcatcctttgcggattttgatgaagatgatgacggtgtcagcgaggaaaaggagaaccgtgctgctgatgacacggagaaggatgttggctggg

SEQ ID NO: 79260 - DNA, 664 bp, Triticum aestivum
  Clone ID: PAT_TA_79260
cgacccacgcgtccgcgggtaatgctacaccccatatgcgacgtggccctgatggcccgagaactctttgcaacgcttgtggcatcgcttacaggaagggtaaaatgagaagaatgatagaagctgaaccacctatagatgaggcttcacttgctaagcttgttcctgaggtggacatggaatttgagagtgaggaaaaagcatatgaattctacaataaatatgctgggcatgttggctttagtgttcgaaaaagcacgtcacataaatcttctgaaaatattaccaaagtaaggacttttgtatgctcaagagagggttacaacagggataaaaaatcgttggaggcaaagaaaccaaggttggatacaagaattggctgtccagcacggctgattattaaagtcacaccagagtgtaaatacagggtcactgattttaaagcagagcacaatcatcagctggcccctccttcgacgatgcatatgttaaggtcacaaaggatattaacagaacttcagtctggggaagcagaactgtcagatgattccgtagtgacaccaaccacaaaagcaactggtgatcttgttgtgagacaagttggtttccttcgaagtatttctctcctcccagcagattacaagaattatcttcggtcaaagcg

SEQ ID NO: 79261 - DNA, 540 bp, Triticum aestivum
  Clone ID: PAT_TA_79261
tcgacccacgcgtccggacaaacctccctccctctctctcttgtctgtggctgtctccggccggcaaccgtgaatcctagctgctcgcgaccaaaaccacctacacctccccgcccaactcccatccatagcctctagctgtctagcagtttagctccggtctccgggctccggccatgccgcaccgtcgccgcctacacagcctcgcgccgctgccgccgcctcccccttcgcctcacaccgccttcgacctgtccgaggccgagtcgcggctgccgctcctcgcagactacgggcggctcaagcccgtcgacgacctgtccgcccccgccgcgcccccgtccgcgcactggagcgccgggagcgccttcaccggcaccgagcccgcgaccgcctccacctccacggcagcgacgggctcctccctggctcccgcgtcatccgccgcgagggacgacacgtgggtgcgccgctccagggagagctactacctgcagctctccctcgccatccgcatcacctccgaggccttcctcgccg

SEQ ID NO: 79262 - DNA, 624 bp, Triticum aestivum
  Clone ID: PAT_TA_79262
tcgacccacgcgtccgactagaacttggggatatggacaagacaaaagcagcatcaagggacactaaaagcatcaggttttgaggttcttcgccacaagagttttagcaccatatggctctgatggatcagcctgttgctttcctccgctagcctgctgtgtgtgaggcaacttttgaatatgtttggggaagcatcaggtctgcggatcaactgtacaaaatcttgggccattgtgaccagaggggatcaccgtgaccatgatgaggagagaatcgctcctatcctacagcgttccattggcgcttttccctgcaagtatttggggcttcagttatctattttatctctcactaaagccgaatggcagcctaccctggattccattagggcctgcgccccagcatggcaacgaggcctcataaacagagccggcagactggtccttgtggattcagtcccatctgctcgacccgctcatcatctgctgatttctgaagctccgaagtggacaattcttcaacttgaaaagtggctgcgtgctttcttttgggcagggacggagatagtgcaaggagacaaatgcttggtttcttttggatgagctctctagtgcttggactgc

SEQ ID NO: 79263 - DNA, 726 bp, Triticum aestivum
  Clone ID: PAT_TA_79263
tcgacccacgcgtccggttgcatgtaacacacaaagtatgttgccatgtcgaaatactgttttgcattgtcatggcatatgttttttaccatgtccctgaagctttgagtagtacttttttttcatggcaatttatagatgttcttctcaataaatcgtgacgatttctttgtagatgttgccatttttttactagctcccacaatttttttgtttgcaaatttttgtagatgtcgacatttagcattgtgtagttatttgtgtaggcacttttttgcaggtgatgagatgctaatggactagatttccttggcaattctaggaaactatagttcatggacacccccaaaatgtatagttcatgacaatcaaattatgtcttttgccatcgaagctcaagttttacatgtgttaatttgtttccatcgaaacttaattgccatgcttgtgtcttttctttagggtacattacagatatatcacattctttttgccatgacaacttttgattttggatatgtccccatcgaaacttcattcccatgcttgtgtcttttgtttagggtacattatagatttattgcattcttgccatggcaactttttattttggatatgtccccattgaaccttaattgccatgcttgtgtcttttctttagggtacattacagatatatcacattctttttgccgtgacaacttttgattttggatatgtccccat

SEQ ID NO: 79264 - DNA, 646 bp, Triticum aestivum
  Clone ID: PAT_TA_79264
tcgaccccgcgtccggaaaggcgtctccgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcctggggtcacagtgtacccatcacccca

SEQ ID NO: 79265 - DNA, 583 bp, Triticum aestivum
  Clone ID: PAT_TA_79265
tcgacccacgcgtccgcactggtccacgattacttattcagcgcattcaggatgctgcagagccccctaaatgctttaatgccagcttgtactcaccaccaaagcaaagagaagtagaacgccaccatgaaattatgagttacaggaaccaatttctttggagttgcctcttttcagttcctgtgttcctgttcgcgatggttctgcccatgctccctccttctggagattggctgttttataaaatctacaacaacatgacggtaggtatgctactgcggtggttgctatgttctccagttcagttcattattggttggagattttacgttggagcttaccatgcactgaagcgagggtactctaacatggatgtgctggttgctttgggaacaaatgctgcgtacttctattctgtgtacattattgtcaaggcactaacatcagacacgtttgaaggacaagatctttttgaaactagttcgatgttggtatcttttatattgctgggaaaataccttgaggtggtggcaaaggggaagacatcagatgctttgtcaaagctgacagaacttgcaccaga

SEQ ID NO: 79266 - DNA, 466 bp, Triticum aestivum
  unsure (1)..(466): unsure at all n locations
  Clone ID: PAT_TA_79266
tcgacccacgcgtccgccctcgcagtcgaacggcctcgccacccccgctcctctcctctcctctcctctcgcccacgcccgccaccgccgaagaagctcccatggcgggcggagcggggaaggacgacgagcccgagccgccgcgggagctggacgcggcgggcgagcgaaccagccccgatcaccacgctccggcgtcgccgggctcttccgaggaggaagagggcgccagcggagcagtcgaggcggggcaggacgacgcgcccgagccggaggacgaccaggaagagggcggagacaccacggaggacgacgaggacgaggaggaggaggggtacggggaggaggaggagggagacnaggacgaggacgaggaggacgccccgacgcacctgccgttcgcgcccgcggaggaagagtcacttgaggagacaactacagttgatccaagctatactatctctct

SEQ ID NO: 79267 - DNA, 503 bp, Triticum aestivum
  Clone ID: PAT_TA_79267
tcgacccacgcgtccgaatgctgtcagatatgccatcatgatgaatacagtgggggaggtatgctctgacataagtcatgattcacgtttttgtcaagagctgatggatgcagttaatgctgttcatagtaagtatcttctaggcaagcaacaaactgcagaaggggataaaacttatgaacaaacagtgaacgaagcatgtgtgagtgagcctttgaacgatcctgctgtaataaacaacaagtcagtgaggaaagggaacagattgaagagccgatccgagagagaagggtggaaaaaggctgctgataaacggaagaaatgtatttgaagataattattgaatagaattaagaaagtgaattagaacttgtttacaatggttcatttgaaaatgtgtttccatttttgaggatttttatttttacctagaattttctctgtttacagtagcagttttggtttgatggttcacatagtagtataattaatgagaatggaca

SEQ ID NO: 79268 - DNA, 511 bp, Triticum aestivum
  Clone ID: PAT_TA_79268
cgaccccgcgtccggtaccactgggacctcccccaggccctggaggacaagtacaacgggtggctcgacaggcagattgtggatgactttgcggagtacgccgagacgtgcttcgcggcgttcggggaccgggtgaagcactggatcacggtgaacgagccgcacacggtggccatccagggctacgacgccgggctgcaggcgcccggccgctgctccgtgctgctccacctctactgcaagtcaggcaactccggcaccgagccctacatcgtcgcccacaacttcatcctcgcccacgccgccgtctcccaattgtacaggaccaagtacaaggcggcgcagaacggggagctcggcatggcgttcgacgtgatgtggtacgagcccatgtcgggcgcggcgatcgacgtcgaggcgactaagcgggcgcaggagttccagctggggtggttcgcggaccccttcttcttcggcgactacccggccaccatgaagaagcgggtcgggg

SEQ ID NO: 79269 - DNA, 681 bp, Triticum aestivum
  Clone ID: PAT_TA_79269
ccacgcgtccggtttggcaagcaagatatgggagttcctggcagttatggtgagatgtggtcttggagtcatgtagttccaatggtaaattcggcgctgtcttggttacatctaaatgatattccctacttgtgttcactgatcaatgggcagagtgagaatacaacacatacaccggagcaaagctgcttggttttgttgatttcttctgtactaggcatgcttaattcgacattggaaagaatatcaccagagggcactcctgatagtagaagttactgcttgccttggataccggactttgtccccaaaattggcctggggataattactaatgggtttttcagcttctcgtgcactgaagttgttgggcatgaggagcagctgccgtcccgtggtgtatcgttggtgcaggggctttgtcatctgagatgctggggtgatgtcgatgcatcactatcttccataagttgccttcaaagattagtgcagctatcctgttctgttgacagagtgatccagagagcgacaacaaatagttctgagcatctcaaagaatctaaagcagggctagctggcaagatattacaagaaggcatttccagtttatggcataatgacttgttgaactttcttacttcgctgttgccattgatttcctcgcagtggcctgtattaaag

SEQ ID NO: 79270 - DNA, 508 bp, Triticum aestivum
  Clone ID: PAT_TA_79270
gtcgacccacgcgtccgaatctgccctgctgctgcccctgctgcacctgagggagactggagagaaggcaggggaggggaggggaaggaggggggaggcagccgtagcagaggcgcatacacacagacggaccgcttcgtcctcggccgcccctgtccgtcctcgctcgctttggagggatctgctgctgcgcctgcgccgctttcagagcctttctcagcgagctggctctgctctgatggtggtgctggcggcggcggaaaagcttctggtggtgggggttaaaggtgggggggctgcctaattctggtgggattattcgatttgcgctgctgtgccgggaggtgcggtgagtggaggaggggatgattacgttcgtggactcggcggcgggggagcgggagaggggggacgggccgcgctgcctggacccgcagctgtggcacgcctgcgccggcggcatggtgcagatgccgccgcccggctccagggtctactacttcccgca

SEQ ID NO: 79271 - DNA, 344 bp, Triticum aestivum
  Clone ID: PAT_TA_79271
ttgggaagtacaaacacatcagcacagtgagtaaggatgtggcaccttggggaataatgcctacaaagcaagcccaggatgacgacgctgatcactagcatgaaggataccaagcaggctaaggatgaagtacacgatgaaggcaatgaggacaatgaaaacatgcaatccataaacatagcagcagctgcaagttcttctgtgtatgataatatgattgctactttttaaaagaaagtgtatatgatagtttgatgtttctacaagaaaggaaaaaatggtttgaattaaaaacattgatcagtatgaatagaaaacaattatcagttcaaaaaaaaaaaaaa

SEQ ID NO: 79272 - DNA, 383 bp, Triticum aestivum
  Clone ID: PAT_TA_79272
tcgaccccgcgtccgattccgcagtcacgataaccgagaaggaatttgtgggagaagttcatatgccctcacaaggaagctgcaccacaccttgctaaagattatgcggcagcctgcaaagatgaagtgccgactagattcagatttacatgaaccaagaccagtctgaaaattcctaactgcatatgacaggacaaaattttcattcgttcctgattcagtgttgttggcctaactgaatggtggttggctgctatctataatttgtagtatgtctgttacatgctcatttggtggtgctattgaggatgaaactgatatttttatcaggggagatgaaactgatattttggtttcaaaaaaaaaaaaaaaaaaaaaaaaaa

SEQ ID NO: 79273 - DNA, 767 bp, Triticum aestivum
  Clone ID: PAT_TA_79273
gcggcggcgcgatctgggcgcgggtcctgagattggggacggcggcgcggcggtgaggcgaggcgaggcgcggcgcggcacccggcggcatgacgaccaacaccaagcgcgcgtacaagctccaggagtttgtggcgcacgcgtccaatgtcaactgcctcaagatcgggaggaagacctcgcgggttcttgtcactggaggagaggatcataaggttaatctttgggctatcgggaagcccaattcgatatcgagtttaccagggcatacaagtgctgtggagtcagttgcttttgattccacagaagtatttgtggctgcaggagcagccagtggcacagtaaaattatgggatctagaggaggcgaagatcgtccgcacgcttactggacatagatcaaactgtatgtcagttgatttccatccttttggggaattctttgcctctgggtctttggacactaatctgaagatatgggatataagaaggaagggctgcatccacacatacaaaggccacacaagaggggtgaatgctattaggttcacacctgatggccgttgggttgtgtctggtggcgaagatagtgcagtgaagatctgggatttgacagctggaaagttactgcatgagttcaaatcccatgagggtcaaattcagtgcattgattttcatccccatgagttccttctggcaacaggttcagctgataaaactgtcaagttctgggatttggagacctttgagttgattggatctactgga

SEQ ID NO: 79274 - DNA, 534 bp, Triticum aestivum
  Clone ID: PAT_TA_79274
cgaccccgcgtccgaataaaataataaatccctgccctctcgcctcccttctcccgcccctctccactccgagccctgcttcgccgccgaggcctgaggctctgcttcgccggcgacttccttcgcccgttgaacgcgcattggcgcacgaagacaagaagcttccgcgctgatcccctcaccgtcgaccgccgagaagccgtcctctcgcgctcgaaagcaagaagggttcttcagttcttggctgccaggcttggccaagaaagcaagaaccgacgcaagaaggccatgaggcgtgcggaggagccaggggagcaccagggcgcgccagatcggtggtgggtggtggctggcctcgtcgccagcgcatctccctgctctcgaggccaacctcgccgcatcgctcgccggcgtggaatcctcggcatccacgccatcgctgcccctgatacaggagggagcaccggggggcagtgatcacggcacagccgcctccacgcgcagcgacgtgctcgacgcatcctccccggcgcc

SEQ ID NO: 79275 - DNA, 370 bp, Triticum aestivum
  Clone ID: PAT_TA_79275
tacagcgagagccggggacgacgggagtggaggcggatctaggacgaggataaagtcgccgggggtaaaacagcgtggcgtacctgcagcgcgcagtgggggcaggagccgcagctcgtaggcggcggcggcggcggcggcgagcagggcggcgctcggagggggagaggcgtggccggcggcgtcagtgagaagcagagtgtgctgccgtcgtccaactgcggaatgcaatcgatgagcggccggtggcgatgccaagcggcctggtgggctggccagcaacagagcccgatttgcttctcaagatgggcctacgggcctggatctagggctgggctgggccggccggccgacgggacgggtcctacct

SEQ ID NO: 79276 - DNA, 541 bp, Triticum aestivum
  Clone ID: PAT_TA_79276
ccacgcgtccgggatgattcattgattttgactggccccaagagaggattcatggtatgcgacaatatattcttcgaaatcgatctgaaggtgaaggatgtgcatgggaggactgtcgatgacgatagactcagtaaaggcctgatagaggtggatgctatccgcaggctggaatatagtcccagatatgtggttgatacggaaacacttgttagcatgcacagcatattggatttaaactatacattcgtaaggagctcggtggagggcactgttgagatcaagatccttgagggacctgatgaattccatgggaagattgttgcttccactaccagcattccatgcgacattatgctacatgatagcaaagtgagtggtgccctaactgcaggtgacaatggagtcctacaaatggcgcggcgcgtagtaggagtctctgtggatgagatgctggtgttgactgttgctgctgctgtcggtgatgatgagttatctgtccgcactattgagtttactccaaggcgcaatggttacgatg

SEQ ID NO: 79277 - DNA, 605 bp, Triticum aestivum
  Clone ID: PAT_TA_79277
ccacgcgtccgaaggaatacctacattctgcagagctgagagacataatgcagtttgggagcagcaatactgctgttttctttaagatgcgagttgctggtgtcctacatatctttcagtttgaaactaagcagggtgaagaaatatgtgtagcacttcaaacacatataaatgatgtgatgctccgcagatattcaaaagcacggtctggctctgctactagcacggtttctcagaatgatgtttctcaagcagataagctaccaaatgctgaaatgcacgacaaacgtgtccaagaactgtcaaaagtagttgatgagtctcagaagaaagcagacgagttgcgggatgagttacagaggaagacacaacaagaaagagagatgcaagaagaattggaagggctaagagataccttacaatctgaacgacatatcattaaagaagtaacaagcgagcgggacaggctaaaatccctatgtgatgaaaaggaatcttctttgcaggttgcattggtggagaaaaatagactggagaccaaattaacaaatggtcaggcccaagagaacaatactaaagtaaacttatctggaagtcattgtgaa

SEQ ID NO: 79278 - DNA, 432 bp, Triticum aestivum
  Clone ID: PAT_TA_79278
tcgaccccgcgtccggcctcttctgctgcggcggcgccgccgcgctgctcaccaacgacccggcctaccggtcccgggccaagatggagctgcgctgcctcgtgcgcgcgcacatcggcgcgcacgacgacgcgcacgccgccgccgtgcactgcgaggacgccgacggccgcctcggcgtcagcctcagcaaggcgctccccaaggccgccgtgcgcgccttcagcgagaacctccagcgcctcgcgccgcgcatcctgccggccgccgagctcgcgcgcttcaccgtgcgcctcctggcgcgcaagctcatgcgccggaagctcaagttcgagggccccaagatcaacttcaagaccggggtggaccacttctgcctccaccccggcgggacggccgtcatcgaggcggtgaggaagaacctgggcctca

SEQ ID NO: 79279 - DNA, 567 bp, Triticum aestivum
  Clone ID: PAT_TA_79279
tcgacccacgcgtccgggaagagagaagggaagggaaagacgaggacgaaggcggcgagcaggccgggatactgagcgccatggcttccaagatcggcatggccatgtctggcaatggaacccacggcggcagcggggaagatgttgatcacagtaacggtgagggcgagggcaaggagaaggagatgggaggcgacgagccgagctccaacggcggtgggctcgttaagcagatcatgtccaacctccccacttcaggtgcactgccaatctgccattttcagttccgccatatccttgtgttgttgcctcgattgtttcagctgacaggatttgctctctctccctctgttcttttgcctcgctgcagacactcgggggcccgatgctgaggaggcctccctgctcatctccatcatcgacgactagactagcaggagatagatttggcacttgttatttctgggtgtagttttacatcgcccagcgtgccctctttcttgatgctcatgttgtaacacatgtttgcaccttgataagtgtactggcctgtaatcgcattgactg

SEQ ID NO: 79280 - DNA, 729 bp, Triticum aestivum
  Clone ID: PAT_TA_79280
taccggtccggaattttccggtcgacccacgcgtccggcaagcgacgcaccaagccgatctctcttctcccccctgcgctgcatattccgccccccaaccagaccaccaccaacctgcgacgacgatccgcacgcaaatccacctcgagaaaccctagctaatcccggcccggcatggcctacgtggaccacgccttctccatcaccgacgaggacgacctcgtcggcggggccgtagggggcccgcgcggcgcccccgtcaaggagatcgccttcgccgccgccctcctcgccttcggggccctcggcgtcgtcgccggcctcttcatggccgccaaccaagtcggcggtgacaccgcgcacggtgagatcgaatctcctttcgcccctctccgcctccattttcttctttccctatatgcctataagaagaattggtactgcctctaggaccctgaagttgctgcaattttctaactactgctgtatgagtatcttaagagctacttactggtaattcatggctagaagtagtatttctaaggttgtgacttgtgagagaggaattgattgaggtttatttggctgagacatagtcgacatgtatttcagtacagagggagtagtatttactccgtagctgttgtttgggagctggataggtgacttattttaatggtatatatgagtatgaccgggtgtttgctgagaaatatataggcatttgta

SEQ ID NO: 79281 - DNA, 379 bp, Triticum aestivum
  Clone ID: PAT_TA_79281
cccacgcgtccgccgccactacttgttacattgcttatttgttttttaaccacgttggctggtctctgaaattccttgctgtgtggcccaccttttattttggctgtttattcctacacaaattctgggtctgccactgtctctaataatattataatatcatcctctttaactttatatttgcattttctattgtgtaggaataaagttaaagaggatgatattataatattattagagacagtggcagacccagaatttgtgtaggaataaacagccaaaataaaaggtgggccacacagcaaggaatttcagagaccagccaacgtggttaaaaaacaaataagcaatgtaacaagtagtggcggcggacgcgtgg

SEQ ID NO: 79282 - DNA, 477 bp, Triticum aestivum
  Clone ID: PAT_TA_79282
tcgaccccgcgtccgataaactacgggggacactctcttcagttgatgttgccaccaaggataacttggagaaacttgtcaatgttggagagatgctgctaaagaaacctgtctcacgggcaaatttggagactggccagatggtgcctgcttgtagtgacacagaggagaccaatgaggaagcactcaagagatttgcaaagctgttgtctgatgaaaagcaaattcgccaagcaagatcaccaaaatgaagtccgatctcttttgtgtcaatgctctgccagagattttattttctctgcatgacatacaccagtcaccaattagttgatatgtttgttgaagttgcactgtaatgtagttaaataaatgtgtagtgaggcatactgactgctatagcttgataatgtcaggcgccgatggctttattgatatgtaaatacaaatgttcttttaaataaaaaaaaaaaaaaaaaa

SEQ ID NO: 79283 - DNA, 416 bp, Triticum aestivum
  Clone ID: PAT_TA_79283
acccacgcgtccggtccagtgctggctacagtcagttgctgtcctcactccgcacccccagttaggctacctccactgtcctttcagtcagcggcgaccggcggccggcggcttcacgcccaatcgcacccgcccgtcctcaatcccgtccaccatcgtaggtgatccttcccgccgcctcgactccgtcgaccgtcgccgccgactacgccacacctttgtgtcggcatctcccccgaccaccgcgccgccacccccgcgggccgtgggcacgaaggtccactcaagcctgttgctgaccttccatcatcctgcagccctgcatctcatcatcctcttcagtttataactgatgttggtttggctgcctctcatgctgaaagcaaggtttcaccttgccgacaggctgatggttc

SEQ ID NO: 79284 - DNA, 440 bp, Triticum aestivum
  Clone ID: PAT_TA_79284
tcgacccacgcgtccggagcgcccagcggtggtcggagctcccctacacccgcgtggcctcggtggccatgcggcgctacaagttcctcttcaagaagcacgacgaggagcgcttcggcaagtacctggaggacgtggaggccggcaaggccaagatctcggcgggcgcgctcctgccgcacgagatcgccgcgtccgcctaccgcggccaggaggacgacgtgtcagagctgcagtggcgccgcatggtggacgacctccgctcgaaggggtcgctgcgcaactgcatctccgtctgcgacgtgtcgggcagcatgcacggcaccccaatggaggtgtgcatcgcgctgggcgtgctcacttcagagctcagcgaggagccctgggcaggcaaggtgatcaccttcagcgagaggcccctgatcctcttctcgggcgcc

SEQ ID NO: 79285 - DNA, 516 bp, Triticum aestivum
  Clone ID: PAT_TA_79285
tcgacccacgcgtccgccctgccttccctctcccctgctttgaccccgctgcgactaccatgttacaaccactgggcaggcagccaccgccctcaggatgctcagggagaacaaggaccagtttgacctcgtcatcagcgatgtccacatgccggacatggatggtttcaagctcctcgagcttgtcggtctggagatggacctcccagtcattatgttgtctgcaaatggggagacgcagacagtcatgaagggcataactcatggagcatgtgactacctgctaaagccggtgcgtcttgagcagctgaagacaatatggcaacatgtgattaggcggaataccaagaaccgtggtagtgacaatgatgatgctggtcagaaggggccgaatgctgaaggtgagaatggtggtgctaaccgcaacaagaggcagtcacggagggatagagatgacaatggagatgatggtgacgattctgatgagaacagtaatgacaacggcgactcgtcatc

SEQ ID NO: 79286 - DNA, 534 bp, Triticum aestivum
  Clone ID: PAT_TA_79286
tcgacccacgcgtccggggcgcgctctcgctcggggtctacgcgcacgcgctgctgctgcgccagctcgggggccacggcgacgtgtcccgtgacgtgctcatcaacaactcgctcgtggacctgtatggcaagtgcggggccgtcgagctcgcgcggcaggtgttcgaccggatgcccgagcgggacatcacgtcgtggaacgtggcgatcctcacgctcgccaaccacggatgcgtgcgcgagtccgtggagctgtttgatcggatgacgcgggccgagaatgttgtgccgaacgcaatcacgttcgtcgcggttcttagcgcttgcaaccatggcgggatggtggaggaaggcagaagatacttcgagatgatggtcagcgagtacaggatcaggccgaggatcgagcactacgggtgcatggtggacatattggcacgagctggcttcatcgaagaggctctggatgtcgtgtctggcatgaactgccggcccgatgccatcatctggaggagcctgctggacgcatgct

SEQ ID NO: 79287 - DNA, 435 bp, Triticum aestivum
  Clone ID: PAT_TA_79287
tcgacccacgcgtccgggccggattgggtgcccacggcgtactggaagggcaacccggacgtggcgtcgcccctccgcctcgcgctgctcgcctgcaacgacaccaacctatggcgagccgagatcatgcgccaaaactgggaggaggaggccaagtccgggtaccagaactccaagctctccagccagtgcacgcaccggtacaagatctacgcggaggggttcgcgtggtcggtgagcctcaagtacatcctgtcgtgcgggtccatggcgctgctgatcgacccgctgtaccaggacttcttcagccgggggctggagccgcgggtgaaccactggccggtgagcacggtggggatgtgcgagtccatccgggacgccgtggagtggggcaacgcccacccggaggatgcggagcgcgtcgggaagcgcggc

SEQ ID NO: 79288 - DNA, 682 bp, Triticum aestivum
  Clone ID: PAT_TA_79288
tcgacccacgcgtccgaggcaagatctcaatggtcaaaaaggtttgttcctcgattgaataagttagtactttcttgttattctgttgtagtatctgaattgcatgactctctatctgcttacctgaataattggttattgacatcactagacttgaatgcagactcgtggctgtgattttgttctctctagttagacacatagaattagttatgacttataatttaaataacaggttcgattgagctagatttggcaatggatgtactatctgaatttcatgtctctctgactgcttacctgaataattggacattggcgccagtagacatgagtgcagcctcatggcttttattttcttctttgtggttagacatacagagttagttctgacttaaataaaaagcgaactcgattgtgctggttgttgcaaatgtattcgttcttgcatgtgctgagtagtacaggcttttggtgtcggccacaaatttgcatctagtagaaatatgatgtgctgactatctaggtaatcatcggattcctgaaattttcatagttttccagaaatataagtataattatcttacatgtggaagtaaatgtttttttgaaacatgttagtgcaactgtaaaatgtgggtgtcggatggactgagacctgcactgaaataccagcactctc

SEQ ID NO: 79289 - DNA, 562 bp, Triticum aestivum
  Clone ID: PAT_TA_79289
cgacccacgcgtccggcagaggactgcccccgggatctggcaaaaagaaacagctcgatgccttaggttcagctgggacatcatttactcctcacataataactgtcaagcctaatgaggatgttgcttcgaaaataatgtctttttcacaacaaggcccacgtactacatgtataatctcagcaaacggtgcgctgtgcacagcaacactccgtcaaccagcaacctctggtggcatagtgacatatgagggccactttgatattctctctctgtcgggctcatttctgctggcagaggatggtgacactcgtagcaggacaggtggtctgagtgttgctctggctggaagcgatgggcgtattgtaggaggctgtgttgcaggaatgcttatggctgcaacgcctgtccaggttgtggtgggcagcttcatcgctgaaggtaacaaaaagcccaaggaagaacaaccgaaacgcgagcccacatctgtgccgatgttaacatctgcgccgatgcagactgctgctggctttggtgcggcctcagctgctgctactccatc

SEQ ID NO: 79290 - DNA, 564 bp, Triticum aestivum
  Clone ID: PAT_TA_79290
tcgaccccgcgtccgttcaggaaatataccagctgagataggcaaccttataaacctcgctctgcttgacatgagccagaacatgctctcaggacaaattcccctggcagtttggaacttgagcaacttaattgtcctgaaactttccatgaataggttgtcaggtaaaattccatcaacagttggtaatcttgctcaactcagccagctttatcttgatgaaaatgaattgtctggaaacataccagcaaatataggacaatgcaaaaggctgcttgtgctaaacatgtcagtcaaccaccttgatggatccataccaggagaactcttcagtatttcctccctttcattgggtttggacttgtcaaacaacaacctgacagggccgataccttcggaagttagtaacctgatcaatcttggcctccttaatgtttccaacaacaaattatctggtagccttccttctgaacttggcctgtgtgttcaactgctatctcttcagatcgaaagcaacatgcttaatgggagtattcccgagtctttcagcgcactgaaggtcat

SEQ ID NO: 79291 - DNA, 705 bp, Triticum aestivum
  Clone ID: PAT_TA_79291
acgcgtccgattcacatgaagacccaagaatacccctagcgccgcctcttatattatgggacagaggagtagtttttatttatcttcatttgacatattatcaggggcggcgctaggggtattctttagaaagtgtaatttcaatgacattcagttgtaattgctcagccaaataacccacgtacgttgttaatctgaagacaaattacacagttctctcttaatactgtcgttgcatcatgtgagacaagttactccagttgtacataggtatccatcatttccctcaagtatcaagtgtggctgatatgttgctctcacctatatcatctttttcttgcaggcaccttattctttcagctgcaatatttatttggatctctcagttgtgaagtgccatcatgtgtcaaaaacgcccttatattataggacagagggagtatttatactctgcacgcacaatgttaccgatttgttttcagtcgcagtatgccatctatctgaattttggatagcttgcatagtgcctaataagttcatgagctaattataatattatttatagagcttccatataatcattaggatgatgaagcatgtaagtattgtcactactaattgcattagcttcgcctcagaacttggaaggaggaagtagagttatcaacaatgatcaactatgaggtaccatagatatcgacgttt

SEQ ID NO: 79292 - DNA, 524 bp, Triticum aestivum
  Clone ID: PAT_TA_79292
tcgacccacgcgtccggtccctcctcatcgtccccccgccgcccctctccttcgatatgatctccttggcgccccgccgtcgccggcgactcctcggctcctcgcagtcgccgtcacatcagacgccggccactcctctgcggcctcacgctgtcgtcctctccttcgcaaggaacacccgacccttcctccgcggccttgtgacgccgaccactccttcgtggcctcacgccgccctcctctccctccttccttcgtccaagcccaggacttcccctccctgacccgatctgacggagagagggccaagccttgccactccgatggtcactttggccaaatccggttgggggagccaccgtagagcctcaacgtcggcgcagcagcagcagtccttgcgacggtgggtgccggagatcgtcaagcaactcgccgtcggcggccacgaccacctcattccctgccgtgcgtctccgtcaactactgtggcattgacgacagcgagttaggagcctacgaggtag

SEQ ID NO: 79293 - DNA, 668 bp, Triticum aestivum
  Clone ID: PAT_TA_79293
gtcgaccccgcgtccgggaaaccttttcagttacctaagggatccagaggaagggctaaaaactgcataagcatagccagtgagcacgtagaaaaagcattgcagtattcttacagggaccagcgtaacaagaaaaagtgacagaccgtatctctggatcgactccattgggtatccattaacgtctgagatttcacaaggaaatgagtttctttcattctcatgttgaaaagaattataaagaaaccaagcagaatatgatgtcaaacttttaagctattattgggtggccacctatcaaggtttgctgaaagttatgaacttgcttttcaaaaggctttgtattctgcatctttatttgtgcaagaaatccaattggaattggtctgttgtcctgtgcatgtactttcttttgttgcttatatatttcaaccacttatttatgttgtcctgtgcatgtacttatttatgtacttctgtctgggatactatatggctaccctctaatgcactgctcagccttcagtctctttctgtataattgacttagggaaaaacccactgtttcctatccttttctgaacagcgagatctaattattatgaaagacatctgtagtgtgttgctctctatataaatggcttgctctaattctgatttatcagact

SEQ ID NO: 79294 - DNA, 631 bp, Triticum aestivum
  Clone ID: PAT_TA_79294
gtcgaccccgcgtccgcacagatcggccaggctacaacaagactattatgcagcaatctgctcgagttttgaagctgcaggcagccccatcagatcggccagcaaaaagactcaattttttttctactatccgtccgcgagatcgccactgcccaggagcctgccccggcacacgagccgccacgcccaccctgaacttcccctgaaccagccggccacacacagctgtaattcttccctgcacttcttcagggaggagttatcctaaggtaggtaaagaagaaaatgtctgacactgaagctggctagcgagccactggttctgacactgcaacgctgatcccaaacacaaacagtggaagcttagaaggttcaagcaacaataggccacaaagaccacctggttcagagacaacacgaggttgtcgagatcacgctcgatgtacaacgtgattcagtgtcggtccaaggcatcaggccagtgcctgcggaagctgtgtggctgacacgaggaagagatacgacagaagtaagagtaccgctgcagtggcacttaagggcttgcagtttgtgactgccaaagttgccgctgatggtgcggctgctgtggagaaatcattcaatcacctac

SEQ ID NO: 79295 - DNA, 775 bp, Triticum aestivum
  Clone ID: PAT_TA_79295
accggtccggaatttccggtcgacccacgcgtccgcccttaccgaagaagataagaatccatatgtgttatgcaaaattaactttgtcatcttgtaagcgctctaggcagtgtctagagggtgaaaaatatgagaacaaaaaagaattactggattaatttacaacatccatcctttacttcgttcatgtcattgttgtttacccctgggagtatttttaacttgaaaatctctggtgaactgccatttagagtacatttgcttgctctgttaatttttttgggttactccatcttgctctgttaagtgaaattagatatgtggagtagcagcagtaagctagaccctccatcatgctctgtacatagtcaaagctactccaagttagcagtagtactgttaacttctcaatttgcttggattacatttaaattgtagtactctagtactccagtaattttgcttaagagtatttaacaagattgaactgtatttgtgcggagtaatttttcttggagtatttaacgagattgaacaagatttaacttttcaacatttaacagtacttttcagtaagtgttctaaacatgcttctgaatatttgcagattctgaacatgcaagcaaatatgcaggagtaaacaagttcttgcagtagatattgtaagtatttgttctgaacatggtactgtcaccgaagatattgcaagtggtctgacaagattttctcaatttgcaagtttagttacttttccagttaattaattggacatctt

SEQ ID NO: 79296 - DNA, 473 bp, Triticum aestivum
  Clone ID: PAT_TA_79296
ccagagcacactgctcctccgctctctcttcctcctctcctcctcctcccccccattttattttatttatttatgtatttatttcacccctcctgctagccaatccatcggctctgtaactgttcctaggagggagggatttgccccaaagttccgttcttgaattttgttcttgcttgtcccaaatccctacctgctgcatttgcttctgctcccggattcgagcgccccaatccagggagattcccacttcttcttgggcatttctggtccagatctttggctgccgcaagatctgaagaatcatccccacccacggcgacggcgacggcgatgaggccggagatgcgcctggattcggcggcgttccagctcacccccacccgcaccaggtgtgatttggttgtggtggtgaatgggaggaaggagaaaatcgcctccggcctgctcaaccccttcgtcgcccacctcaa

SEQ ID NO: 79297 - DNA, 318 bp, Triticum aestivum
  Clone ID: PAT_TA_79297
ccacgcgtccgcgagagagaggtgtacaagctttcgattggagcagcgtgcgggctgtcgtggccgtcggatagggtcatcgtacaggttctggacgattccacggatccaacgatcaaggatctggtggagctggaatgcaaaatttgtggattacgtgcgagatatgggatggttctcatgaggaagtcgggttccggttggaaatcggcatcaaatacagcgaggaaatcacactgttggacataagcatgcaggcctcagcccccataaaaaaaaaaaaaaaaaaaaaaaaaaaaaaaaaaaaaaaaaaaaaaa

SEQ ID NO: 79298 - DNA, 527 bp, Triticum aestivum
  Clone ID: PAT_TA_79298
aggaatgaaaccaatctgttccaccatgaaattccattccatttcatttggttcctcgtccaaacacacccttggttgtctctctccgcacccacacacatatacaacctaataagggtggcgcaaagggcaaactctcgcgttagccacgtcagattagctacgagacaaagggttcgcttcgtcgagaataaacagaaaattacagagaaaaggattggccagcggccctcagtcaccatccctcgattcctctccctctcccttgtctacccgccgccgccgcgccgcccacgacctccccaaccgctgacgttcccaccccctaccttctccttgcctcacccctcccccctcgcaccagatcgagcggcaggatccggcacgcccatggcgctctttaccgttcaggacgccatggacaaagtgctctggccctggtgctgcatccatggacaaggaggacatctctctctgtctctctgtgctgaatcaagttgcagctgctgcaacctcaatgccccagc

SEQ ID NO: 79299 - DNA, 178 bp, Triticum aestivum
  Clone ID: PAT_TA_79299
accggtccggaattttccggtcgacccacgcgtccgcatccacgacttcatcacaaagttctgaacacacccagcagaacccattggatttgtaacgtctgcgtgcatgcacgtgtacggttagtccgttcgtatgaatcatcggtcgtttcgtgctctaaaaaaaaaaaaaaaaaaa

SEQ ID NO: 79300 - DNA, 278 bp, Triticum aestivum
  unsure (1)..(278): unsure at all n locations
  Clone ID: PAT_TA_79300
cacgcgtccgacttgctcttgaacacgaaatatggtggggaatatcacgaggtcatcatgatgaagtcatcatcctttcttcggaaatttcatcgtactaacgaaagattaagggggtatgccgaagaatggatctctgcagggtagattatttggtagacaacaacgaggaaggtggcggaaagtaactctcgaattgaaatttaagacaataacgagagcaaagcaagaaggtgcnaaaaaaaaaaaaaaaaaaaaaaaaaaaaaaaaaaaaaaaa

SEQ ID NO: 79301 - DNA, 210 bp, Triticum aestivum
  Clone ID: PAT_TA_79301
gaccccgcgtccggtgagaacgttctgtgggcacaaaattcgatttgtagctagttgcacgttccccgctgatcgattagtgttgctagcagtatatggttactgattatcgccgatgtttagagcatctcaagccgaccttaagtttttcgtattgactttaaggaattttgacttataaaaaaaaaaaaaaaaaaaaaaaaaaaaaaa

SEQ ID NO: 79302 - DNA, 181 bp, Triticum aestivum
  Clone ID: PAT_TA_79302
tttttttttttttttggaataccgagactaccaagaaccaagataccaaatgtctggaaactgtacatgcattgaaacataagggcgtccagaatataacaagaccagcagcagcaactagcagattaccaagtcccaaaacagtgccaactttcacccatcgacagctactactcctggt

SEQ ID NO: 79303 - DNA, 551 bp, Triticum aestivum
  Clone ID: PAT_TA_79303
gcgtccgcccacgcgtctgccctccgccgccgccttctccgatgcctccccagctcctcctacacagcctcctccagctccgggtgccccctcgccaccccctcctccgcctcctccactcctacaaccccattgaccgcccgccgccgcaggacccgcccctgcacgacgccgagctttggatcgccaaggcgctcgcgactgccgccttactcctgccacactacctcccggcattccgccgcctcgcgccctcccaggtcgccgccgccgccgcgctccgccacgcgccttgcgcctcctcgacgctccacctcttctctgcgctgcattccccccactcccagctcgccatccccccgtccgctcattcctaccgttacgtcatctcgttgatgtgccagtccggccgccacactgatgccctccaactgttcgaccaaatgacggaccagtctggttactttcccaatgctcgttttctctcgttcctgtccggttcctgcgccactgcagggcttcttgatgccgctgcagcattgctctcaaag

SEQ ID NO: 79304 - DNA, 657 bp, Triticum aestivum
  Clone ID: PAT_TA_79304
tcgacccacgcgtccgatagcttgattttgtcttataaccagctctctggtgctattcctgctgagatctgtgtggggtttgaaaatgaggttcaccctgactcggagtttgtgcagcataacggccttcttgatctgtcatacaaccggttgactggtcagattccggcagcaataaagaagtgttctatgctgatggtgctaaacctgcaaggcaacttgctaaatggcaccattccctcagagcttggtgagctgacgaatcttacaagcattaatctgtcttctaatggattagttggaccaatgcttccttggtctgcaccattggtacaacttcaaggccttattctatcaaacaaccacctaaatggcaccattcctgttgagataggccaagttcttcccaaaatttcaatgctagacttgtccggtaatgtacttaccggaagtctaccccagtctttgctgtgcaacaaatatctgaaccgcctggatgtcagtaacaacaatctctctgggaaaattttattcttttgtcccatggacggagaatcctcaagctcactgctgttcttcaattcaagcagtaaccatttctcagggaccctagacgagtctatctcgaacttcacacaactgtcttctcttgatatc

SEQ ID NO: 79305 - DNA, 499 bp, Triticum aestivum
  Clone ID: PAT_TA_79305
tcgaccccgcgtccgggcgcacactacacaaggggagagagagagagagatatatacctcatcggcctagctaggcgtaaccgacctccctccctcccgtgggcggatcggcggccatggaggtggagccggcgtccaacgtatgggaggacgcccccgacaacatcctcctccgcgtcgccgcctacctccccttccgcctcgaccgtctccgcatgtcccttgtcagcccacactggcgccgtgccttgtgcgggcggggtcaggggcgccccccgcagctcccccttctgccgcctctgccgcccgtgctcccgtggctcgtcttccccaacaccgaggagccttccctcttctgcgccatcgaccgcatgagctaccccctcggcctcccgcgcgacgtccgcaacgcgcgcttctgcggctcctgtgatggaggctggctcgtcctcgcgcttgacacgcgccccacgcaggacgctctctacaacctctactt

SEQ ID NO: 79306 - DNA, 523 bp, Triticum aestivum
  Clone ID: PAT_TA_79306
cacgcgtccggaaacttgaaaagtatctggtggcaaggacgctgtaaggctatatttggtaaattctcaagttgcatgggtgcagtctctacatttcaaattgagtggtatttctgattctgtgaaagctgtactcccccgatggtataatttgtataaatttcttgtccaaaatgcaaagaaacttcacagcgaggacctcacagcattttctcccattgaccatgcttcacttctgatgtcatccaatgtgttagatggctggctacactcagtaactgtacgtctcgtcaaatttgttcgccaagaaatggatgatccgctttacacggttgtgccatatttggtaaaatacattgacaatcttgctgaaatttatgtgcattttaattacttccgtcttgtcggctgtactgaccgagaggaccatataatctctctttcaataatctaccatgcccttgtgacaatttgtttggtattggctccatttacacccttctttactgaagttctttaccga

SEQ ID NO: 79307 - DNA, 226 bp, Triticum aestivum
  Clone ID: PAT_TA_79307
gtcgacccacgcgtccggtctcatcaacatatgtatgcttgtgatatgctcaatctgggattgtccagtctgatgtttagttatgcttcaaagggtggcttaatttgatccatgtactcacatatttgtgatacatactgtcatattttgcactgacaattgtatccagcttctttttgcataaaaaaaaaaaaaaaaaaaaaaaaaaaaaaaaaaaaaaaaaaaa

SEQ ID NO: 79308 - DNA, 645 bp, Triticum aestivum
  Clone ID: PAT_TA_79308
gtcgacccacgcgtccgaaaccacaaaacccctccctccctttcggctcgtcttccatctctccgccgccggccgccgcgcgagtgcgaccatggcgcgcatcgtatcgcgggccctcccgttcgcctcgcgctcgcacctccatctctccccgcccctccgcggcgcggcgctgctcagctccacgccgctcctcccgcacctccccgcggcggcgtccacggcctccctgctctcctcgcgggggttcacgcccacccccgagccctcccgcttcgcgcagcctttcgcgggattcctttctggcatacgcggcttccgaagggcgcggcgcgggcaggcggcggcgaagcgagagccgccgcaggaccctgcgcccccgcccccgcccccgcccaaggagagcgagatagagctctgcgcccgcatcagcgtcgaggatgatttgcccgacgacgtcgaagtgctgaacgttatagaaatcatgaaattaaatgttcctatggcgatgaaaattgcactagatggacttctggagtataactacaaaacacgagacacttcaataagtgacgtccggaagtatgaaaagggtgaggtttctgtgttgctatgcaacgataacttcatccagaatcttaacaa

SEQ ID NO: 79309 - DNA, 531 bp, Triticum aestivum
  Clone ID: PAT_TA_79309
gcgtccggaatttagcattacatctgcaatagaggacctgagttctatgtctgcttgcccacgtgggcatcgcccattaagggctactggcgctgctatttccacagctgttgctcttctggaaggttgctgctcacctaacactggtggccgaatcatggtttttacatctggtcccacaacagtgggtccaggacttgtggtggaaaccgatctcgggaaggcaattcgttcgcatcgtgacattttcaatggcaatgtgcctcttgttgaaaaagcccaggatttctataagaaagttgccaagagattgacagacagtgcattagttcttgatcttgtggcttgctctcttgatcagattggagctgcagagcttaggtatccagttgaagtatctgggggcttaatggtgcttacagagtcatttgagtctgaacagttcaaaagctgtttaaggcaaaccttcaagcgtgagggtactgattaccttaacatgaacttcaatgcaacgattgaggtagtgacatc

SEQ ID NO: 79310 - DNA, 419 bp, Triticum aestivum
  Clone ID: PAT_TA_79310
tcgaccccgcgtccggtgacgaataatcaagtgatggtgaatagagtaattcattttgctgtgttgggtgtagtattcgcttgcctgcactgatgatcctcggttaagtagcagcagctatagttcatttattcgtttataatttatataggattagcaagtctgtccgacctaacaagtagtttttggaaccaaaaactgcctttctatttacagtgcatatcaaaaaaaagtaacattgttgtgtgtgctactgtaggtattagtgcaggatagaatgtgcatgatttgcatctatcatgtctggaacgtcttgtctggacatctagggctcctttggtttaaaggaattctatagaatttttggaagattgaaatccttaaaaaaaaaaaaaaaaaaaaaaaaaaaaaaaaaaaaa

SEQ ID NO: 79311 - DNA, 533 bp, Triticum aestivum
  Clone ID: PAT_TA_79311
acatatacaggttcttgagcactggaaccattgaggagaaggtatatcagcgtcaaatggcaaaagaaggcctccaaagagttattcagcaggaacaagcggacgacaaaatgcaggatcaaggcaattctctttcaacagaagatctgcgtgatctttttactttgcatgatcaagtcaggtctgaaatacatgaaaatttgaagtgcggtcgctgtaagaaggatcactgtatgccgttagatggtaatggtttggatttagatgccgctaagcctgatacagtttcgacatcaaaagaaaagttgtatactgatattggtggctttagagagatctctggatgtgtgcagaaaatgaattgttcaaatcaacagatcgaacaaccttctgaagaagatttacgaagttggggccatcattctgatccatcaactgtacctgataccatcctccagtgttctgctggtgaagaggtttcttttgttttcaccaatcagggtgatgggaaacttgttccagttgaatctatg

SEQ ID NO: 79312 - DNA, 426 bp, Triticum aestivum
  Clone ID: PAT_TA_79312
ttgaatgagctgatcaataaacaaagtctatgtttagatgtggatacatacagtcttctgatccatggtctttgcagggtgggtgagactgactgggcatatcagctgtttgaagagatggttggtagtgagatagtgcctaggtataaaacatgggagttgcttttggatgaagcacaaaggaaaaacatggagggtcgtgtcgaaagaattcgaaattacatgacttgttttggtatttccgtttaattggatgaattatattcctacatgattgattttctagtggtcagctgatagcgttatttggcattactttgacaactaatgaggcaatgctttaaaacatttgtgccaattatacgatataccacacactataattgagttcctcacttgacaaaaaaaaaaaaaaaaaaaaaaaaa

SEQ ID NO: 79313 - DNA, 308 bp, Triticum aestivum
  Clone ID: PAT_TA_79313
tcgacccacgcgtccgcatatcatatgcagtgttggtatacgtcagtgcagcggtgcagctgatgtagtactgtacaccatttcaaggtttcctctgcttttttcaggaagcaccataaaactctgttggtgggcttcctctactttatttcaaggcacactgcctctactttgcttaccactgctcctgctactatatatttgtgtgcttttgcttgtagtaagactgcacttatactgttgtaataagaccggaaccaaagtcgtgttttcatctttgagactatttttcaaaaaaaaaaaaaaag

SEQ ID NO: 79314 - DNA, 241 bp, Triticum aestivum
  Clone ID: PAT_TA_79314
tcgacccacgcgtccgcaaatcaaatcgcacgagaacagaaaaacgaacgcgaagctcctggaatcccagcaatggatcgctcccgctcgaagcgcgggtaccactacgaccaggactcgccgccgccccgctccaagccccgattcgaccgccgcggcgggggcggcggcccgaaccctaacgccaactaccaccgccgcggaccccccgggggcggcggcggcgcctccgaccgccgcg

SEQ ID NO: 79315 - DNA, 540 bp, Triticum aestivum
  Clone ID: PAT_TA_79315
cgacccacgcgtccgggagcagaggtttttgtttgttttcttgcggagaatactgcgatggggcgcgctcgcggcggcaggctgctcctggtcctcgccgcgctgttcgtggcgctgctcctcctctccggctgcgcggcggaaggggaggacgaggagggctcgccggtggcggcggcggaggagccggaggcgccgatggaggacaaggagaaggcggccctgtacgccgccatcgggggcttcgtcggcaaggcctggaacggctccggcctcttccccgacccctgcggccagactcccatccagggggtgtcatgtgatctcttcaatggcctgtggcacccaacagtggtcagcatcggtccggtgctcgacaactcgctgcagtgcgcaccggacgccaggttcagcccccagctgttcgacctccggcgcctcaagagcctcaccttctacgcctgcttcccggcggccaaccccacggcgatcccggccgcgaactggtacaggtttgccggcacactcgagacgcttgag

SEQ ID NO: 79316 - DNA, 310 bp, Triticum aestivum
  Clone ID: PAT_TA_79316
cctcatagaaatgcaaagggtacggttattgaagcatgtcttgacaaggctaaaggacctcttgccaccctagttgtacagaatggaaccttgaataagggcgatattcttgtttgtggtgaagcttttggaaagatccgtgcaatgtatgatgatcgtggaagccttgtagaccaagcagcgccatccaacgccgtgcagattattggcttgaacaatgtaccccttgctggtgacgaatttgagtctgttgatgaccttgatgttgcacgcgaaagggcaaacgcgcgtgccgatgcaatgagaattg

SEQ ID NO: 79317 - DNA, 611 bp, Triticum aestivum
  Clone ID: PAT_TA_79317
cgcgtccggggaaattatttcttgtctttcttattcaggttatttacatggaccatttgatatttccccaagctgccatcaatgagcaccagctgaattattctcttccaagggcttgcttcgtacatcaaacggactttgatcttgtattggaatttgacaagaacaagctatctttgggcaaagcttcattcgggaagtgtcgttttcgccctctatcggagacaccgtacatagcattgcctgccgaaggcccggtaggcaacatgactaaagttgatcaagatcagcaggttccggacagcccggattgtgttgatactgaagattgtggggctgaaaatgtcaacattaatgacaaccaagctgatgtggctgaggaagagaatcctacggaaggtggtagcaatccaacggaacatggcaaaagtagagacgaagatgtgtgtggttcactggatgattggcttcagaacccagcaccattcggtgcagagcttgagctaccatcacatctggctgcaatctacgacaagcacacaaaactatattctttagagttaaaaggggctctaagctcttttgggcaagtgttgcaagcaatacattgc

SEQ ID NO: 79318 - DNA, 587 bp, Triticum aestivum
  Clone ID: PAT_TA_79318
gtcgacccacgcgtccgggtggatggcggggccgggggcggtggcgaggcggtggaggcgggtgtagcgggcgacgcgatggaggttgacggcggcgctggtggaggtggaggtggagctggggatgtggagggcggaggtggcagtggagcggccggaggagcgcagctggcctcgtcaccggcgaccgtgttccggatccgcctcaagcagccccccgcgagcctcaagtacaagatgcgcgtgcccgagctgtgcaggaacttcagcgctgttgcttggtgtgggaaactgaacgcaattgcatgtgcatcagagacttgtgcgcggattccaagctctaattcaagcccaccattttggattcctatacacatactgaatccagagagaccaacagaatgttctgttttcaatgttagagcagattctccacgggactttgttcagttcattgaatggtctcctacgtcatgcccacgttcattattagtggcaaattttcatgggaggattactatatggacacagccaactaagggtcctgttaatcttgtacgtgactccagctcctggcaatgtgaaca

SEQ ID NO: 79319 - DNA, 262 bp, Triticum aestivum
  Clone ID: PAT_TA_79319
gcgtccgattcggcatggccgccttccacctcctgttcctcttcctcgtgcttgccttgtccttcagcggcaacagcgctgtcgccgccgtggttgacgaccagcctcggccgcagcaggaggtctgcatggcgtcctcttcttcatcctgcccagaagccgccgtcgacgccaaggtgctcaagggggaggccagcgtgatgtacaaggagaaggtcagctcgttcttcaagcatgatgttcgcaccatcaaggtcgactt

SEQ ID NO: 79320 - DNA, 491 bp, Triticum aestivum
  Clone ID: PAT_TA_79320
cgacccacgcgtccgggaaacagtaccgattatgagtatcttggtgctttggcaattttggcgtcaagaggaatttaaggggagtggacgatgcagacctgaacaattatctgttgtgctaggagctagaattcagttagttgtactaatcagttttgagtaccgccacttcaagtttcaaccagattggatactattgatcaggccacctgcgcaagagcgaacatcagaggtcaaatttccgttgatcatgggcaaatgtattcttatttgcttgaagattcaagacaggattatcgtcactctaaacatactcggtaagtttatccatccatcagttgcaccttttgaatggtatcatagtcccttgtccttggagctgatcagccatgtggtagtcatcaaactgattttctgggcttggattacaacttgtgttgtgatggaggtggacccaatagcaagtactgtagcttgggaacatttttgtt

SEQ ID NO: 79321 - DNA, 588 bp, Triticum aestivum
  Clone ID: PAT_TA_79321
ccggtccggaattctccggtcgacccacgcgtccgaagcatcagttaccgccattaccaaagtttatgaataatcggggcgccgagtgacccgaccccgagctctcctgctagcgcgcaccggcggcggccactccggccccgtcggccaccccaccgctggctcgcagcccagccgccatgttgccgccgcctccaccctcgttgcctgtgggcttcaagccggttgacgtcccgccgccatccctatcgtcttcccggtcagatccggatcgggacctcctgcttccgccgccgcagacgacgacgctggacctgcccacccagcttcgtgccgtgcccatggcggtgctggtgatgcctccgtgcgagctcgtagcgcccacatcaccgaagctccccatgcccgcggctaccggcaactgcccagctccggcgccggccaccgcgacaccgacgccacccatgcccgcggcagctggtggctgccccgctccgtcgacgacggctgctgaggtcgacatcctggtccccgtgggggctccgtccctcctccagccggccgcgcccgggagctcgcgtccatcgc

SEQ ID NO: 79322 - DNA, 614 bp, Triticum aestivum
  Clone ID: PAT_TA_79322
tcgacccacgcgtccgaggaaaaggaggcaaagaaggagaaacaggaacataatcacaaagagcatgataagttaagagaaaacagtatagattatcagatagacagtctgatagatagtcttgacacgaagcccttaacccctcccttggctcctccagctgatgatgctaaagttatcctagctgatgaaaacctgaagaagcgaaagaaccacgagatgaatggttacctacaaaaccatcatgaaatgcggcctacaaagttgccgagaccagccccctccagcaatcatgtggagaatggtacagcatctcatgtagccgcgccaccctcttccatgaagccagatgccatgaaaatcgaaaaggctgaacggctccctaagaaggaagagaaggtcaatggcaacaaggaagctcagcagcgaccttcactcgattcagggcttcgagatcctctccctaataagaaggaagagaaggtcaatggcaacaaggaagctcagcagcgacctttggtcgatacagggcttcgagatcctctccctaagaaggaagagaaggccaatgtcaacaaggaagctcagcagcgacctcaggtcgttacagggct

SEQ ID NO: 79323 - DNA, 450 bp, Triticum aestivum
  Clone ID: PAT_TA_79323
ccacgcgtccgcgctcccgtgagaacaggaggaaccgtgagcccccgcagcgtttcaggcgcagggacgacggcccgaggcctggacagggtggcccgccccgtgctggtggccctggaggccctggtggtgctcctgccggcgctggtgctgtccctggagctcctgctccccgtgtggcgctttgatctagttctggcatgattgggcggtggcgccatccctagttttacccgtgtctggatattgaactattctacctagtttttgctgcaatcggttgtactgaaagttggttggtcaaaagcacaatttgtgatcaggtctttaatgttttggcaatttcgctgctatctataatcagagagaactttttggttaaaaaaaaaaaaaaaaaaaaaaaaaaaacaaaaacaaaaaaaacaaaaaaaataacaacaaaaaaaaaag

SEQ ID NO: 79324 - DNA, 573 bp, Triticum aestivum
  Clone ID: PAT_TA_79324
gacccacgcgtccggcactttttaatgaactggcttttcatccatcctcacccttatcatcccctcccaatcctccccattgccgatagccggagagtgccaaatctgaagaaccaccggcgcgcgcatctgccggaaggatctgccgaaatcgaagctacggtcacacagataattctagccgttagtatgcaaatcacgcttggtccagcaatgaatctctcagagacagctcttacatcttccaatggtagttctactcccacatctaggatatctgttcaaaaattatgtatggcagtagctcagttttcccaattcaagagagaccttgctaaggaaacaggcttcggtggaatgctagaattgaagataatgcacaagactaatctgaagttcagttctttcctaatggagagagttgacaccgagtcttcaagcttgttattagacgtagatagggttatccaaatttctgacaaagatgttcaagacgtttttggtctgccaattggcaccagattgattccgaattgcatgacagacatgtcgaacgcctgcatagagttcagc

SEQ ID NO: 79325 - DNA, 446 bp, Triticum aestivum
  Clone ID: PAT_TA_79325
tcgacccacgcgtccggctctctctcctagccctgctgctagctcctagctccatcttggcgccggcaaagagagacatactcagatggcggcggcgcggtcggcattggcgtctgccggccgtgcggcgaacgaggccgtcagcttcgtggtgttcatgctgctggacgcgctggagctgctgctctgcctcgtctacaaggtcgccgactacgtggccgagggcgcgtggcggccgtgctactgctcgtcgtctgccgtggccgcgccggggaagatcgtcgtggcggagcgtggcgggtccaaggtggtcagcatgctgtcctccaccaagctgctcctggaggacatctccgacacgctgtacacgcggccctccctgctcgccagcgccgccgggtcgtccccgccgtccttctcccggcgccgggagaaggcgaggccgt

SEQ ID NO: 79326 - DNA, 564 bp, Triticum aestivum
  Clone ID: PAT_TA_79326
ccacgcgtccgcagcggccgtcactgtcgctgtcgcagaggagggacgagggagcgaccgaggggggttccgtccggtcgtgctcgcgtccggtccgctccggggagaaaggcggagctgcgagggaggccctcgccggccggcatgcagaacgccgtgctggcgtgccccgcgccgtccggcggaggggcgggaggagacggcggggtcgggggcgggggcgcgggcgtcgtgatggtgaagcgcgcggccctggtggcgtgcctgacctgccccctctgccgccgcctgctccgcgacgccgccaccatcaccgagtgcctccacaccttttgcagaaagtgcatatctaaggagttcatcgataaggagatctgctactgccctacttgcaacattgatttaggctgtgctccagaggagaaactcagagttgatcacagcctacaatatgtgaggtcaaagatatttccttctaaaagacggaaggttgtggaccaagaagccatatcaccggtcgaatcacctgtcaagagaaaagaacgatctctatcttcactgaca

SEQ ID NO: 79327 - DNA, 538 bp, Triticum aestivum
  Clone ID: PAT_TA_79327
ccacgcgtccggtggaaatcatggcatcgaccatatgaaccttcatgtatttgatagtttgctcgatcagttttatgccttccactacagctaaggctactacgcagcttcattgagattttttctataggatttggattaataatctccaataatatggtcatgcttcttataattactttcatgtataaatacatttgtgattttctgtatgttgtactactaaactgtgtgctataccaagcctaagcaatgttaagtagacctttgaattcttaataaggaaattacacaatctgttctgtgtgctgtaggattagtgttgtttgaagatgtttttcttcttaccaatcaggttgatgattttgactgtcgatgcagacgctgtgccggatgttcatcaccggtggcagtcatggattcaggctcctgtggaactcatggcatcgaccatatgaaccttcatgtatttgatagtttgctcgatcagttttatgccttccactacagctaaggctactacgcagcttcattgaga

SEQ ID NO: 79328 - DNA, 718 bp, Triticum aestivum
  Clone ID: PAT_TA_79328
ccacgcgtccgcgggcttccccggttctctcccctcccatggtcaggttccaatccctacttctctggcgatttgagacttgcgtgtgactagcagcctcccgccccacctcatccgctggaggccgaatctgttccccgccatccaccggctcgccgacgaggcaacaagactcagcagtaagctatttgcatgatggaggctgcggaatttcgcccttggtcagatcttccgccagaactcctgggacttgttctcaagcgcctcccttccctagctgaccgtgttcgtttgagagctgtctgccacccatggcgctctaatagcaggttgcagacccttcctctcccattcccgtggctcactctccctgatggcaccctcctcggcattccaagcggtgaaattcaccacatatctttaccggaaggtgcgtgttgccagggctccattgacaacttgctattcctcatgcacaatgatggtgtgtgctacttgatgaaccctttctccaagaccaggttgcagcttcgtaagctagcaaaggtatggaagcgtgagatatatgatcccgaaccccgaattaacccaattttctacaacttggtggtgccctttccacttgactcgtcaccctgttccctacttgctgcactgatcatggatgatggtaactggggtacactttgtattagtcaatcaccgattgtcactgact

SEQ ID NO: 79329 - DNA, 360 bp, Triticum aestivum
  unsure (1)..(360): unsure at all n locations
  Clone ID: PAT_TA_79329
gacccacgcgtccgcaaaaaaaaccctccgaatggcgaaggtacaggaaaccctagtagcgctggccgccggcgtctccaccccgctgcaggtagtgcggagggacgcatgcgacgacggtggccggcggctccctcaccttgcgctctcgatccacgcaccatgcgagggatctcatgacattcgtcaggcacaggtcatatctgtctctttctaaaaagacatgggagtntctgtttcttactcgagaaaagacgttctcatggacccagtgttttggaaagcagcagaaaatctcatggatccagtgtttaggaaagcagcagataaaggaaatatagttagcctacaagagcttgt

SEQ ID NO: 79330 - DNA, 628 bp, Triticum aestivum
  Clone ID: PAT_TA_79330
gtcgacccacgcgtccgactcgatatgggattcagaagagatttgaaaaaattatggctgccactcctaaagaccgtcagacactgctattttctgctactgttccagaagaggtccgtcaaatttctcacgtagcaatgaggaaggactataggttcattaacacagttaaagagggtgacgaggagacacattcacaggttagccagatgtgtatgatcgcaccacttgatctgcacttctctatattatatgatgtactgaagaagcatgtcgcagatgatgcggactacaaagtgattatattctgtactactgcaatggtcacgaaacttgttgctgaagttctctcccagctgaaactgaatataagagagattcattccagaaagtcacaatctgcaagaactaaggtctcggatgaattcagaaggtcaaagggcgtgatattagttagttctgatgtgtctgctcgtggtgttgattatcctgatgtcaccctcgtcatacaggttgggattcctgctggtagagagcagtatatacatagaattggtagaacaggacggaaaggcaaggaagggctgggcctcttactggtggctccctgggaaagtcattttcttac

SEQ ID NO: 79331 - DNA, 516 bp, Triticum aestivum
  Clone ID: PAT_TA_79331
cgacccacgcgtccggtgcctcggtggacctgaggcaaaagaaagaatcaaattcttccttgcagctaaaagaagaaaacgagataacataaacttttggagtacttagtgaggtaaattattccaatatattagcccatttctggttatgctgctgcattggttcaaaccgagaggatattcttccagagccttgcttgcacagagcctgtgttgcagcactgcatcttgcatgctgtactcccattggttctaaattgtactggtctctattccatggaaaaactgtaggtgacggaggtttcgttgttgcaagtgtatatgctcgagttgtagctcttacctgatatcctcatttgtacatatatctccgtaagtgtcatctgacaggatgtattaaagtcttaattgatgaacaaggtaatggccttccgtcaatcttcctttcagtttgtcgtcgcagcggaatgtgcctcggtggacctgaggcaaaagaaagaatcaaattggtctaaa

SEQ ID NO: 79332 - DNA, 139 bp, Triticum aestivum
  Clone ID: PAT_TA_79332
cggtccggaattcctgcgtcgacccacgcgtccgggactatcataaaaattaaaagttcatttgaaactagggctgaaagagcgcagttagagttgattggaaagggagctagcttgtatggctccactgtgtctgtgt

SEQ ID NO: 79333 - DNA, 673 bp, Triticum aestivum
  Clone ID: PAT_TA_79333
cgcgtccgaaacaacatttcacactcacaatggccactatgagttcaatgtggtttcctttggcttaacgggtggaccgcctacttttcagtgtgaaatgaatgagacactagcccctgtactgagagtctgcgttgtagtattttttgatgatatttttgtatttagtgcgacccttcaggatcatgttaaacatctcagacaagtactacaattgttgaagcagcattagtggagggttaacgagaagaagtgtgcatttgctcagcgtagcatttcctatctgggatttgtggtcagtggtcagggagtgtcgacagacccagccaaggtgcgagatgtgttgaactggctagtgccccaatctgtcaaggagctccatgggtttcttggactatctgggtactatcgcaagtttgtccgtaactatggtgtgattagtcaaccattaacccaattgccgcggaagaatgtgtcgttcgtgcggacagcaacaacacagacagcttttgatgttctgaagaaagcagttacatctgcacctgtacttgcgttgcctaatttctgtcttaaatttacagtagaaactgatgcaagcgatactggtgtggggcagtgttgattcagcaaggccatccaattgcgtttgtcagtaaggggttaggaccacgta

SEQ ID NO: 79334 - DNA, 464 bp, Triticum aestivum
  Clone ID: PAT_TA_79334
tcgacccacgcgtccgttgcttcaatttcgatccacccaccgctggacatcgccaaaaccccagccagctggccaacgcgtccccgggaagcaaatcaaatggagatcgaaatagcacccgactcccctgcccccatgccgcgctccggcgacatcgcggtcgccgacgggaccgcgactctctctccgccaccgtcgccgccacagggccctgcgtcgccgtcaccgtccctctctcctcgggatgacgtgctccccctctcccctccccgcaacagccccgcccggcgccgccgctctaagccccttcgcgccgcggtcgtcgaccaaggcgcgggcgccgtcgggtctccgcgaaggaagcgccgcggggcgggggagccgcgcacggccgcgtcgcccgggaagaacgtgaggcgagcgcgccggcggctggacaacgatggcgggagggagttgacggc

SEQ ID NO: 79335 - DNA, 415 bp, Triticum aestivum
  Clone ID: PAT_TA_79335
gacccacgcgtccgggcgcgggtgacggcgacgcggcgggggcgtcggcgtccgcgcccgcggcggaggccgcctccccgccgccctcgcggggccgctcggccaagcgggccaaggcgcagggcaagacgacgcgcgtggtgtcaggccccgtgttcgaggccgccgccaaggcagcgggccgcgcgatcgagagctcgcagctgagcgcgccggccgcggagaggtccgccggggccgtcgcggcgtcgtccacggtgtcgaattcgggagcttcagcgaggaagaagaggacgcccaggcgtctgcctccgtcggacgagacgaccgcggaagagatgacgcagtggaatacgaggcgcggggcggccagtagccggactcatgcctgggccaaactgatttcccaatcttc

SEQ ID NO: 79336 - DNA, 577 bp, Triticum aestivum
  Clone ID: PAT_TA_79336
ctcagccaatgcattctctatttcctgactgggatactggcaaacccgttgaaacggatatgtgtagtctgtatgaagtataagctaggaatttgggggtttctagctctttctcgctatctacaggcatgcgttttgaaatgcattaatggagatcttcgtgaagcagtcaacatggacttggtttcctttgcaaagcagttgttgaactctgacccactggacgaccagctgttgggaattcgtattcttgaccacctcctcagaagcagggaagaccaagatgaacgctacaaggaaaaggtgctcacaaagattcgatcttctcttgataccgtcgagaaagcagtatacatgatgggcttggacagagaggtggaacaagataccagagggcacgctgcgcgcatactgctggagctcgcacctggccttcaagtcgagagctttcctggtatttttcaggctatttcttcactgcttagcgcacgcaagacaaagaccagcggaagctccagcaattcaacctgtgcgagcaaagagctcaaattgcttggtgtggatattctcgacaaac

SEQ ID NO: 79337 - DNA, 608 bp, Triticum aestivum
  Clone ID: PAT_TA_79337
gtcgaccccgcgtccgcaagtccggtctccgcctccgccattgctccaccacgccgatgtcccgcgtccgcctccaccgccggctcctctcctccacctcgccgccctcacgttcctggtctccccgcgacgcctttgccgcggccacagagcgcctgcgcgccgggacgctctgtcgagatgatgcacacaacctgttcgacgaattgtttcggcaggccacctcggtccccgagcgctccctgaacggcttccttgccgccctcgcccgtgctacgtcctccactgcctgcatcaaagatggccccgccctcgccctcgcccttgctctcttcaaccgtgtgtgcagagaagaagccggcccgcaggtggcggcgcccaccgtttgcacctacaacatcctcatggactgctgctgccgcgcgcgtcgcccagacctagggcttgccttattcggctgtatcctcaggacgggcttgaagatacggggtggatgaggctgtgaacgtgctgcttcacaggatgaggctgtgaacgtgctgcttcacatgatgtccgagctcggctgtgtgcctaatgccttctcatactccattgttctgaagggc

SEQ ID NO: 79338 - DNA, 708 bp, Triticum aestivum
  Clone ID: PAT_TA_79338
ccacgcgtccgagatctcaaacaactgattctttaactgctcttctatacggtatagatggatccttaagtcaggacaaaatccctttcccttccatggcgacgcaaggagctgactcgatttcaacattaatggataaatattttcatccatcaagttcagagacggcgtcatttgctagggagcaattgtcctgtgaaaataatcttcaaagaaatgacgttgtagctgcatttgtgaaacagcatgaaactttgaatctgcaagaggaatgtactgccagagcaaagcaaattggaggtgaaaattatcagtcagaatgtagccaacagtatggcaatgttggactttcatcaaacatggatgggagtcattgttcctcaaacttgtatcaaaatcaaaaagcaaattctgaactcctagagaggattgcttcagactcaatagagaaacccaaagatactaataaggctttacctgaagttcctgctgacagatcaaaagcaaagaaggcaagggctggtaaaaagagaacatatgattgggatattttaagaaaagaagttcttgctagtcgaggaaacgaaggaagaggtgagaatgcaaaggatgcacttgattgggaaacaataaggcaaatagatgtgaaggaaatatctaacacaattagagagcgaggaatgaacaacatgctctcagagcggatac

SEQ ID NO: 79339 - DNA, 538 bp, Triticum aestivum
  Clone ID: PAT_TA_79339
ccacgcgtccggtcggcgcctccctccctcaccttccgcgcccccctttctcccctttctccccttcctacggcttctcctccccctcttcagtcttcacccctgcccaccctcgcagatctcgccattccctgccacgccgccgcccgcccgcccgcgcgccccgttccggcggaaggtctccgcctctcccgcagcctccccggagagctggaggggcctgcgccaatccgacggacggcacggctcctccctcctcccctgctgccccggccggccgcgatacgggctgtcgatcctcgggttcgatcgaagacgcaggcgcctgtgcgaccgagtgcgcgcgcggagggtcagggccggcgccgagatgaagggcgtgtcggcgatccccgccgtggcgatcatcccttcgccgctcttcctctggcgggccaaggttatattgtttctcctatggggtttgtgctgttgcaagatagggtgggactcggttatgagaatgagtgttgatctgcgagacttatttttatacgag

SEQ ID NO: 79340 - DNA, 616 bp, Triticum aestivum
  Clone ID: PAT_TA_79340
ccacgcgtccgcgcttctccgcggtttccccatatcaccctccccgcctctcctctcccctcccccacagccagagacccgttccgtcccgtcccgttcccttcctcttccggcgacccgctccctcgccggcaacccccgcggtggggcccccattgctggccctcaattgcgccagtgcccccgcctccacctccacctccacctcccgcgtagctcgcgcgggaaaataaccgacggggcgaggaaggagggccgcgccgcgcgtgccggcttcggtcgggccgggagggatccccgtcgccgctcgctcgtccggaggggaatgcgggacctgtgccgccggggaattgtctagacgggcctccgcaaccgcgccgcgccccgccggagtcatggtggagggaaggagctgtctccctgcagagatcaggaatgggcttgagactctgaagaagaggagacttgagaggatgcgtttgagtgctcagaaagacaccggtgacaatcctgccatggctgcgaggagcggcggggattcactgcggactcctgcaaactgtggggtgagattgcatgccaacaacgttactgcgggtttacctagcactagcag

SEQ ID NO: 79341 - DNA, 675 bp, Triticum aestivum
  Clone ID: PAT_TA_79341
tccgcacacatttactgcacttgggtgtcagaagatgaatattttgaggctgcgaagatacaccctcggttgaaaactagattgaataacttcaatagacagtttgagtcgacggataaatctgacgatgactatgttccaattaggcctgaatggacaactgttgacagggtccttgctagcagaaaaaactctagtggtgaaagggagtactatgtgaaatggaaggaactttcgtacgatgaatgcacatgggaaagtgagtctgacatctcggtgtttcaacctcagattgagcgctacaatgagattctgtccaagcgcaagaaatctactgacaagagtaagaatgccgatcgtgcgatgcgtcatgctgaagggactcccgagtttcttactggtggcacactacacccttatcagcttgaagggttaaactttctgcgttattcatggtctattaataaacgtgtcatccttggtgatgagatgggtcttgggaaaacaatacaaagtattgcttttctggcctctgtgtctgaagacaagtttggtccccatctagttgttgcccctctctcaaccttgcgaaattgggagcgtgaatttgcaacttgggcacctcaaatgaatgttattatgtatttcggatctggatcttctcgtgacattatc

SEQ ID NO: 79342 - DNA, 580 bp, Triticum aestivum
  Clone ID: PAT_TA_79342
ccacgcgtccgagcttatattagctgcaactttgtgtttttatcagtggtagtatgatattgtccttaactagtctgattgaacagtgtaaactgtatgtgttgaatatttatggcttatgtatttcttcaggtgcagtaacagaaatgatattaaggttaattttagtggtaggttaggtaaatatttcgtggtgaatgagtaggctaatctttagccagagaatatgcacgattatgtgtaaaataatttactgaattgcacttgctacatataactatgttgtcgtacttttgtttttctttatttcatttataatttttttgcttgatatgtgctagtagattgagcagcttctatctgttctcactgatcccacaattcaacctagtcacaattacttgtctaaaatcaagtggaggatctttgcagctacttgatatgtgttactggattaagcagcttctatctgttctcaagtgatcccacaattccagtagtcgcagtaacttgtctcacatcaaatgttagatttttctcatagatattattgctggatcaatcttctgatgttattgct

SEQ ID NO: 79343 - DNA, 696 bp, Triticum aestivum
  Clone ID: PAT_TA_79343
ccacgcgtccgagcgacggatactgaagcaagaaaccaatcgagttccttgattcacctgcaggagaattccttgctgacgatgaggactatggcggcgccgtcggaggcggcggtggaagcattcaagcaggcgctcgcgaccgccgcctcggtgtccgcgtacgccatgcttgcgcgcggcatggcgggggagctcctcccggatgagttgcgcgcggccgtgcactggggtgcggcgttcgtgcgctcccgcttcggcgcccgcgacaaggagcgccacaccatcatcatccgacactacgacaacgggtccagccagaacagcttcttcgacgcggcgcgcgcgtacctggccaccaagatcaatccgcgcacttgtcccggctctgcctcgcgcgctccctcatcaccgagcccgacgggagcagcagctggagcacgctcctgtccatggaggacgggggctccgtcacagaccacttcgacggcgttgagttccggtgggcgttcatggaggctggcggcgatgacggcaatagggccaagggcgggggtgagacgctagagctcagcttcgacgcggagcacgcggacaccgctctcgacaagtacgtgcccttcatcagctccacagcggaggagctgcggcgccaggaccgcgcgctcaagatcttcatgaacgactacgggtttt

SEQ ID NO: 79344 - DNA, 280 bp, Triticum aestivum
  Clone ID: PAT_TA_79344
cgtccgcagcccattattccctcccagtcccagccccaaacctccttcgccttcacccagccccccagccattgatccccaatccgcgcgcccaccctcccctccacgcgcgcgggcggccatgggatgagccgcggcggcgggggagcccggatccggacctagggttttcggctgccacgcgcgcgcgcagccatggagtgggacagcgagtccgacggcggcggcagcgccgggagcggggacgagatggaggaggaggaggaggaggggggagagg

SEQ ID NO: 79345 - DNA, 668 bp, Triticum aestivum
  Clone ID: PAT_TA_79345
ccacgcgtccggggaaagatgaggccgtgcgtggcggacgcggcgtgcgtggcgcagctgcgggcctgcggcgccgtcctggccggcaagaccaacatgcacgagctcggcgccggcaccagcggcatcaacccgcaccacggctccaccaggaacccctaccacaccgccagggtgtcgggcggctcgtccggcggctccgccgccgccgtctgcgccggcctctgccccgtcgctctcggcgccgacggaggcggatccgtacgcatgcccgcggcgctctgcggcgtcgtcggcttcaagcccaccgcggggcggctctccaactccgggcttctcccgttgaactggacggtgggggtgccggggatcttggcggcgacggtcgaggacgcacttatcgctccagaccagctcactcccagccccagctgaatctgccgatgctgacatccacccattgcatgcctaacatcaggctcgcaagatacggaaagtggttcaacgacagctccgacaacatccgaggctgctgcgacaaggctctgcagatcctgcgcgcacactacgggtgggagaccgtggacgtgaccgtgcctgaggtggaggagatgcgtctggcgcactacgtgaccatgggcgccgagtgctccgcttccctcgccgcc

SEQ ID NO: 79346 - DNA, 771 bp, Triticum aestivum
  Clone ID: PAT_TA_79346
gggtcgacccacgcgtccgggacgacaaggtcgcgtatggagtactttcactgttaagtttccattgcccagctcctgaaggtatgatgtctcgacgcctaatttgcttgtttttacttgttgagggatatataacgggagtgagccccattgttgaaaatgttttaaagagatcgacaaacagtatagctcttagcacacatatgttaatttcgttttttgggtgtatgaatgctgccctatcacatgagtcatatgatttataagttgcactgtcatatgatgaatttatggtatatcaggcttaaatttggacttttgtttggagagatgaagtatggagaatcgacgtctaaaggaaaataaaatgctcgcaatatgtttcagttcatatgataaatgtctcatgtttctcctatgtaatattacgctaaagtctatttttttctctgtactacttaatcttgattctatctcaaacccccaaacaaaacctgcgtgtctttttcatttatacattagtaatggtgtgatgtactaaccagtttttagtaaacctgatgatccaactatatattttaatcatgtatgtgcttgatgattaggcacatgtaagtgtttttgtcatattgttcaaacaatgatctgctaccactgaagttactgatcatctcttgtttggaaggcaggggtatgctttggtttcttgctatttgcctttctcttaaagcactcgactggatgcatccgacagtttataaatcaataatt

SEQ ID NO: 79347 - DNA, 226 bp, Triticum aestivum
  Clone ID: PAT_TA_79347
ggtcgacccacgcgtccgattagcagcctagttatttcggcctctccagtgaaattaaactttcctttaacacaaacaagagtgcagtaggtttcagttccatcacatgtctcagcaaacatcttgtggatgagggaatatgctgtaacatttgtttcaaagtggatactgtggatagaaaccagtaatcgcacatgatcatggatccgcggggtgaaccactgtt

SEQ ID NO: 79348 - DNA, 644 bp, Triticum aestivum
  Clone ID: PAT_TA_79348
ggtcgacccacgcgtccgtgcttttataaggtggagtctactatctgagaatcaaacttttgaagttgttgatgcatctgaggctttgactgttgaggccttaaagcatcatagtagttcttcggcacaatatggcaatccttgtgcctggatatctctaaatgcatctgctgctggtcgagccacaatagttgcgacgttttcctccgagtccgattcctattttgagacttttaatgagcctatttttctgaaggccacatcaaaagtatctgcatattatcctcttctggtactccaagcaggaaatggaaaccagtttggtggttactgggttgacttatctagattacagagtggaattcagaatatgggtaacaactctcccatggagctgtacttggttcctggatcaaccatggatgtgtttctctttggagggcctgaacagtgggacaaagtggttgattttgtcgaaactgttgatgttgttggcgcactagaaaattatatcattggctctactgctgtgcaaaaaatatctagtggactataccgagtttcttgccaaagcaaagggatctttaaactgttgttatcacgtggaaacatgattgggaaggatcatcctgtgcctgctgttg

SEQ ID NO: 79349 - DNA, 615 bp, Triticum aestivum
  Clone ID: PAT_TA_79349
ccacgcgtccgcgccgctcccgccgcccctacctcctcatctccttgctccgttgctcgttgctactcccgtcgccggtgccgcccgcacgagccgccggtgccagatccgcgtcctcccctggacggctccggctcgcctccgcctaatcccagtccgcctcctgtccttcatccgtgaggtgcctcccgacctgcttcctccgccacatcagagatagcacccagatctgtgtcctccccgccgtatcccttctcccctgaccgcctctggctgcctgccgggcaatctgcgacctcctcggcaggggcgcacggcagaccaatcagccgccgagccaagagagcagtcgagatgacaggaggaatcgtgaccgtggcgagcggggtgatgaaccccctcatcggcaagctcaccacactcatgggcgacgagtacaagaagttcaaaggggtcaggaagcaggcctccttcctcgagaaggaactcagcgccatgaacgctgcccttcagaagctcgagctaattgatgagattgatccaaccatcaaggattggagggatcatgttagggagatgtcgtatgatatggagaattgtatcgatgacttcatg

SEQ ID NO: 79350 - DNA, 601 bp, Triticum aestivum
  Clone ID: PAT_TA_79350
ccacgcgtccggccaagacggtggcggagaaggaggcgtggcggctggcgacggagcacgggctggacctggtggtggtgaacccgtcgttcgtggtcgggccggtgctgggccgggcggcgcccacgagcaccgcgctggtggtgctggcgctgctcaagggggacctgggaaagtaccccaacacgacgatcgggttcgtgcacgtggacgacgtggtgctgggccacgtcctggccatggaggacggcagggcgtccggcaggctcatctgctccggcgacgtcgcgcactggtccgaggtgctcgggtcgctccgggagcggtacccgcagtaccccatccccacagagtgcagcggcgggaagggagacgacagggcacacaagatggacacgagcaagatggaggcgctgggcttccctcctttcctctccatccagcagatgttcgacgactgcatcaagagcttccaggacaaggggctcctccttccttgacatgacaccggccggcttatatatatagatcgatccaagttgtgagcatctgtgcgtcatattatagtcagtacgcatagtacaatatgtaggaacctcaa

SEQ ID NO: 79351 - DNA, 701 bp, Triticum aestivum
  Clone ID: PAT_TA_79351
ccacgcgtccggcccaagcacttcccaaggttaatggctctaaggttaacctcaagactacaggctcagacaaggaggatacagtgccttacacttcctcaaagaccttctataaccaactgcccgactggagcatgcttcttgcagctgtcacgaccatcttcctggccgcggagaagcagtggacgatgcttgattggaagcccaagagacctgacatgcttgttgacacatttggctttggtagaataatccaggatgggctggtgtttaggcagaacttcttgattaggtcctacgagattggtgcagatcgtacagcttctatagagacgttaatgaatcatttacaggaaacagctcttaatcatgtgaaaactgctggtctccttggagatggttttggcgctacgccagagatgagtaaacggaacttgatctgggttgtcagcaaaattcagcttcttgtagagcattatccctcatgggaagatatggtccaagttgacacatgggtagcttctgctggaaaaaatggaatgcgtcgagattggcatatccgcgactacaattcgggcagaacaatcttgaaagctacaagtgtttgggttatgatgaataagaccactagaagactttcaaaaatgccagatgaagttagaggtgaaataggcccgcactttaacgaccgttcagccata

SEQ ID NO: 79352 - DNA, 370 bp, Triticum aestivum
  Clone ID: PAT_TA_79352
cgtccgccttcctcctcccctctctctcccccgaaaaggagaccaccagaccttagcttaaaaatccaccccttaattccggatccgacggcccagatctctcctgcccgcatcgccccgtccaacccccttgctccccttcttcccgccctccccccatgtcgccggcggcggccggcgccgcctcctccggcgaagcgccgccgtcgcgcgagccctacaccatccccgcctcgtccggttggttccgctgggacgacatccacgagacggagcgccaggcgctcccggacttcttcggcggcgccggcggcaccggcttcgggacggcgacgcggaacccccggatctaccgcgagtaccgcgacta

SEQ ID NO: 79353 - DNA, 536 bp, Triticum aestivum
  Clone ID: PAT_TA_79353
gcgtccggcagcagctactccttttcgagctgcggttcgcaatcgaagcggcagtccggaatcaaagcagtccttcccgggctacaatcagaatcagttatatatatctggcctggcggcaccctccaatattcggagaagacgcagcagcaactccttagacatcagtttttagactgaccggcggcaacttgggcgatggcgaggactagtagccggcgacgggctgccaaattgatggccaagccatccggttcgaccatggtgaaaggcaatccagatgataggatcagcagcttgcccaatgacatcctggtcaacattctcgaccggctcgatgttcgcgccgctacgagaaccagtgtcctctcgagacggtggagtcagcttcctgccatggtcccacggcttacaatcagtgctcgggacctcctgccgtcagaaactaaaaccagcatttccaaagctgaaattgttcggaggaccactgcagctgtggccaaagatccggccaatgtagcagtgtccgatgctga

SEQ ID NO: 79354 - DNA, 406 bp, Triticum aestivum
  Clone ID: PAT_TA_79354
tcgacccacgcgtccggatcgatcctcaaaaatctcttctcccccgagctcgaccaccccaaaccctagcagccatggcgacggagtcggagcccgccgcggcgccgcgcctgctcctgggcccgcccctgatccgcgccgcgcgcccatcccccgactccggcgccgccgccggcgacgcgttgcacccgttcgtcgacctcctcgacgcggccttcaacgcaccgtcggaggcggccctcaaggcggcgctcaagccgcggagggcgctcacggagaactgctccgccacgtacgccaactcgggcaacccctgcctcgacttcttcttccaggtggtccccgacacgcccgccgaccgcgtgcgccagctcctcgccgccgactgggcgcaggactcactcac

SEQ ID NO: 79355 - DNA, 201 bp, Triticum aestivum
  Clone ID: PAT_TA_79355
gcgtccgcccgaatcggtcgccacgaagaaatgggaaggcgccgccggttcgctctgcagtacaccagcgacgacgacgacgacaatgctgcacccgaggcgcccaaaaccacagtccccgactcctcgcgccacaagaagcagcagcgccgctaccgcgacggcgatgacgacgaggcggacctggagctcgcggaggag

SEQ ID NO: 79356 - DNA, 548 bp, Triticum aestivum
  Clone ID: PAT_TA_79356
gggttgtcatggatgatggtgataatagtggcagtggtgcaagtacaagcacttgtacttcagctcatggtactatgggaagcacacttccggagaagatgacaaagttaaatatagagcaggtgatcccatctcagagcatgaaggatgaagctgctactcggcaaccagaaccatttgtttttggtagtaatgcaacttcaagtttttcttctttgaagaagaccacatcattcacaagctttcaaactaatgtatcctctgaatcaaagggcagcagaagaaacttggctaatgatagcagtggcagcagtgtaactgctctatctgaaggggctgcagaacatgcactgcaagatgaaatcaagaaattaaacatcaacaaggaaggaccttcagctggaaatgtcaacgcaaatgatgcttgtactcctaaattttcctttcagagcaaagcagaagctgtgccaggatattgtacctttcctcagcccaaacttcaggagtcatgcccgtttgctccgttgaatcattcatctactttctct

SEQ ID NO: 79357 - DNA, 481 bp, Triticum aestivum
  Clone ID: PAT_TA_79357
tcgacccacgcgtccgcccctggatattgaaggtagagatttctttaatctgtcatgttccagaaatgttgaaagcatgaatgtgccaccattagatgatgatcttatggaggatttaacccgggatattgttttgaataatggtatagaaaggggtgctacagctcaggtagcagaactgatcaatcttcacagaggtcatctgtctcccgagattgattttcccttggcacattcccgtgaatcttcatcttctggtaacagcgagcagtctgttcctacaactttgacacttggcagtaatttctatttcagtaataacatcgaaagtgagcgacagctcaaggaaaaccatgagctgctggaagggcagaaaggattagatgtttccacagtgacagaatttgatagtcttgtaaaacaaaaaggtgtggctgatgatgactcagttggtgtaggttctcaaaattggctgacttta

SEQ ID NO: 79358 - DNA, 379 bp, Triticum aestivum
  Clone ID: PAT_TA_79358
tcgacccacgcgtccgcggacgcgtgggtgatgaggccgctgcgtctcgttcccggcctcctgctcctgctgctctcgcgcccggcgccggcgccggcatcgacggtggtcacccacctgccgggattcgatgggcctctccccttctacctcgagaccgggtacgtgggcgtggaggaggacaccggggcggagctcttctactacttcgtggagtcggagcggagccccggcgcggacccggtgctcctgtggctcaccggcggccctcgctgctccggcttcagcggcctcaccttctaagtcggccccgtgaagtacatgctggcgccggacgatggcggtttgccgcagctggtatacacccccttgacatgga

SEQ ID NO: 79359 - DNA, 482 bp, Triticum aestivum
  Clone ID: PAT_TA_79359
cgcgtccgcctcaccctctcgcccccctctctcctacgcacccacagccgcagcccccaaccatctccctcactcagatctcgatccgccgccgcccccaaccccacctccaccgccaccgtcgacgaccatcacagtagacgaggtcgaggctgacccaagatcgagccatgcacagactcgcgatgggcgcagcggggattctcaggcaaccccacgccaatcgagacctcgatctgaatcgagcaggcgctctccaccggcggggcttgggctggccggtgtcccccgtcgacgtcctcctccctaccgctcccgacaactagttcccctgccacctccctttcccgccgacccgtgctcggccaccacagccgcggcctgctctggaaccgctccatgagccacgtcgcatcgcggctcagctccgccaccgtcgggggccccgcccctgaccacgacccccaccccatccatccacc

SEQ ID NO: 79360 - DNA, 260 bp, Triticum aestivum
  Clone ID: PAT_TA_79360
cgtccgcacctctcctttctctcccggcgtggacgcgcaggactacacgaacgcgccaccggataaccccgcggcccaccgccggaatacagctccgtcgctgtacctcgccaagacaccgcgtctgcaccataggctcgaggcctaaccctatcccccgccccctacacccggaggaggccgcgacggcggcggcggcggcgcgatgctgttccacgtgggagggcagggcgcacggcccaccttcttcgagatgtccg

SEQ ID NO: 79361 - DNA, 175 bp, Triticum aestivum
  Clone ID: PAT_TA_79361
cacgagccaccagggcacacctagagggggtaggcgcaccctaatgcctcatggttcctccgtttgacctaattccgcctctgtaaattctctaaaatcaggaaagcaatagagagctacccaaaatactttttccaaaaaaaaaaaaaaaaaaaaaaaaaaaaaaaaaaaaaaa

SEQ ID NO: 79362 - DNA, 599 bp, Triticum aestivum
  Clone ID: PAT_TA_79362
tcgacccacgcgtccggcgctctcgtcctcttcgtcttcccctccgagcgccttccctacctgctccgcgtcgcgctcgccgacatccccgccgccgttccgagcacttgatgcaacgctgtgccatgactccttcactgttcgctgctccttcgggctctgcacctcgccgacgtcccccttcgtcacggcctcggctagggcggcaccacggtcgtggcgccttctccttccaggcaccgccgtcggcgagctctccttcaccataaccgcctcccaaccccgggctccgacctacccaccatctcgagcaggttcagatccgccacggctcccgcagccactcgccggcagaccaagcaggtgcaggacgtggtctcttcctcttttcgtttcgatttgatttggaaggctgatgatgttcgttctcttcgattcaatttggtagacgcgcaggtgcacgacgtgtggccaccattctgcttcctccggcggcggcgaggagaggtgagccgcctccgtcacccctccatccaccactccaccagcgccaccatctccagccaccgccgccatcagcaccagcctcctcacaccac

SEQ ID NO: 79363 - DNA, 264 bp, Triticum aestivum
  Clone ID: PAT_TA_79363
gtcgacccacgcgtccgacgaaatcaaccacaggaaatctttaatgttaaccactagagaagttctggccctctcgggttggggaagatgcttctggtatgggcttcctttatgtactccgggtctcgcaggccgtaatgtaacgagtaatttggtggcacgatgggccgggctgatcgtggcctagagcaactcgagcacaaaatatctcaatctccataatgtttttttattcaaaatacttcgattgcctttaaaaaaaaa

SEQ ID NO: 79364 - DNA, 468 bp, Triticum aestivum
  Clone ID: PAT_TA_79364
cgtccgctgagaccttcccacgtcatcatcgccccatcaacgcgcagctcgcgtaacatttgcaggtcctcgtcgccccttcgaggtttcggtttgccatggcggaccagctgagcgaggagcagattggcgagttcaaggaggccttcagcctcttcgacaaggacggcgatggtaccgatttccgcccctttcgccctcccctcccctcccctccccttcccttccctcatccgcattaggtgatcccgcgcgaacgccgtcccgatcgatccggcccggaatcgcggatcctgccccgccaggcgtgggttgatctgcgtcatgcgatgcgcgcctagatctgatggcgtgccggggcggtggcgattttgtttttgcgcggcgatttggtcgttttggcgtgacggtaaccgaaacgcctgcgtggtggcgaattaatctgttccgaggtttgggcctatcctc

SEQ ID NO: 79365 - DNA, 147 bp, Triticum aestivum
  Clone ID: PAT_TA_79365
cgcgtccggccatccattcctcgatccctcctactcctccttgacgacggcgacgacgcgcgccgcaatggcgatctcctccggggcggcgggcgcggccacggcggccccgcgccgcaggagcaggtcgacggtgctcctgatggc

SEQ ID NO: 79366 - DNA, 564 bp, Triticum aestivum
  Clone ID: PAT_TA_79366
tcgacccacgcgtccgaggaaggctagagactactgagtccggacatgctttggaagcaaccgccaagtcagtgagtgtgaaaaggaaatatcgtaagaagaactaccataccgacactcctaggagaagtcctaggcttatacagatgggtgaatgttgtatcggtcctgtggaagagccagcagccgaccacaagaggtctcacacgctcgggccagcagaagaatcagctgcctctaccgacccagctgaaacggctgtcctcactatgacacatgttggatcaacgagttgtttttgctctccaacatcaacgacactcctcagcctgacttccaccactccgaaagctcagacttctgaaggtggcgacgcaaagtcagtgagtgtgaatgcaaaatgtcataagaactaccataccgacactcctaggagaagtcctaggcttatacagatgggtgaatgttttaccagtcctgtggaagagccaacagccgaccacaagaggtctcgcacgctcaggccagcagaagaatcaactgcctttatcaactcagctgaaa

SEQ ID NO: 79367 - DNA, 452 bp, Triticum aestivum
  Clone ID: PAT_TA_79367
cgacccacgcgtccgcacccattctcctcgccgccgccgccactccgccgccgccgccgccgagatgggtcgcgtgatccgcgctcagcgtaagggtgcgggctccgtcttcaagtcccacacccaccaccgcaagggccccgcccgcttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgttggtaacgtcctcccgctccgctccgtgcctgagggaggcgtcatctgcaacgtcgagcaccacgtcggcgaccgtggtgtcttcgccagggcct

SEQ ID NO: 79368 - DNA, 595 bp, Triticum aestivum
  Clone ID: PAT_TA_79368
cgcgtccgccaaaaaattatcaaatcaacgttaatcaaggatctctatggagaaatcgaccgactgaaagcagaggtctatgctgcacgtgaaaaggttggggtgtacattccaaaagatagataccagctggaggagaacgagaggaaggccatggctgatcaaattgagcaaatgactgcctctttagaaacaaatcagaagcaaatcaatgacctgcaagaaaagtacgattctgagctccaacattctgctgatttgagcaaaaagctcaaagccacagagaaatgtctggaccatacaagcaacctactctcaacaacaaaagaggatttgaaacaggcccattataatctcaaggagaaagaattcattatatctgagcagaaaaaagcagaaaatgctctagcacatcaagcctgtgttctgagatcagaacttgaaaaatctagccgtgataatgcttcactgcattcaaaaatagccagaggagataaactaagtgctgcaaataggtcggtggtgaactcattccaagctgaccttgcttcaaagttggatattctctccagtaccctcactgcatctatagatc

SEQ ID NO: 79369 - DNA, 543 bp, Triticum aestivum
  Clone ID: PAT_TA_79369
cgacccacgcgtccgcagtatatttttcttttgaatttaaatattgaaacacgataactatctattttccaaattcatcattgaattatgctatctttaactgctagacaggcatttctcgtagttttcgttactataggcaggaagatgcacatgagctaatggttaacttacttgagtccatgcacaaatgctgtttaccttcgggtataccaagtcagtctcagagtgcttatgagaacagtctagttcacagaatatttggtggccgcttaagaagtcaggtgagatgtgcaagttgctcccactgttccagcaaattcgatcctttcctggatctcagtctggaaattgctaatgctgctacgttggtgaaagcacttcaaaattttactgaagaacaggctttagatggcggggagaagcagtacaactgccagagctgcaagaaaaaagttgtggccaagaaaagatttacaattgataaggctcctgatgtattgacaattcatctgaagcgttttagtccttttaaccctggtc

SEQ ID NO: 79370 - DNA, 656 bp, Triticum aestivum
  Clone ID: PAT_TA_79370
cttctctacggcccgcccggcaccggcaagtccagcctggtggccgccatggccaaccacctccgctacaacatctacgacctcgacctcagccacgtgcaaaacacaacgctgcagtggctgctcctcaccatgtctgacaagtccatccttgtcatcgaggacatcgactgctgctgcgatgccatgttaagggaggtggacagcaagacgccggcgcggacttgcaaagaagacggcggcggctcatcagaaacttcggacggtacgccgtctccgaagcgcaaatcggaggtaattacggacgtgctcttcccctgcattgctgtgtgaacatattacgtatactatatacctatctcaatgtccatatgcccacttctgcgtacggcgaactcagatcacgctttcggggctgctcaacttcatcgacgggctctggtcgaccagtggcgaggagcgcctcatcgtcttcaccaccaattacaaggaccggctcgacccggcgctgctgcggccggggcgcatggacatgcacgtctacatgggctactgctgctgggaggcattcaagactctggcccggaactacttcctcgtcgacgaccaccccctcttcccggagatacaggaactgcttatggcggtgcaggtga

SEQ ID NO: 79371 - DNA, 656 bp, Triticum aestivum
  Clone ID: PAT_TA_79371
cacgcgtccggtatctagccaccggtgagatggaatatttgggagatggcgaagggacgaacggaaaccggggcttggccgtgagcacagctgggggtgacgacgcgtttgcaggagccgttgttgctgcagtcgaggatgcccaacgcgagagcattgcactggtccactacatcggtcgggagtacgttgatcggcccaacaacttggtgcctcttactttgaagcaagtttccatgctaactccttcagccaggcatgggggggcactatcgatacatgggatgcctgtcaacacggcacgactgcttggtagggtgtggaaccgtacggaatcgtcggaagagatcagcttcgttctaggcgatggcactgggtctatcgaagccaagatatggacaatagacggggagtacatgcgggcgttacgtgaagttaggaatggagactacgttgtggttaacggctctataaggacgcgggattctgtcatgcatatacgagcctactcaatcaggcttgtgactaactacaacgagattactaaccacttcctccattgcatatacgtctccctcgatcttcagaagcagttgagggagagagaaatggatattcgtcgggcgaatctggtggtagcctcaaacgagcagtct

SEQ ID NO: 79372 - DNA, 556 bp, Triticum aestivum
  Clone ID: PAT_TA_79372
acttaaagtaccaaatcagactgccggttgaagaatcaggggccgggtcgaagattattaagactatggctatcgggacattaatgtttgggatgtgaacgatgtttcgggggatgatggcatgttcttgctggtcaattttggtcggtgtgtgcttcacgttgacacagatggcaaattgattgacattttcaattttgatctccaaggcttctgtatttatgaatgtcgtctcaagcaaagtctggttcagcataccttttttccgtctctaaaaggttatactgtgaatgcttcacctttcatctgattattgttgttgagtgaggtggtggttcttaacggactagcagtcgtttccttatgagctgcaatatctatgaaacggatcaactatgaggctgctggcatcttgctttttaggcattgatgtaatataagttaggatcataagctctgaatgttatattgcttgtctccctttcggttgaactgattaatgccgtgttgatgctttgctctgcttttaaaatatttgccacctgatccacttcac

SEQ ID NO: 79373 - DNA, 513 bp, Triticum aestivum
  Clone ID: PAT_TA_79373
ccggagtccccattgctggcccctgcttccgctacatcgggaagttgcagttcaagcagagaaggacgagcgcctcgacccccctgcaatgtcgcctcactttgccagcatctccaccgcccggattcacgccaccagcaagccccttcctcctctactccaaccaacgcctccggcagccccgtcgtcatcatcacctaggtgagcagcagctccaccggcggccacctctagcaggcccgtgccgcacttccttcccttccgtctctctctgcatgatgctcctgaccgatcgctgccaccatcttcagtagttgttttccccggtcccggtgccccatcttcgaccgaagccagggacgcccagcgccgctcgccgccgtccgccaagcctctgcgccgcccttgccaagtccatctgcgccggcctctgctcgctctgatcgaaagcaaaggagctttgctcgtcccgctcgagcgccttgaccctgcctcgcttgcgatgacccacgc

SEQ ID NO: 79374 - DNA, 674 bp, Triticum aestivum
  Clone ID: PAT_TA_79374
tcgaccccgcgtccgccaaacgccccccgttccatccctccctccctccatcccaagaacaccaccaccaagcaagatccaagccccaagattggcctggctttctcggagcaagagcagcatttgtagagatcggtcgagctgcggcggttggatcggcgagggagggagcggcgtgccggtggtggaagtggaagtggttgcgctcgcttgcgcaggagtgagggtcaagttccctcggagctttttctcctttttccttttcaccacacaccatccacctgaaacccatccccatctgaatcccccgactccgtccatccatcttccatccacgggtagagagacacagagagggattgcagtacaacccaagaaaccatgatggtggtgtggcaggggcaggagcaggaggaggattgatcggcggtgctagcaggagtagtagtggccgctgctgttactcaccggtcgccatcccctcttccctttaatccttgcttcactcctcccctccctccctccctccctcctgccttgtcttattgccttgttgcaagacaagaaaagaaacccggccgcattcccaacaacaacccatcttcttctcggcagccgcggttggtgcgtcgtcgcggttgtggtggtggtggttgttgtatgatcggtggcag

SEQ ID NO: 79375 - DNA, 417 bp, Triticum aestivum
  Clone ID: PAT_TA_79375
accaccacgagctcaccggcgggagcagagccacggccggaacacaacgactaccgcgaaggatcgatgtgggaacaagggggcttcaaaggaggagctcacgaggaatctgtagggaagggcagcaggctcggggaaggcgccggagtgcgggacggcccttaaactggttttgaaggttgagtttttgagagctctgttagacatgctttaagaacagtactactgctccgctctgcaaaatatctcccaccttcttccgcatcagcagcggcatcttcatctccatcccaccagcgcgccgtgtacagagcgagcgaggcatgtttgatggggtggatcgcggtgccgtcgtggcgatcaagcggatgaggctgtgcgccatggaggaggaggtggaggaggggatggaggtgg

SEQ ID NO: 79376 - DNA, 724 bp, Triticum aestivum
  Clone ID: PAT_TA_79376
gcgtccgcccaatttttccctggcggcggcgtagggacagccgcagacatttttgcgcctcctccgaattagcagccttcttctccctaccaccattgctgcatatgagcacaagcgcccaccgtctctctgtctcctccctcgtactgcagtaatcccaaaccaaagaaaatggttggagggcgctgcacggacgccttcgccaagccgaagcatccgcgccctgcaggtggcgacgacggaagcaacggcggtgatgcgggtgggggaggcggcatcgggcatgccggcgaccgtctgagcgcgctgccggacgacctcctccacgccatcatgtcgcgcctcaaggccctgcagatggtgcggacctgcatgctgtccacgaggtggaggcacctctggcgcgccgtgccgtgcctcgacgtcgacgaggaggagaccggcgcctacaacaatttcgacaacttcaccagcaaccttctgcactgccatgacatcgcggtcctggaggacttccggctgcacgccgccaggacttctgaccgatgggtccgccgcgccgtaggccaaggcgaggcatggccttgccggctcaaaagtttgcatctcttcagactgtctaatctgaatctgacagatatagggagccacatcagctcccgctgctttgctctggaggacgtgcaacttagaaactgcagttttgtgctcaccagcaatgcta

SEQ ID NO: 79377 - DNA, 628 bp, Triticum aestivum
  Clone ID: PAT_TA_79377
ggtcgacccacgcgtccggcaaccgctacgaggtcgcacccagcggtgagattcaacgtttaaccttctatagtccgttgtgtagagcagtgttgagccttcaacgactttctagttcggtccaggcaactatcttgtcgattcgtgttgtcggagagggtcatccttttaaatctggaggggaagttttttgttggtcatctagtgcagatggtagttctactatgcatgagaaggctgtgctgtttcattctcttgaaggaattcctcaagaagatgatgagttagatctagatggttaccttcctctgtcaagaaacgttgtttcggttgaatctggaggagggttgaatgttgtggtagaaacgtatgggggatcttctacatctactcatgtctacttcccttgtgagtattgcaacatcagtcagcgtacatgtttggtttgcggctctgaggtggagatcactgttgcttggtcccgacttgtccgcgacaagatggaccttttgattgatggatatactacccaggcctagtatggtgtcttggccatgtattttcgtcttgctagtggtatgctaaggcaagtaggatgtcaaactgtaaaaaaaaaaaaaaaaaaaaa

SEQ ID NO: 79378 - DNA, 720 bp, Triticum aestivum
  Clone ID: PAT_TA_79378
cgcgtccgtttccagaaataacaaacgggaggagcaggggtggtcacacaagcagaacggccacacaaggtgttctctcattgtcgcactactggccacctctcctctccatggcgctcaattccgtgacaggagcctgttttgtgtgccgcacagctatcccaaaggtgtagttgtcgttgtacagagttgtacttccttgccggaaacctctccaattctggtataccacctccctcccgtctttttcgttcttttgtgcgattcatgatttatggacgtgtgatgtggaatgtctttaatggtaaatttttggatcgttgttttatggtcgatacagctgcaaaagcagatatgcaaaattgagagcaatgatactgtgcttactaaaaataacaactctgataattgcatagaggataggtctgaaacttttatttacatatttagcttcattttttctgataggagtatcctcaaagtatggcaactattcacttacttaattgttgttggccttttcttcctttacttgtactcatcgaaacctttcccttttgtttgtagtggtgtcagctatgacctggagagaggtgtttagactccctaagatggcacatgtcgctgaggagacgtgatctccgagcagcccttctcatagctcgcagtccaggtcgatgccaaattcaacttccaggaggctttttgtgctgtggctgc

SEQ ID NO: 79379 - DNA, 687 bp, Triticum aestivum
  Clone ID: PAT_TA_79379
cgtgtcaacggcgagcagcaacaagaggagagcgtaccggacaagccgcgcgcacttctactgggttacgagggagcccggatcgttcgagtggttcaagagcgtgatggatgaggttgctgaaatggacaagaagggtgtcatagagctgcacaactatctcacaagcgtgtacgaggagcgcgacgcaaggacgactctgctctcaatggttcaagccctcaaccatgccaagaatggtatagacatagtatcaggcaccagggtcaggacacattttgcaagacctaactggagggaagagttcacaagaatctccgccaagcaccccggttcgacagttggggtcttttactgtggcaagcccacactagctaaggagctgaagaaactatcacttgagatgagccgcaagacgacgactcgcttccatttccataaggagtatttctaatagaatagaatagaatacacacacatctgatgaccatagtaacaactattgattacaaaaattcaattttttttggaagaaaacttgccctcttcgccatttgtaaatgtacatagtataaagtagaaggcacttagaagcatttttattaacaatatgagagggaatactattatgtttgatatgcacatatagtttatagctacctgtaaaaatatatcaaatgttaagca

SEQ ID NO: 79380 - DNA, 603 bp, Triticum aestivum
  Clone ID: PAT_TA_79380
tccacgcttttgtttccaagatattagtgtaaaccaatagaaaaagcatattttgctgcaccgaatttgtgagccaatagagggcaatgttcccgttgaaccagcatttgaggagagccgagctgcctttgaaccagcatgggaggagtgctaggaccggaacgatttgaaggagttgattaaaaacaaacaagggatggtgcaaaatgtgggatagtagagaagataatcacctctacttctaattaatcaaaggaccgataagggattagtcggattttggggtaaaatgcggaatagttgagaagataatcgcctctacttcttactaattaaaggaattaagctttggtgaattcttttttttattcacgatgggaacgacatatatagccgggtcggttcagcgattaccgagagtaaaacctgaagtgaatggcctaagaaaagcccctggttgaactaaattacagtaaacagtaactaaagaaataagctaagtaatagcagccgttggatctcgcgatcatgcatgcatcgttggatagccgtctgtggccttcacttgtgttgctctgatggataactaagagatatatgtcg

SEQ ID NO: 79381 - DNA, 228 bp, Triticum aestivum
  Clone ID: PAT_TA_79381
tcggccggggcgagggtaggggggtaggggaggggacccgcggacggcggttggaccccgccgccgccgcagcctctggctttttgccgggccggccgcgtgggtccacgtcagaccgattcctttttctcttgggccgtcagcccgctccagccaggcccaaacaggtcggtcggttccggcccccttctggaatcttccctcgccgtcgcaccgcacggggctgga

SEQ ID NO: 79382 - DNA, 407 bp, Triticum aestivum
  Clone ID: PAT_TA_79382
cacggcgtctacgtgccgttcccccgcctccacctcgccgacctcgccgtcgcgtccgccaccgaccagacgaacggcacctgcggcgtcgggggggccttcggcgactgcgcctcctcagcgatcacctctcccggcgagtgaagcgtgagtcgtcccgatcgttttgctctgttatgtttctagccattgaggatttagtgctagtagtgcgtagtggttcggatgacagattgatcactcgtttagttcatagagtttcagattagagattgggcagtggtggtgatgagtactgtgttcttctgatcacattttggcaccgaatggatgttgctctgttcccactgtttagatgggaatttgattcatcatctcgttgctctgttcccactgtttgcttgtgc

SEQ ID NO: 79383 - DNA, 509 bp, Triticum aestivum
  Clone ID: PAT_TA_79383
atgtggtgtggatgccgctctcactgtattagctgattcagtctatgcatcacaggctgcaggagattgtcattatgggaacttgtctgactatgaggttactggtagctgctttgattctttgggagggagaaagagagcaagattgatggaagggagcaagaaaaagcggaagcggtatggaggtgcagcacaaggaaatcgacggcccttggatggtagccatgaagaaccaatgcctctcccaaatccaatggttggatttaacctgcctaatgataggctacgatcagtgaccagacggcttcctcaacaagctattgggccacctttcttctactatgaaaatgtggcactagctccaaaaggtgtatgggcgacaatttcaagattcctgtatgacattgagccagagtttgtggattctaagcacttgtgtgcagctgctagaaaaagaggctatatccataatttgccaattgagaacagatttcctctcctgcctctcc

SEQ ID NO: 79384 - DNA, 567 bp, Triticum aestivum
  Clone ID: PAT_TA_79384
agagagggcctcctccccgagcgcgacagctagggttactagccgccgccgaccgacccaccgccaccaccgccggccctccgccgcggcgcgcgtagccggcccaagcccccgccgccccgccgccagtacaggatctcagccagcgcctccctccctccgccgagcagccgctcccgccagcagcgcctccctcaatccctccctccctggagccgccgccgccgccgccccggagctacgccggcgaccagtccatcggcaggtatctgttcctaatggttatctagagacagataccttgaagggtcctcaatggatttgaacgcatcaccgttgcccgaggacgatgaccatgaagagccagttgagcttgattttggacaggacgatgaagatcatgtcgagtctgctgttgagattatgagaagggaacgagaagaacgacgcagaaagttgaagagagatcagccagatgatggactaaggccgcgaccacagcaggttaggaatgatcatgtgacccaaaacaagattggcggatacaaacgagttaaagagacacct

SEQ ID NO: 79385 - DNA, 274 bp, Triticum aestivum
  Clone ID: PAT_TA_79385
cgacccacgcgtccgggcatatgtaaacctgaagcgcacacctcagttggtcgaattggttcaagacagccaggagatggaggagcttatgagcctttctcctgaaaaaatactactaaggtggatgaactttcagctgaagaaaggaggttttccagagaacagtaacaaatttttcatcggatataaaagacagtgaggcatacgcttgcttgttaaatgtcctggctccagaatgcagtgctaaaccatcgccaatgtcagtaaaagatct

SEQ ID NO: 79386 - DNA, 564 bp, Triticum aestivum
  Clone ID: PAT_TA_79386
tcgacccacgcgtccggcgtgttctaaatagggtatggacggcagatgcagtaactactagtatctcttgaagaaacttcagctgcagatctgaaacccatttttgtgccccttgctgtagttgtagccctgccagatgaggtgaaccaggccgctttctagtgcccccttgccattgcttgttgccagtgttggttgccagttttagctcaacaaatctggctggagcctgatctgcccaagccagcattagttgtgtgctctctgtgtctggttgagcaaggttgcagcttccatttgttgatttcgtcggctttgtttagtagctttgataacctggagactgcaagcaaacagatcccgtcctgcagctctagtaataaggtggtgctgggggaaggcaccatgacctactttccggaggaggtggtggagcacatattcagcttcttgcccgcgcaatgtgaccggaacaccgtttcacttgtttgcaaggtatggtatgagattgaaaggctgagccggcgaactgtctttgtgggtaactgctatgctgtgcgccct

SEQ ID NO: 79387 - DNA, 599 bp, Triticum aestivum
  Clone ID: PAT_TA_79387
tcgacccacgcgtccggttggacgatcgattcccctccgcctcccgccgccgccgccaccgccgccgccgattcactcctcccccgtccccctccatccgccgccgccgccgacgctcaagcaccgccacccaacgcaggtccaccgggcgaggcgcgcgccgtcggcgatggcgaccgcggcgggggcgaccggggcggcggcgctgtggcagccgcaggaggaggggctgcgcgagatctgcgcggtcctggaggcgcacatctcccccaactccgaccaggcgcgcatctggcagcagctgcagcactacgcccagttccccgacttcaacaactacctcgtcttcctcctcgcccgcggccagggaaaatcttttgaagtacggcaagctgccggtcttctattgaaaaataatctgcgagcggctttcgtttccatgcctccatcatctcagcaatacatcaaatccgagttgttgccatgtataggggcaactaacagggcaattaggtccacagttggaactgttatcagtgtactcttccaaattgttggagtcactggatggatcgagttgtttcaagctctacatcaat

SEQ ID NO: 79388 - DNA, 133 bp, Triticum aestivum
  Clone ID: PAT_TA_79388
ggctgccctttctttttttttttgaaccagttggaaacaaagattgttcacgtgcacaaaatgggaagtcaccaaacagtatacaatcatagaaagcacacttgacgataacaacagaaagtacacttaatga

SEQ ID NO: 79389 - DNA, 435 bp, Triticum aestivum
  Clone ID: PAT_TA_79389
cacgcgtccgctctccttcccgcttcacaaacggaggggccattggcaagccttcccaggctgtgagcacctcttccctgtgtccaagacgctcccgttcggcaacagctacagcgagctcattggcggcctcgccaacctgcccggcgtgccgctagggcgggaggcgatggtggaggcctcccggttgctctccgcctaccacccgggcgccgacgtcgagcctgtcaagcgggcgctggcggcgatgcaggtgatgataaaccaggtccagcggctggagcccatccgcaagaccgtccttgaaggatgggtgaccggtgcccgcgtcgccccggagcacctgccctacatcgagcactaggacaccatgtcttacgagatcatccgctccaaccgcacacgcaagtgggatgggcccttcaccaagatgct

SEQ ID NO: 79390 - DNA, 259 bp, Triticum aestivum
  Clone ID: PAT_TA_79390
gacccacgcgtccgaacctttctccttctgtcccgcaaacccccgagcgatcacagcatgttcggcttcggtcaccacggccaccatggccagaaccccccggcccacgctccggccgccgccggaggcaaccagcccaccttcaagatcttctgcaaggccgacgagggctattgcctctccgtccgtgacggcaacgtcgtgctcgccccgtccaacccccgtgacgagcaccagcactggttcaaggacatgcgct

SEQ ID NO: 79391 - DNA, 162 bp, Triticum aestivum
  Clone ID: PAT_TA_79391
ccacgcgtccgctcagttctcctgcaccaggggggattagctacggtttaacgagccgcggcgaccaccatgaccgccacacacgcggcggcggcggagtcggacgcggaggccataagcatcctcgagcgggccgcggcggcatccttcccgccgctccac

SEQ ID NO: 79392 - DNA, 227 bp, Triticum aestivum
  unsure (1)..(227): unsure at all n locations
  Clone ID: PAT_TA_79392
gctgtgtggtgtcctttctaaaaggatgctcatgctactaggactagtaggaagagggctgtgtggtgtccttttagaaaccaggaagtgtcgaatcgaaggtcctatgcatgtgttaagaggacaccttgngagaattttttttctgtgcagttggtccagacttgggacttgttgtatcctcgtcaaacatgtctggtgtggtgctacattctttgcgaacaggt

SEQ ID NO: 79393 - DNA, 125 bp, Triticum aestivum
  Clone ID: PAT_TA_79393
ttcgtatcgggttggtaaagttcttgtgtatgatctgatatcattgcgcatcattctgttacctgttccggagcatccaatcttcactagtcttacatcgagaaggttggagtactcgatctcca

SEQ ID NO: 79394 - DNA, 489 bp, Triticum aestivum
  Clone ID: PAT_TA_79394
tcgacccacgcgtccgtgaaatgaagcaccccattgatgctgaatacaaccatggtcgctccacgccaatctttagatgttgttcccatgcagatgcaaaagccttgggtgaggagttaattaccgtgcatgatgaggcttggctggaaaaggaggaagctagggtgagacaagtgttcgaggaagtggctgaggatatcaagaaggagaaagcggcgaaactggccgaggctatcaaggaggagaaagcggcgaaactggctaaggctatcaaggagaatgcgttaaaggaagtgaatgaggctacggaggtgggcaccatagggcatggccatggaaagagcgccaagtatgtagtacctgctagacgaaaatgagtagcttctcaatccatggttactgtcgatgttgtctctctttctctctctgtctctctctgctgcacgtacggatggttgtgcaatgcgaatgctcaacacaccccttaac

SEQ ID NO: 79395 - DNA, 367 bp, Triticum aestivum
  Clone ID: PAT_TA_79395
cgacccacgcgtccgctccctccctcccctgccaaccccaaatctcccctcgcccgtcgcagctctcgaatcccccccgagcatcgaccatgtcggcctactgcggaaagtacaaggatgagctcatcaagaacgctgcctacatcggcacccctggcaagggtatcctcgctgctgatgagtccaccggcaccatcggcgagcgctttgccagcatcaatgttgagaacgttgaggacaaccgtcgtgccctccgtgagctcctcttctgcacccctggtgccctccagtacctcagcggcgtgatcctgtttgaggagaccctgttccacagcaccaagggtggcaagcccttcgtcgacatcct

SEQ ID NO: 79396 - DNA, 237 bp, Triticum aestivum
  Clone ID: PAT_TA_79396
cacgcgtccggaagatgacgccacaaaaaagcgtccgcggctgcttaatggatgatcttcagtctcttgcgttgtccttatggcctgcattgtctttgtggatttggtggtgtccgtggtctctagccaagttagcctcgtttggggtgtctttgcgatgtagcagtgtggggttgatggtctttacgtgttggatatggttgtcgagtgagtagtccacatgtggttgatttgtat

SEQ ID NO: 79397 - DNA, 164 bp, Triticum aestivum
  Clone ID: PAT_TA_79397
tcgacccacgcgtccgccggttacgtcgacatccccggcattggacgcatcccggtcgattaccccccgaacgtgctgcgcaaccccgacagcctcttcactaagcagttcatcgcgaacggccgcgagatcgccgaaatagacggcattctcgtcaacacgtt

SEQ ID NO: 79398 - DNA, 200 bp, Triticum aestivum
  Clone ID: PAT_TA_79398
ttccgtgcacatctttggcagaaggtccatgaaagtgttgttatggatctttgccaagttctggatcaggagttggatgcgctggagattgagacagtacaaaatgtttttttacatcccaggaagagttacaagatgaacagttcatgtgcagatgtactcctttttgctgcacataggtggcagatgtccaaaccaag

SEQ ID NO: 79399 - DNA, 388 bp, Triticum aestivum
  Clone ID: PAT_TA_79399
gtcgacccacgcgtccggccacgccccatcttctccccgatccagcagcagccacatttccccatcttctcccctgtccagcggctagcacccacgcgtcgccgtccggccgtccggccgccgcgtcggacctcctcgcccgcatctgccgccgcgagccggcgcgctcgtccctacccctcgacctcgaggggtaggccagcattccctccgtccggccgccgcgtcgcagcttctcccccatccggcagatgcggcgtcgcctccgctccgtccacgtccggcagcggcagccacgcccctgtccccgcgcgcactgtttcccacgcatggcgagcgggcggcggccgtagggatttgggggtgtctccgttcgcgtgcagcggtg

SEQ ID NO: 79400 - DNA, 322 bp, Triticum aestivum
  Clone ID: PAT_TA_79400
tcgacccacgcgtccgatccatccaggctagatagcatccgccatgactggtttgattgatcctgattcattttggcatcattgtatagtgtgatcattctttgcgtgcagtctggtggtgtgattttccgtcgtcaagcacccccgttgcagtgttgttcattccatggccctcatgtcgacctttgtagagacatgttcaggctattttgatgtaggctaattctggggctaacaatacaccgatcctcatctacaaaagatgatgtatctcttaggtcttaaccatctctaggccttcttggtgtggttgtagacttgt

SEQ ID NO: 79401 - DNA, 162 bp, Triticum aestivum
  Clone ID: PAT_TA_79401
cacgcgtccgctctctgctctgctctgctcgtacgggaaaaccccaatccacccacgaccagccagccagccagccgccgcaaaagccgcactgagtccctagccccaaaccccggggatccgtttggtggaggcgaagcatcgggtcagggcggcatgtcc

SEQ ID NO: 79402 - DNA, 643 bp, Triticum aestivum
  Clone ID: PAT_TA_79402
catgcatcgtctgattggtatccctgttgctgctgctgaatatccgatgacgcatcaagtttgtgaaggtacagtaagtgttagcacctgtgaacttgacgatctggtaagtgctagcactagtgatgattcaatttgttcagcgcattctcatgattcacctggggtgtcagatgactttaccactgaacagcaatgtgtccagtcagatgagttgactagttccgtggctatgtccgcacaacagttccttgtagatggaagcatgactgcagaagacagcagcaatcatgaaaacttgggttcttataatgtcacttcagagtgcaaagacaaacagctccaagttcaacaggagcaggagaatattgaactttgtaataatgctggcagaaacttggccgcggcagtacaggtcaattccggccattttggtgacaaggccgtcaatctcaagagcgctattcctactgagtcacagcatgagtatccgaagagagatgccatcgttttggaaggcatgcaagctgctttgacgactgtggtctctggagaaaatagaaattcagttaacacagaattggattctcttggtattttacttggagctttagcagaagaatccattctagctgatgttcct

SEQ ID NO: 79403 - DNA, 496 bp, Triticum aestivum
  Clone ID: PAT_TA_79403
tcgacccacgcgtccgcgttcgctctcttctgcatcttgtatggttgcttctgctcttctcttgttactctggcggctgatggtggttttatgttgtgaggaggagtctcacgagcaccacgctcatctctattcctgttcccttctccatccgaactggatactcttcaactcttgatcttcccatcgtccttatccctcttgctatcggcaactctgacgattctggtgtccagaactcgctcttgctgcatgtgcgttttcttgtcccttcacagcgtgtggattttcgcttggaaaacaaaaacagcgccctcttcgtccttccgctctctggagtgctaattaattattgttctcaatccatccccgtgtagtatctcgcgcatcctccaagttcctcagaattttgagcttgtctgtacttccttggtggtgctaacgtgcactgcaaccttgagatctataagttcttccttgttatgaatgagtgtgc

SEQ ID NO: 79404 - DNA, 357 bp, Triticum aestivum
  Clone ID: PAT_TA_79404
tgccaatcatcttacttttcatccatggctcgtgatggttttgattttaatatgtgcatttatgatggtatatcttatctatcaagggtgcaagaatccttggctaggaaaaagactttcacccctcatcttcagcagccatctccatcttcaagtgcatccgttgctgattcagttggtacaactagaattaagtcgagaattcagcattggcgtaaaggatgtgcagaacccagtaaaacagctgatggatctttagttagttctctcaggaaactaatcatgggcagtgaatcatatggttcaaggcccagtatgaccatcgatgttcgcagtgatcgccaagttcaacttgtt

SEQ ID NO: 79405 - DNA, 335 bp, Triticum aestivum
  Clone ID: PAT_TA_79405
tcgacccacgcgtccgccgacgcgccacgccgccgctctcgcgagctagccacagctagaccgtcgatcccaccgggcgggaacgcggaggcgcagatggagatcccccgcagcctcggcgtccaggacaacgaggaggaggaggagtacgacagcgtcttctacgaggacatcgaggcgcccaagttcgtcgacctcaccgcgcccgacgccgcctgccccgccgacgacccctcctggttctgcctccgcgtcggctgcgaccagagtcacgagcacgtcgacccggaggcgctgcacaggagcttcgtcatgcgggtcatggcggcgaggag

SEQ ID NO: 79406 - DNA, 305 bp, Triticum aestivum
  Clone ID: PAT_TA_79406
tcgacccacgcgtccgggcgggcaagcggaagccggcgacgacattcccggggcaaggcatcgggctgcgcggacggacactgcagccggcgacgacgttgccggtacttcggcgcagactgcagggccgacggcgaatgcaggcggcgacagcactgccgggacttcgaatgcgctcgcagggccgacggcggcgactacgcccagcgctgtaggcttccccggcgcctctccccagtccggtggagttgcagttgcagttgcaggccgcgggggcggggtcgggttggggcagaggggatccg

SEQ ID NO: 79407 - DNA, 166 bp, Triticum aestivum
  Clone ID: PAT_TA_79407
gcgctcgccgtcgccgccgcccccgtctcgcttccgcagctctgtcccctccccgtggtttcttactgaaaaaactcgccgcgcgcaggctactaaggagggattcttcgtcgaacgcggctacgcctgcgcctgcgactcgtcctgcggctatcgccgcggcggc

SEQ ID NO: 79408 - DNA, 202 bp, Triticum aestivum
  Clone ID: PAT_TA_79408
cagagctaccattcctgctggcgaccaagttagatacattggaaggtcaggatcaacaacacagaatgttctggcaatatgtgattttgacatgcatttcatgtacacttcagttggtcaacccggctctatgcatgataccagtgtcttgtttcatgcaattgaagctgacaaagataccttccctcatcctccaaagggt

SEQ ID NO: 79409 - DNA, 445 bp, Triticum aestivum
  unsure (1)..(445): unsure at all n locations
  Clone ID: PAT_TA_79409
tcgacccacgcgtccgcatatgaggagtagtctcagatgttaatcagttgctcctccctagctttggtttggtctgaacttcaaagttttcatccactcaatgttgattcagtcaaagatctcttggaaaaattatttcgacaatgataacaacattatagagtgaatcttgtcctctggaatatatggaagcgcaaaaactgcagaggtctcccgggatgtttttgaggaattgcacattactgctagcaagattgctgatgattgatactatggtcccacaggtattcacatgaaattaataaatggcaccttacggattggagtactctactgtaccacctatctaggagatgntaattttttccttctattatttctcttaatccctgtgtactcattggactttgtatagtcctcaattttatgaagtggttcaggctgg

SEQ ID NO: 79410 - DNA, 111 bp, Triticum aestivum
  Clone ID: PAT_TA_79410
cgagggcatccgctgcatcatccgcatgaggtccaacgccttgttgatctccgagaacggcacgctgtgtgtgatgaacaaggcgttcgacctcatggcgaagggcgaggg

SEQ ID NO: 79411 - DNA, 494 bp, Triticum aestivum
  Clone ID: PAT_TA_79411
cgacccacgcgtccgcattcgcttcgcctgttgccctctccatctcccaaatccctcctagctaagctagggttttactttcccctccgccaagcttttacccgccaccatgaccgccgccgagctgcaggcggagctgctccgcgcccagctcgaggagcacaacatcgatggagatgagcctatcgttgaggacgatgatgacaacgatgaggatgaggatgaaaaagatgacgatgacgttgcgggagttgatgctactggaagatctaggcagagtaggagtgagaagaagagcaggaaagccatggagaagcttggcatggatttatgaatggatggttgccaagtttttgtcataataatacctttttgtcaaccctaaattgtgtttctaccaatgttctaacttaatgggtaacaaaatttcaaccaaatttctggctagcagtgtttggtccgacggattcgtgcaaattcgttgttttcctttt

SEQ ID NO: 79412 - DNA, 288 bp, Triticum aestivum
  unsure (1)..(288): unsure at all n locations
  Clone ID: PAT_TA_79412
cccgggtcgacccacgcgtccgacttctctgctccctcctctcctccgcgcaggcccggcgaaagggaagcaagatgtacaccgccaggaagaagaccanaagacagggcgtcgagccctccgagttcgaggacaccgtcgcgcaggctttctttgacctggagaatggcaaccatgagctcaagagcgacctcaaggacctgtacatcaacactgcaatccagatggatgttgttggcaacaggaaggccgtggtgatccatgtgccgtaccgtctgcgcaagccct

SEQ ID NO: 79413 - DNA, 532 bp, Triticum aestivum
  Clone ID: PAT_TA_79413
cgacccacgcgtccgtgagtaggtggcgagtaatactatgtcgagaatcgatacaggggcatgaagcaagcgagcaggtgtgcgcagcgacccgctactgcaaaaaatagcctttacagagcaccgggccggctcgacagggcatgccgcccgctggtggacacgtagatgtgcgcgacggagatgaaccccgcgtcgtcgcctctgcagcctggacagagctccgccagtactagtgatggagctctccatctactttctccacctgctatgagagagtagagatcatatagtggatttgttttttcttcagagatgtgctcccgtcgttgttggctgtcgaatttgtgatgcaatccgtctctatgtcaatgtcttaaccacttcgtacttctgcacaatcagcagaacataacagctgccacagtttacccattgatttcctggagtgattcaaacctaggaaagtctgctacttgtgcaagcaacagggtaagaagtttcacttttcttactaatgcacctcaattcg

SEQ ID NO: 79414 - DNA, 278 bp, Triticum aestivum
  unsure (1)..(278): unsure at all n locations
  Clone ID: PAT_TA_79414
gacccacgcgtccgcccacgtgtccgaaacaccccgacgtcaccctccataccctaaccctagaaacagacgtccatctccaccccggcgcgcgcccgactgctcggggcancggcgatggggaggcggaaggagcgccgcctggcggccaatgcggcctcgggccgcatggtcaagctcgacctcttcctcgatccttccgccggggaggcatctatgaaagagggagtaggagaggaaaaccgtgggcagcaaactggtgttcccacttcaccatc

SEQ ID NO: 79415 - DNA, 467 bp, Triticum aestivum
  Clone ID: PAT_TA_79415
ccaggtagcgtgcagggacttccctcactcgcgccatttatgctctagcttgccctttggcactacttctcacgtcaggcattgtaccatgtgctactgttttgtatgtgatgttccagctccatgcaaatattggggtaaaggtctattgactgatgatcattgtcatggtaccgatgacgaaatgagctggaaaatactgaggcagacattcaggctcggccgcctgacagcatctctttcagaaaaatgccagaatgccgtgcacccaccaatggtgccacccacacagcaagatgtacatcatcaagtctcagccccacagtcacatccatcttccatgccagtcttaccgaatgcagggcaaactgtcggtgcagtaagagcatctcctttgacaagagctgaaagatgtagagacaatgctcacaccgctcgggttactcgcaccgccaccccttgcccac

SEQ ID NO: 79416 - DNA, 424 bp, Triticum aestivum
  Clone ID: PAT_TA_79416
cgacccacgcgtccggcagagctcctctcgatcccctccccttcctccccgctgtcgcgacgtcgcatcctccccgccagcccctcctactccagccgccgcccccattctctccagatccaatccaagtccccctcgtccatcgcccccttcctcccgtcactacaccaacctctccgccggcccacccctggtcctcccggcgcctgagcgcgccacccaccgcgtccacagagactgccgtggacctgcggtgcgcgagctggaggacggcgggggaggccaacaacctgtcgccgtgggccgacgtgctgcaagactgcgtgccgcacgtgcacgcatacctcactggccccgcctaccgctccgacctcgacctcgtcgcggggaggcctccgcctatgcccgcgccgccgccgccacc

SEQ ID NO: 79417 - DNA, 411 bp, Triticum aestivum
  Clone ID: PAT_TA_79417
cgacccacgcgtccggcatcatctacacaaacacaatgtgatttatttatatattgcagcaatgcaaggtttgattttcctggctaagagagaacaagggagcaccatgcttacctatttttcggattatcacctcgtctatcttgcagccgaagtggttccagctattccacctgaatacaccgtgctgtcagttcagcaagacttgattgttggaaatatttcatggagaagcagatagaaaccagttctccctgttcggtttagaggggcttgaagaggactcgggtcttctttggttcataggatagaaatatcataggaatatgaaacttgtaggaattgagatgtcatgtattctaaatcctatgaataggaatagaaaaatagatgtccgtttgttcacatcat

SEQ ID NO: 79418 - DNA, 600 bp, Triticum aestivum
  Clone ID: PAT_TA_79418
tcgacccacgcgtccgagacctcctctcatgggccaggcttcttactaacctaagaaatgaacttagattatcatacatggagcatcgagaagttattgcaagggtcagttcgaatgagtatatcaagtctttgaggaaatttagtttagtaaattattctggtcttatgaagaggactcctgcttttgatctacatgctgttgttcctgacaagattgacaaaactggacagtccttcacctcattggttccacaatcatcaacgccagcacacatgatgtcaccagcaaggaacatttgcatattaggtatctcttatagcaccacaaaaggttcttgttttgatcccgacgccactgtgccagctaagaagttgaaatctggcagtgggagtgcattagcatacttcaaatgccccccttgcgcggaaccgttgcccgaggcagtttcttctgtgcgggcggaaagtcccaaatatgatctgcttgatagtagtaaggaatcaccctgcgcaatgaaagctggatgcgctgtatctcccatgtttcaagaaaagcacaacgaatcaaatgctggtgatgttccttggtgtgttcaca

SEQ ID NO: 79419 - DNA, 150 bp, Triticum aestivum
  Clone ID: PAT_TA_79419
ctgaccttctcaccaccgggccgccatgcgccctagcctcttttttctcaccatagcggctccctaggtgtggagtggacgagctcctggccttcgtctccgtcgtcaagtcccaccgacaagacaaggcactcgctccgcccctttttt

SEQ ID NO: 79420 - DNA, 590 bp, Triticum aestivum
  Clone ID: PAT_TA_79420
gacccacgcgtccgactgaaacgctgccatgagaagacgccaatgagacatgatgctactagaacaaaaagggggaaagcaagaatatcctatacgatgaacaaaacgggtagaatgatactcctttatccaagatatatcatccagaatgaacaaaaaggagtagtagtacatatgaaatgtcatgtactctatttcttttgaaaataaataagtgctgccatgatgctttaaaatttttttttgtccttaacagtagacataagtcttcccgtaggcgtaaatgtgggtcgtaacagtcgtactggcgctgcaattgacgggagaatgaaggatccagatgcatctagtactagagtagtacacgtccgcgtggcagacactcagacagtcactaatgtgataagtatgtttactagtccagttaagtcccatctcatccacggccttggcccatgtggccccaacagtaagctgagctgtatatgggtgtgataacacgtggtcgatttcgtccaggacagcgctggtgaattattggccaggcccccaccaccctcacatccatgatgaattattgggtggccacc

SEQ ID NO: 79421 - DNA, 173 bp, Triticum aestivum
  unsure (1)..(173): unsure at all n locations
  Clone ID: PAT_TA_79421
ttcccgggtcgacccacgcgtccgagagcatcttcgcttgcagaatgaaggtttcttaagtacttggacaaattcttttgttggtccttgggatccatctcaaggagagcataaccctgatgangaagatcaagctctggttgtttctttctggccgtcactcgtcagtacct

SEQ ID NO: 79422 - DNA, 684 bp, Triticum aestivum
  Clone ID: PAT_TA_79422
cggtccggattcccgggtcgacccacgcgtccgcggtgatgcgccgccgcccaccgtgtcctcccctccaccgtctccctgctccgccaccggcctccaccctctcctccttacctcacatcctatccctcggtggccctgcttccggatcgagcaggggatgccgcggcgctcccagatccgcggttgctcgtcttcgcggccgacggacacgtcctcgacaatgaaggattcgagggcgctcggatctgcactggcgcggccgacggctgccgggacggagctgctccgtgctccacgaccaggtgaacgcctccgcctccgccgcccaaggccatgccttcttcacactcctgtcgtcgcacgacgggggaggaggtcactgcttcctcctccgtatttcaccgagagagaagggcgccggctggtgtgcatcttctcgggcaaccacgcggccgtgcggtcagacgccgctcctccgcgcgaggactggacaggacagggctgggcgcggctcggttggggggcaactccgatcttggcgatgccatggagattcttcaagctatgcacgactggttcacaaggacagcaaggaccgccaccgtgatggaagatgcacgaagtggtcgccgccgccgccccaagagcaaacctgcctcctccgcatgtgttccacttgct

SEQ ID NO: 79423 - DNA, 556 bp, Triticum aestivum
  Clone ID: PAT_TA_79423
gtccgccccaatattttcatgatcatgacttggatttcgccccagaagggcaagaaactgatgataagttgcttcaaagggcaaaagaaattgaagagaggtttataattccttctggagacaatcatcagcttaacatgtccagatataagcgattaagctcaaatgaaatgttccagttgattcagtgtttgactgaagacaggaaacagctagcagatgaattgtcttcacagattaaggcacgccttgaagaaaggtttaatgccaaagagaagtacaaacaatcagtgaaagaacttgagatcagaactcgaaggctggagaaggagaagactgaagtacagagtactttggagagagagattgacagaaggtcaaacgattggtcagccaggctgttgagatttcaatctgaagaagagagacctgcgtgaacgggtgagagaacttgctgagaaaaatgtctcatttcagagagaactcacttctcttgaagcatacaaagttgatgcatctgataaggttgcaagttttggaaaagcaaaacatggaa

SEQ ID NO: 79424 - DNA, 580 bp, Triticum aestivum
  Clone ID: PAT_TA_79424
ccacgcgtccggagcagcgaaatcccaattcaaaattccaccggcaaaccctcgcggacagcgcgccgcgccggatcggaccgcctgccggagatggaggcggcgcgggattcgatggcggccctcctcgacgccggcatcttcgactccgcccagacgctcggatgctttctcgtgtcttctggtggcgcaaataatgaggccagcatatccatgaaggcagaaagcttggtcctgcacggtgatgcgttgtatggggagaaagaatttcggagggcactgaatgcctacaagcaagctatgcaatgtagcaaaagtatccccagacaagcaacaagtactgccagaatctcaatttccactaccggccggtcaccttctccaaattcttcaaatgttatgccattcaatgaaaatgaggtgaagtctaaaatagctatttgccattctgctttacatgagtatcgtgaagcactccaagagatggaagggattccttctaaaatgagaaatctaaaaatgaatctgatgttaggcaagctttatcgaatatccagaaataatcgtgcggctgccatat

SEQ ID NO: 79425 - DNA, 512 bp, Triticum aestivum
  Clone ID: PAT_TA_79425
ccacgcgtccggtccgatgatcacgcgttaccggatcctgaggagaaatcgggcatttctgtttgtctagatgccggtccaagtgggaatgcagtggctgggtccaacttggatggtcagaaggatttggattgggattcggaggagagccatctctgcggcaatgggaccggtcctctattcagtgtatatgaagacccggacggcaattcagtgcacgttgaggtgaatgaggatgaaatcgttagcaggtgtgtaaatgcagatggagaagggagtggcgatttgcagtccatgttgtctcgtgcaagagtaatggctaaggggtttgaaagtggcgaacgtgaggttccaaagaatagctcattggttcggttcctagccaccgagaagaaggaatcgcgtggtgtggatgctgatgtttcagttgtgcagacaaataggactgcctcaagggctgttgcacggggtggttttgcagcattttgtggtgtgcgcattgtattgatggc

SEQ ID NO: 79426 - DNA, 603 bp, Triticum aestivum
  Clone ID: PAT_TA_79426
ccacgcgtccgcatacttagtttgttttttgtcatgcatgtgacttagatggcctagggagtgataggcaggtgaaggttcactttgagtcgtagaaaggcgagatgccgaactggtcgtgcgacgcggccggtgtgcaaggtgtgatgccatggggctgtgcgatgcagcaacttcgtgtgaagcgacatggtacgagggaagtgcagcgtgacaacctgtgtgaaagagccctggagccaacgtatacacatgcgtgatccgagtgaacaggttgagtcagtttgcatgcatgtgagtttgttagctgcatgtagtgtgcatttgaggccaagtcatggctcctggagagattccaggagtaagataaggtcagttagtacatggttagtgcatggagagtttagtggagtagtgggtctaggtattggcgtgagttttgcacggcaagagtgccagcccctgctgtataaatgtgttgctttgagtaatcaaaagaagaggccgtgagggcacaagtggcaagatgtagcactagtgttcacccaaggagcagaccctcttggcaaagcagcggctgtcttctctttggtgtatgcgtgt

SEQ ID NO: 79427 - DNA, 646 bp, Triticum aestivum
  Clone ID: PAT_TA_79427
ccacgcgtccgagcaaattcagggatatttatgatgaagaacactttgtaaaacgtctacagaatgatgttcgagtagttaacaaagtgcctgattttgtaatggagcgttttggtcacaatctaagcaatgtattcaatttcaagataaaggcttggtcttctagtaaatactacgaagatgttgttcttccgaagttagttgaagaaagattcatccgaatttctccgtttgcaaaccgactctcatttgatgccccacctgttgttcaacggttgagatgcttggtgaattttgaagctttaaaattttcaaacccaattgctactctatcggagactttaatttctcgaatgagagaaaaaagtgctgaaagcaatgggaaatatatcgcagtgcatcttcgttttgaggaggatatggttgccttctcatgttgtgtatatgatggtggtgacggggagaagaaggaaatggatgtggccagagaaataggttggcgagggaagtttacaaagagagggaaggtaataaggccaggagttataagaatgaacgggaaatgtccacttacacctttggaggttggattaatgcttcgtgggatgggtttcaacaataagactgcaatttatttggcctctgg

SEQ ID NO: 79428 - DNA, 277 bp, Triticum aestivum
  Clone ID: PAT_TA_79428
ccacgcgtccggtgataagaaggaaaaatggaaaggaataggcggtattttcaagtgaaacaactatgcgagggagtgctcaaacaaggatggacacagggcatggtgaactgcttgcttgagatcagatccaacaatgtgtatgcatggagcagtgactctttattttccacttcgtttgctttttgatgggtacacttggtatgctaagcgaaaactactttaagatgacattccatattgagatgatgtactgaatgattcttctacatctgaa

SEQ ID NO: 79429 - DNA, 570 bp, Triticum aestivum
  Clone ID: PAT_TA_79429
ccacgcgtccgcaagaagaaggccttcaccactccgacccgacccgaggaggaagaagacctctctcccatccacccacacacctaggtgatagatgtgcagcggcggcagggacatggcgaggaggtgctgctgctgctgctgctcctgctaggtaggtaggtaggtagggtttcgaggaggaaggatctgtcctgccgcggctgtacgacgacgacgacgaggaggaggaggagcgtgcagggggcggatctgctagcgtctttccggaggctgaacgtcacaaggaggcaggcatggagcactacaccatgaggctcagcgcggggggaggggccacgcccacccagcagcagcagcagcagcagctctgcccctggggggagcagtccctgatggtggcggcggcgcccgaccggaggtcgaggttctggcagatggacgtggccgtggcggcccagccggcccgcatcgaggtcatatgcccgctgccgcgccgcccagcccgccctccctaccccgtcgagcccttcggcagggccacctccagggctaacaacgggacgttac

SEQ ID NO: 79430 - DNA, 624 bp, Triticum aestivum
  Clone ID: PAT_TA_79430
gggcttcacctggtgctgtaattcagcaaaatgctggcttcccagggaatttgggccgctccggcaatttcttggatggaaacagtgtatatgactcccgttcgtcattccagaagggtcaaggttcagtgagtgatcctcgttatatggatccccgttggaggccagtccaacaacattttgatcaatcgagcatggcgaatgagtattctgctcaccctgctaatccgcgtccagattatggtcgtcctggtgagcattatgttgtaggccaagatgttagactggaaaatggtatttatgtgaaagagcaaactggtggtcaccctcccatgttctacaatgaatcacattctcatgatagatcttggcatgtgcatcccaaccaaagccatcaacgttatgaggatccaaggttgaatctgcctcctaatggtagagtgatggatccgtacgctgatagcaactcagctaattctgcatttgcacccagcaaagtctatgacatgcattcaacatctcacagtcgctcaagccatgaaagtccccactattatcatggcagtggcgagcatatcaatgatgcatatcataaccaaccagttgtaagtagtggctcctatg

SEQ ID NO: 79431 - DNA, 480 bp, Triticum aestivum
  Clone ID: PAT_TA_79431
cccgggtcgaccccgcgtccgatcgcaccaccgctttcctcctcccacactcacccactccactgccctcgagctcagctccaccgccgcccacacatcagcgcagcggctaggaggaggaggaagaggactgatgggcgaggtggtgctcatctcccgctccggcagtggatgcgggggaggcgggggcgtgggggagcggaaggcggaccaccaggagcggcaggggcagcaggggcaggtgctggagctgctgctcgccgcgctgcgcaagtcggtggcgctgccgtgccagatggcggacgccgacgacccggccggcggcgcggcgggcgcgggctgggggatggacatcggctggcccaccgacgtccgccacgtcgcgcacgtcaccttcgaccgcctccagggcttcctcggcctccccgacgagttcgagctacagatcccctgaccagcccccagcgccagcgcgagcgt

SEQ ID NO: 79432 - DNA, 167 bp, Triticum aestivum
  unsure (1)..(167): unsure at all n locations
  Clone ID: PAT_TA_79432
aattcccgggaaatcttctgtcattatcgtattgtcttntggtgtcatcaaagtcacataatcatgccattcacctcattatttctaaagccaaatgagaaaacacaacttgacatctaatgacaacaaagatggtgatatcatattaccttttttatctctcaaac

SEQ ID NO: 79433 - DNA, 511 bp, Triticum aestivum
  Clone ID: PAT_TA_79433
tcgacccacgcgtccgggcacagatctggacctcccggtgagtgaccatggcggaggccgcaggagcgactcctctcctcactggcctcccggacgagatcaccatctcggagatcctcgtccgcctgccccccaaacccctcctccgctgccgcgccgtcagccccgcgtggcgccgcgccacctccacccgcgatttcctcctgtcccaccacgcccgccagtccgccctgcccctcctctacagccacaacgacgtcgccgacggcggccagtccctagacgtcacgctcttcgaccatcgtgcaggagtcgccgccgccgaccagttccagcgcgtcgcgcgactgaagacggctcccttggaaggggggatcgacgggagtttcactcccctcttctacccggtggcttcctgcgacggcctcctcctcctctccatcgactgtgacctctgcatctgcaacccggcaactcgacagtatgctcccctcgagcagctcgatggctt

SEQ ID NO: 79434 - DNA, 718 bp, Triticum aestivum
  Clone ID: PAT_TA_79434
cggtccggaattcccgggtcgacccacgcgtccgggatcggggcaggaggagcgcaagagaggttaactgtgactcgtcggcgaccccaccatcccggagggggaggaagaggaaggaggaggtccaggaggccgattccgatgaggactgggacccgcgcaagaagggtgccagtgactctgatactgatgtggacattgggcgtaggagggcccggaggggcaagggtagcggtagcgccgcaccacgcagtggcggtaccgggaggccacgtgggaggcctaggaaaacggattctgctgcgaagccctcacagcccgcaaaggtgaaggatgaggaggtggaagagaaaatagagtatccatcggccgccgaattgttggttcaacttacatcagttgcttctgatccattcaatttcaagggttatgattctgtggatgtgatctttagcttcttctcaaaacacaaggactcgaaagcgccgagcgagttggatgataaagagctgttggagatatttggtggtaagaaaggaaggaaaaagtccgttggaagttttaccaaggcgaaacatgagattgaggcagaacaactggagttggagacggcggatggccagaggggcaggaggaaatccgcagggggaatctactccgctcgaaaggcggaagattcttactggtgtgatattatcatcagcgattttgacgatgg

SEQ ID NO: 79435 - DNA, 686 bp, Triticum aestivum
  Clone ID: PAT_TA_79435
taccggtccggaatcccgggtcgacccacgcgtccgtgatttcactcccccacggcgattcaagcgtaagaagacccatgaatcgaaggctgtcaagggtaagaaagtctccaacaactctcccaccatccccacaaaaagtgacgagaagaagaagaagaagtgtcgtcccaccatatggtgtgctccagagtttattaaatcagctattgaaattctaaaagattgccagaggaaaaggatcaagaagttaggttttgggtgggtgctcagtttgactgttgatgcgctccggacaaggaacctgcctgtgtttctaatggacaatacaagtgaatcccttgtgatcaatgttggcacgcagggtggtcttaagattacaccccatgctgtgcattgtgtccttggcttacctaatggcggcatagatccacctcctttatcccgtgcaataaaaatagagcaacttcgggagctcaagaaactacttggtgtccctaaggacgaaaacattactgttgaagtcttgtaccaacgcatacgcctcgggggcgatgacgacttgacgataagatgcttcattataattgtgttcaatcgtctcttattccccactacggctacatatatcacagggagggatgcggcttggacttctgacttacacaatcttccaaatattgatt

SEQ ID NO: 79436 - DNA, 304 bp, Triticum aestivum
  Clone ID: PAT_TA_79436
cgcgtccgcttttctaacttgctaattccttacagccgatgccatcattattagtcatcttacccaggatgtgaatgtatctacaacttaaaagtagcatttatgtatgttgtatctcatactgtgctaagtaatgattagcccctcctttcttcctcggtcaaatacttaaaatttgtaaatggacctcgtaggcttagacaagcttctgtctaaacaaactatttatatggcgcaaaactttgaaatattgataattgtaacagataggctaaacatgtcaaaaaaaaaaaaaaaaaaaaaa

SEQ ID NO: 79437 - DNA, 657 bp, Triticum aestivum
  Clone ID: PAT_TA_79437
ccggtccggaattcccgggtcgaccccgcgtccgcagagatgagctcaaatcgtagatcttcaaaagctcgaaaatcaacaactaattactaccggcttccatttgataagcaccgattatttgatccagatgcatttctttcaaaggatcgttgtgccaatcaatcacaaagtactcaatcaggcagcagacatactgataaacttttcactactcctcagttagtatccgcattgacagggatctggaatcttgttggacacccagaatcttctggcacaacagatcaaagatctgtgagcgaggagattttgcacaaggaagaccctgtgtgctttactagggaccgagaaggacacacattgacatcttgcaccgaaagctcaactggcctcaactctcaaacctgtttatcaacaccaaaatcaatccatgaagatcttagattggtgaagaagatgttaatgctccgatcatgcagcaacatgattggtgcttctgccacatggagacatatgcatcttaccagtaaacttgggaacatgcattatcaaaatatataccccatgcaaaccaaaaagctaggagcttgtgctacttccagcagtatggacatcaaggaggacgactgcttcggaaggggggataactgttgc

SEQ ID NO: 79438 - DNA, 704 bp, Triticum aestivum
  Clone ID: PAT_TA_79438
ccggtccggaatcccgggtcgacccacgcgtccggacatctcgggaggtaggcaagaggaaccaggcggttctccttccatggcggtaccccgacctgtcggatcttcatcgtcatcagcccggcggacagtaaggtgttctatttttcaacgtgctgcagctaccactttgccactgccctgactccttcctgcagaccatggatctgtcgtcgatgcagagcgtcaacagggtggaggtttgccgccctagcagactcgtgtgttgttgccgccgcaatccttctctttgttggagtcttcctcctctggagagaaaaaaattggtctctttgacacgcttgggatcgacggatcgttcatgccatggttggatttgaatggggcagtgtctatccaaaatttgtttggttgactggacaatttgtttgtttggttgtcttaatgtaacccgattcgcataattttgaaaacatcagcaaagatttcagtggctgggagtgtttgccagagtggaaacgaagcatttgctggaaggagctcaagatttcgctattaccctgctgatagttttgtgagcaaccatgttgacaagctggcatctctttgttctattctattgacttcttgtggcattatgtatgaagccctttaagcacaaacctttcgacgcaaggactgtcatgggatttggagtgctcaat

SEQ ID NO: 79439 - DNA, 226 bp, Triticum aestivum
  Clone ID: PAT_TA_79439
gggaggtggtgcgcctgcctgcgcctccgtttccggtcgggcgagctgcgaaaccccaatcgcctccgcatctcccgtcctccccccggcggccagcgagccgccgggtcgagggagaagggcggcggttgctgccgctctgcgtcgtccgctcgcttcccgaggtagcattcgcgcgcgccggctcccgtcccgcgcgcggccacggcagatcgacccgcgagct

SEQ ID NO: 79440 - DNA, 402 bp, Triticum aestivum
  Clone ID: PAT_TA_79440
cctgcaggtaccggtccggaattcccgcggtcgacccacgcgtccgagctggagcggtacgccagcggcggcggcgcgctgctgatgcggcgcgcggggagctccaagatcgtggcggcctcctcgcacctcctcttccgcgccaccgtcctcgccacgctcgcgctcgtctgcctcttcgccgtgcactacccttccctcctgtcccgctccttccggctctccgccgccgccgctgcttcctcctcttcttccccgccgcggcagacgtcgcggcaccggaacctgctcgggtcgtcgtcggcgtacgcgggcgccgcgtgggagcgggaggtgcggcgaagcgccacgccgcggcgggacggggggatgtcggtgctggtcacgggcgccgcggggttc

SEQ ID NO: 79441 - DNA, 190 bp, Triticum aestivum
  Clone ID: PAT_TA_79441
cggtccggattcccgggtcgacccacgcgtccggtgacgaccgccttgcctcgcgcgatcctcctgcgcgccgatccggtcactcgcgctagtgcccacgccccagaggcggcggtggactggcgacgagggagggggcggatgcagacggaggcgagcgtggggatggccgccgcgaccgtggacggcg

SEQ ID NO: 79442 - DNA, 220 bp, Triticum aestivum
  Clone ID: PAT_TA_79442
tgggagtttgcatggtgatttgctattaccattgggagtttgcatggtgatttgctgtttgaggaggagcacatagtgataggtgatcctttgacccaaaaggtttcttgtagttgtggaatgttcaataggacaggaatattgtgtggacatgatctaaaagttcttgacttgatgaaatataaagacattgccaaaaaaaaaaaaaaaaaaaaaaaaa

SEQ ID NO: 79443 - DNA, 666 bp, Triticum aestivum
  Clone ID: PAT_TA_79443
gaccggtccggaattcccgggtcgacccacgcgtccgcttaagtcttcatgttatgtatatagcgatggattagggtttagtaaagtgtgtgtatgatccaataggagttgtgtgtgatcccaatgaccaacaaatcacctaatcaaataattgaggccatcaggcgaaaacaaaccggagttattcatgctagggctctagccacactaatcgcttctcgaaaaaacttacttgaccaatcaatcagtctgcgggtcctacccatttctatggttcttccatcacaccaggaagagtagtgaggatcaaaccctagtaacacaattctagtgggcctctttcccacaagtacaatcacacaatggggtaccaaatggagaaaggatgcatgaatggaagaaggagagaaagaaggggggctagggttcaagtgagagtgtagcggggacaacgggaaaattgtagagctcatctacggtggcattggctatggttggcggcgaatgatgatgttgtgggaacgactagtatagaatctgcacatcaggtgcaaaaatagaaaaatgattctggaccgttggatttgggacgtgcggcacagatcagagcggaggggtctgtactcataagaatataattttgtgcaataatatcccttcgctccc

SEQ ID NO: 79444 - DNA, 638 bp, Triticum aestivum
  Clone ID: PAT_TA_79444
ttttatatttcataaggttttcatattttaagaacatggcaattttttaactttctagcatgccaaaaaattagtttattaccatggcaatttcgagcttcattttggcatgcaatttttttttgtgatgtcaacttttctttatcacaacatggcaaaaattccctttcattttgcgtgacaaatttactttaacaaacatggcaaaaaaatcctttcattgccatgcaatttttttactcttttttgccatgtcaaatttacaatttttggtcatggcaaaattctccttttattttccatgccaaaataaagaaaaattatggagcatggcaaattagctttctacttgcgatgtcaacttttactttatttcaccatggcaatttttaaccttcattgccatggcaattttacggttaaatacttggcaaatttactatctacatacatgggaaattttactctatttttgccatgtcataattttactttattttttcatggcataattttaactttattgacatggcaattttactggaacatacatggcaattttcactgtactttgccacgtcaaaaaattactatattttttgccatggcaattttaccttaaaatacttggcaaattt

SEQ ID NO: 79445 - DNA, 478 bp, Triticum aestivum
  Clone ID: PAT_TA_79445
gtccgagctctgccgctttgcgcttttctaatcatcgccgcagcgtcgcaaatttgttgccttccattccacccacctcgcgacccccctacatgatgcagttcacccatgctgcagtgactgcaccgcctctctaccctaatgggcaccacgggctagggctagggctcttccttgacgtcggcgcgccgagggcacgcccctggccggctgctgggagcttgttcccaacgctgccgccctcctccaagatctccctggggaacctcaacagcgccggctgcatggagcagcttctggtgcactgcgccaacgccatcgaggccaacgacgccacgcttacgcagcagatcctctgggtgctcaacaacatcgcccccgccgacggggactccaaccagcggctcaccgcggcgttcctctgcgcgctcgtcgcgcgcgcttccaggacgggggcgtgcaaggcggtgaccgcggc

SEQ ID NO: 79446 - DNA, 683 bp, Triticum aestivum
  Clone ID: PAT_TA_79446
ccggtccggattcccgggtcgaccacgcgtccgcgcagtatcagcaagaagcggctaatcaggaggtggatagcggaaggctttgtcagcgagaagcaagggctgagcgtggatgatgttgcagagacgtgctttaatcagcttattaaaaggcagataatacggcctgtacagaacagcaccgatggcaaggtgaagagctgtcaagtccatgacatggtccttgagtacattataaccaaggcagccgaagagaatttcgttactgtggttggtggccagtggtccataccaactcgtagcagcaaagtccgcaggatgtcgctccacagcagtgactccaaacatgcaaggaaagcatatggaatgaacttgtctcatgtccgatcactgactgtgtttgggagcctagagcaacagcggtttaaatcattcaagactggaatagtgcaagtactagacctcgaaggttgcagcggtttcaaggcaaagcatgccagtgtctcggacatctgtaaaatgactcttctcaagtacctgagcctccgaggaacagacatcagcgtactaccaccgaacatcgggggtctcaagtatttggaaacactggacataaggcagacggaagttgaagaactgcctaaaactgtagttctgctggaacgaatcagcaatatacttgg

SEQ ID NO: 79447 - DNA, 609 bp, Triticum aestivum
  Clone ID: PAT_TA_79447
cccgcgtccgatcgattccggtgccgtgcaagcaaaattagcctctggtgctgggtgtctgcgagccgcccgctcctgctgccgtgctgtgccgtgaattgtgtgttcgtgcctacccgtggtgcgatgttgcggccaagtagcgaccaaagagattgggggaaccgactgtgtgctaatatggccctggactgtgagtattgttcgctggaatattgccgccgcaaaggttttattctagtcccgttttgaggaaagcatggccggccttgggatgattgccggtaggttgtggttttcggatgctaaagtagttttgataatccatacaccaatattgatcaatcaaactggctgaatctgagatgatggttaaccaaagtgaagtgagtgaacggaaggtgttggctaggcagtgtctcagaagtgactattttctcgactgttcagcagaagccttgttaatgcatatgcaaaaatcttgagaaagcatgaaggctgttcacatttaacttgatcttacaccagcaaagctcaagcttgaccatagacaagctgagctcaggctcagtttcaggcttggcgagccgagctcgagcttttcttgag

SEQ ID NO: 79448 - DNA, 523 bp, Triticum aestivum
  Clone ID: PAT_TA_79448
gtcgacccacgcgtccgagggtatgaccggcgacaacgagtaggtggcacgtgtaccacagcgacgagactgaggtatgaagcagatgtgcgtggtgagctctcgtttcataagttcaagtgcttaccccctataaagttcagagaaaaacattatgttgcttattgctcggccctataaggagcgagcggaggaatccccacctaatctaccttgtccctcgacctgatgctcaacaccagcccgccaccgcgacctctcctcccatagcgtgccgccggtacctccccctcccccagcgcgccgccacggcccctcctgccccagcgcgccaccggggcctccccctcccccagtgcgccgtcggggcctccccctccccgcagcgcgccgccgtggcatttgtccagcacacaaacagagtgtgaggtaccaaagaacgtcaggtaggaggattttggaagaaatgacacaggtacacaccaccgtgagacttggtgcatttttacatagctttctctgg

SEQ ID NO: 79449 - DNA, 610 bp, Triticum aestivum
  Clone ID: PAT_TA_79449
agagggagcgggaaagagaaaaggaacggagggatagggacaaggacaggagccgtaacagagataagaacaaggacaaggaggatagggaacgggagaagttgaggggaaaggaccgtggagaagacgcagatttgcctaagggtgatgagggagaccagaataagggaggtgacctcccaggagagcctgaccaggcctccacatctgccctccgggaccgcattgcgagggccaaggaagaaaggttgaaggataaaaaggaaggaggaattctggatgataaagatgatgcttcagagatactatcctgggtaggcaagagtcgcaaacttgatgagaaaagacaagctgaaaaggagaaggcgttacgtcttgcacgagtatttgaggaacaggatgatatgttagcagaaaatagtgatgatgactatgacgaggctgataaacttggtggagaccacttatctggagtgaaggttcttcacgggcttgacaaagtcatagaaggtggagcagttgtcatgactctcaaagatcagagtattctggctgatggggatatcaatgaagaggctgatatgcttgagaacattgagattggtgagca

SEQ ID NO: 79450 - DNA, 524 bp, Triticum aestivum
  Clone ID: PAT_TA_79450
cccgcgtccgtcttatcatgtgaagaaacacaaggtattttgaatgattctttggagaaaaagtcccctgtcattcaaacactgatatgcgatagtcttattcgaagctcattgaagcatctatcaaaatatagctctttgcatgccttgaagctctgtattagaggcacagaatcatttcttctgaaatcaatgtatctgcatcatctgaggtaccttgatctctcaaacagttctatcaaatcacttcctgaagatataagtattctatataacctgcaagtgctggacctttcctactgttattatcttgatcgacttccgaggcaaatgaagtatatgacttccctccgtcacctcaacactcttggatgtccggagttgaagagcatgcctccaggatttgaaaatctcactaagctgcagacactcacagtttttgtagcaggagttcctggccctgattgcagtgatgttgtagagctgcagcatttaaacattggtggtcagctagagctacgcca

SEQ ID NO: 79451 - DNA, 648 bp, Triticum aestivum
  Clone ID: PAT_TA_79451
ccacgcgtccggatgaagaggaagctgctcaatgtctctatttcgaaatgtcacatacttggttctctcccatgtgacatgtgactaaaactaaaattaatatgtgcaactgacaatggggcatctcacgagaatggaaattaatagtcgtcatagtagcatggatgccatagggttatttttcatccccattcaagtattagttattccaagcttcttagctctataatttggtaatcctactaacatcacttaattgaaatattttttgtttttcttatgctccgcttgcaggtaacaatgtacctgaaaagtcaaatatgcaacctttcactcaaagcccttaaaaataaactggcaagaatttggtatatatattttgtaattaaatttctgtcttatactgcaacttatattatcaacattttttcatgagttaaatttcctttacttgaaaacgagccaccttttctaacacagtaaagctatgtttagaagttttcactaattaacttttgaagggatctgaaactaggttacccactatcacaaataatgaatgcatctgtacaatattcagttgggtaccttcttttagtttgactttcataattttgacaatttttttaattgaactatggattggta

SEQ ID NO: 79452 - DNA, 596 bp, Triticum aestivum
  Clone ID: PAT_TA_79452
ggtccggaattcccgggtcgacccacgcgtccggcgaaatcgagtcgactggggctgtgggggtgggtaggtagcatcctgaaagaggaagtgagcgccaagatttgatttgaccgtcgtgtccgtgcgattcagaaaagcgtctgcttgaatttctgctgcgagcgttggcttggtgatttctgttattggttccgtggtccgtggagattagatgatgcttggctctagccatatgaacttgtgataagaacaacttctgtttgcgttatatatgcaccgatagttgagcaattttttaagccagtctgaacaaaatggacacgcacgtcattgcgtccgtgtgctttggccttctgttgtgctgatgcacatcaattgtattccaaatgccaaccacacgtttttgttagggtcattagctaactgctctctaacgcatctgaaaatgtctagtaagtgctagtgtctgccatgtctgtttcagttaaaaaacatccaggtctctgagttaattgcagaaggagatgtctataacaaaccaataaccgttgccctttgttttcgtcaactcctgacctggatttccaaagact

SEQ ID NO: 79453 - DNA, 658 bp, Triticum aestivum
  Clone ID: PAT_TA_79453
gtcgacccacgcgtccgaccgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactcgaaggcccgttatgaagaaattgtcaaggaagtctcttcatacctgaagaaggttggttacaaccctgacaaggttccctttgttcccatctctgggttcgagggtgacaacatgattgagaggtccaccaaccttgactggtacaagggccccacccttctcgaggccctggaccagatcaatgagcccaagaggccctcagacaagcccctccgtcttccccttcaggacgtgtacaagattggcggcattggaactgtgccagtgggccgtgttgagactggagtcatcaagccaggcatggttgtcacctttggtcctactggcctgaccactgaggtgaagtccgttgagatgcaccatgagtctctcctggaggcgcttcctggtgacaacgtcggcttcaacgtcaagaacgtggctgtcaaggatctcaagcgtgggtacgtcgcttccaactc

SEQ ID NO: 79454 - DNA, 670 bp, Triticum aestivum
  Clone ID: PAT_TA_79454
ttcccgggtcgaccacgcgtccgcgctcctcagtacatcatcctcgtcctcggcgcagacgacaacggagaaggtggcacgttcgcactgtactccctgatgtgcaggcgctccaggatggggcttctcaacagcttacacgccggccacggctccgtgtcgtcgtacaaccaggacgagccctgcaaggagacgcggagcagcctggccatcagagggttcttcgagaagcaccactcgctgcgcgtcgtgctgctgctgttcgtcctcatgggcaccagcatggtcatcggcgacggcgtcctcaccccgaccatgtcagtgctgtcggcagtctccggcctcaggatcaagttcccagagctacatgaaaactacacggtgctgctcgcgtgcgtcgtgctggtggggctcttcgcgcttcagcactacgggacacgccgcgtcgggttcctcttcgcgccgatcctgctctcctggctcgcctgcatcggcggcatcgggatctacaacattttcaggtggaacccgaccgtcgtccgcgcgctgtccccgtactacatctacaacttcttcaggaaggccggcagggacgggtggagctcgctgggagggattgtgctctgcatcacaggcgctgaggcaatgtttgctgacctcgggcatttct

SEQ ID NO: 79455 - DNA, 606 bp, Triticum aestivum
  Clone ID: PAT_TA_79455
ccgcggacgcgtggggcctctctggtgaggcactagatttgtttgcgcagatggaagaagagggtgaagtcatgccgaatgagataactttcttgggtgtcctaacttcttgcagccatggaggattagttgaacaaggataccatcacttccatcgcatgtccagtatttacggtattgccccaaagattgaacactacggatgcatggttgatctcctggggcgtgctaagttattggcagaggcagaacagttcattaaagagatgcctatcgctcctgatgttgtaatgtggcggtcgttgttgtttgcctgcagagcctgtggagaggtgggacttgcagagtatgtagcagaaaggatccaagtattggagccaaacaggtgtggaggggacgttttactttctactgtctatgctaccacatcaaggtgggttgatgcaaacaaagtgaggacaggaatatacagtagcagaaagaccaagcagcctggttgctctttcattgaagtggatggatgcgtgcatgagttctttgcaggggacgagtcacattttgaaactgaagctatatacaaccactcttttagggattaatgaactg

SEQ ID NO: 79456 - DNA, 500 bp, Triticum aestivum
  Clone ID: PAT_TA_79456
cccgggtcgacccacgcgtccgagcttcgatggtaggatcgtaaatcgtagaatcttaactatcaggatcgtaaaaacgtagattctatgaactaaaatcgtagaatcagaggggttagcttggatcgtaaagtcggagaatcgtacaataaaatcgcgattctgacaaccttgcgcccttgtgttcagtagagtagaggcgagaaggaagagcaaaataacccaatcgtcttcctcgtgtcgtgtgtgtgcgcgcgcgtgcttttgatgctcggcaatggagaattctcgctatctcctcctcctgctcattggactgctcgtcgcacccagcgcggtaggagagccatgtgactcgtggcactgggcgtacctaacgagcgtgttctgtatatccaaagagcatgacagcatacttgccttgctgtgaagtggtgcagaccatcgcgaacatatcgctgacagaggaccctttgtgcatgtgtagcctgactgcagag

SEQ ID NO: 79457 - DNA, 201 bp, Triticum aestivum
  Clone ID: PAT_TA_79457
gcgcttgtgggcgaagggattcgtcggcgtcaaaggctccaacagaccgatcccaacgtagccatcccttggatttcatgttcggtcaattctcaattgtgctcccaaatccagatcacccttctggtaattctagggatttcgaaccatcaactacaggggaaataaggaaggcaaactgacatgaaaaacaaaaaaaaa

SEQ ID NO: 79458 - DNA, 245 bp, Triticum aestivum
  Clone ID: PAT_TA_79458
cggtccggattcccgggtcgaccccgcgtccggagcatctcccttattcgcttgcagcgacgacgaggccaccccggaggccagggtggcgggggctccgacgagctccatctagcgagggggcgacggtggatgagggatttggcgagccagcgcagtttgcgtctgacagttgggatccgattggttttccctaagatgcactcaacggacgcacatcttgagtaagggctacaaccagaaaa

SEQ ID NO: 79459 - DNA, 656 bp, Triticum aestivum
  Clone ID: PAT_TA_79459
taccggtccggaattcccgggtcgacccacgcgtccggtgcgattcttgtcagtgttttcaagaccaacacacactaggtctttttcacgagctctacctggatggctatcccgaggtcttgttggaagaacacttgcagatccttcattcccacataagatggcttttgagttcttggctacttttgcctcatctgtttggtgggagatgaatattcgtaaggagaggtttgagcaagaatgggatttggccgttgtcaatgctttgactgcatcatgttgcaaccttgtgattctggggcttctggcaccatgccgttcatatgggagtacatcccgatttgacttccaaaatgccattgagaaacttcctaacaacatatttgagaagagttatcctttgagagagtttgatctgcagaaacgaattagtgcattcctttacaaggctgctgagcttagcctggttggggtagttgctggatctattcagggtggtatctcgaaagccctatccgcaaggaaggatggcaggttatcggtgacccttcctaatgtcagcaccaatgcccttggttatggagcttttctaggattatatgcaaaccttgcgatatcaattattgtgtggactagatcaatatatggatcaagcg

SEQ ID NO: 79460 - DNA, 268 bp, Triticum aestivum
  Clone ID: PAT_TA_79460
gtccgcttatgcacttctgctatcaggagatataaaagtgacgcatgatgggagttcatacaagtgccccttttgttcggttggaaatggtgactataacatacatgaattactgcagcatgctctttgagtgtgggcggctcgcccatgcaccaggaaagcaaaacagaaggtagaccatcgagcccttgccaagcatttgaaggatgaaccatctaaatcacatagtccactgctgaggccaatccttatggatccacagcctcct

SEQ ID NO: 79461 - DNA, 561 bp, Triticum aestivum
  Clone ID: PAT_TA_79461
ggtcgacccacgcgtccgcaaggagagaatttttttttcctccagcaccagtgagtagggcgagatgagcagcccccgccgccgccactgccgccgctcgccggcggcgtccccgctggaggacgacgacctgctctccgagatcctgctccgcctccccccgcagccctccgccctcccgcgcgcatcggccgtctgcaagcgctggcgcggcctcgtctgcgacccccgattccggcgccgcttccgcctccgccaccgccgcaaccctcccctcctcggcttcttcaaccgattcgatcgcctctccttccagcccactctggacgcccccgaccgtgtccctctcgggcccttcccctttcagcgcaacgacggcggctacttcgtctccctcggatgccgccacggcctcctactcgtcttccttccggggattctcgaggtccttgtgtgggaccccgtcaccggcgaccggcaccgggtggccatccccccggtggtcgcggaacgtgcggcggagattggggtcggcggggcggtgtgtcgcgctcccggaga

SEQ ID NO: 79462 - DNA, 723 bp, Triticum aestivum
  Clone ID: PAT_TA_79462
ccacgcgtccgagttcttgcagcgggatcctggattgcgccctcaaatttggcaatatccaccagaccagagagatatcgtcaggagagcatatttgatgttaggtcctatgcaaccccgtctagagaactataaaccttctggtgaactagggcatcaacgccgcttccaatatagttggtttggtgattttccgtcatggctagagtattcagaggagaaaagttgtgtgtattgtctatattgctttgtctccaataacaaagagaatacacgaggtggttctcatgtgttcacggtacatggatttgacagttggaagagggtttgtgggaaacattgtgcattcttgacccacataggatctggaccatgctcaccacacaacaatgcagtcactagtggtcatgccttaatgaaacaaccatgccacatagagaatgttatggctgtgagggacaaggagaaggtggaaagaaatcgtttgcggctgaaagtctcaattgcggttgttaagtggcttgcattccaagcttgtgcttttagagggcatgatgagagaccacagtcaaagaatcaaggaaactttcttgaaatggtgaagcttcttgcagaatttaatcctgagattgccaaagttgtgttgggaaatgctccatacggcgcaaaatacacatcacatgatatccagaatgagatcttgagtatatttgcatctaaaat

SEQ ID NO: 79463 - DNA, 502 bp, Triticum aestivum
  Clone ID: PAT_TA_79463
gtcgacccacgcgtccgaaagaagatgtagtctccgccggaaccgtggtgtgtgcccggtcgacgtgagaattcttccgggttgtgctgcgtgtgtgcgtgtgtacctctatgtatgtgtttgagggagttgagttgaatagaggccaacatacaggccgttcgtcggccggggcgttcgtcgccataaccaagtgtgtttggttcatcttcttctacctctgtctggcgctgctcgccggagggctactcggcgtttgttgccggagggtttgtcccaacactttccttctacaccggccatggctatcggaacgaggctttaatgccaaattgttagcccaaactattgtgtgggaccaagatcttgttcaacaagtattcaatgctgatgttggccctcatattctgagtattccaattaaggacggatttgatgatcttccagcttggcatcccgatccgaaaggtcaaacatcaacttgcactgtagcagatcggac

SEQ ID NO: 79464 - DNA, 619 bp, Triticum aestivum
  Clone ID: PAT_TA_79464
gtcgaccccgcgtccgacaagactgactttttccctgcaaggagtactgaaatgaaaacaaactaaattgtgttttgttgaaaaaaatgatttcagataatgaattaacctcttgatatgaattgacttatcaacttgttttttcaatggaattttcagaggatctttcatgtaaaaagccttgagaagacggctcaagatgacttccaaatgcttgcctctgctgtattccttcaagtcagcaccatcagccaagctctcatcttcgttacaaggtcgcgaagctggtcgttcgtcgagcgccccaactttctcctggtcttcgctttcttggtcgcacagctgatagccacactgatcgctgtatacgccgactgggcattcacttcgatcaatggcatcgggtggggctgggccggcatcgggtggctctacaacctcgtcttctacttcccgctcgacatcatcaagttcttcacccgatacgccctcagcgggcaagcatgggatcttgtcattgagcaaagaattgcgtttacaaggaagaagtcatttggccagcaagagagggagctcaatgcaccgaggacactccatgggctgcagccggcggatgcca

SEQ ID NO: 79465 - DNA, 569 bp, Triticum aestivum
  Clone ID: PAT_TA_79465
cgacccacgcgtccgaatctgctccggccggtccgcgccaccaccacctgccgtgcgcccaggcggatcggttccggtgcggggtcgtcgccgggatgttcaagctccaccgccaccgctcctcggaccggagcgtcggcgagcgcttcgagttccggttctccagcttccgcgccgtcatggtgcctgcagtatcggacaggatgttcctttcgatagtctctgtggataccgggaaaaccatcgccaaatccagtaaagtggctgcccgcagtggaatctgccaatggcccgattccatatcggaaccgatatggttttctcgagacgcagtgtcgaaagagttcgatgagtgccaatacaagattgttgtttctgtgggatcaataagaactggtattcttggcgaaattttcctaaacctgtccaactttctgaatttggcggacccaactgctatctctatgccgttgaagagatgcaactctggaacagttttgcagcttaaggttcaatctcttggcacaaagcctaagttgggtggtgtgagatcttcaagggacatgcct

SEQ ID NO: 79466 - DNA, 638 bp, Triticum aestivum
  Clone ID: PAT_TA_79466
accggtccggattcccgggtcgacccacgcgtccgtgagtggttttggtagggtgataacatgtctgacatgtattttactctaatactggacggatcataatgttgcaactatcaactggtactttagcaagctcaattttggtagcgcaatgagaatgaggcgagttaggtcagtttgtggttgcccaactgtgaaaatatgcaaaagcgggtcagagagacacaaaaatagcctaaagcaggtgaggcaaacaggattgtgataatccaccgcaatgccaagcacagccttaaaagagtgttttggctctttgagaacacttttcctttcattacatgccctacactgagctctttttggaaagaaaaaaagtttcttgaatcctcaaaaggttctaatggagtggagttatacatgtacatatagatgtgtagcatttatgcacaaattttatcaatatatcttctcaggtatggtgtacacaaaaaggagaaatgtgtagatcaaaatagagtaaccttttgcttttttggagccacaaatatgtcttatttttgtgtagcctataaattaatgtactacctccgctccaaaatataagttgttttggtaggcttaaacgtcttatattttag

SEQ ID NO: 79467 - DNA, 695 bp, Triticum aestivum
  Clone ID: PAT_TA_79467
ccacgcgtccgcaaacagcagcgcttggcggccggcggcctgcgagagtaatccgagatgtgcggcagggccaggtgtaccctcagcgcggctcaggcagccagggcctttggcttcccgaccaccacctccgccgccgccggcggaggcggcggcggcgacggaggaggagacgcccccgccgtacggacgctccagatggaccggttccggccgtcgtacaacgtgacacccggggcgtacctgccggtggggaccctgcgagcgcgggcggcgggcggggaaggacgtgcggaggagcaagggcctgttatccagtgcatgaagtgggggctcgtccccagcttctcaagcaagaccgacaagcccgaccatttcaggatgttcaatgccaggtcagaatctgtaaaggaaaaggcttcgtttaggcgacttatcccgaagaatagatgtcttgttgcagtagaagggttctatgagtggaaaaaggatggatccaaaaagcaaccatattacattcatttccgggatgagaggcctcttgtgtttgctgccctctttgacacttggacaaattcagatggagagaccctccatacatttactattttgactacccatgtttcaacttctttgaaatggcttcatgatagaatgccggtaatcttgggcgatgaagactctgttaatgcttg

SEQ ID NO: 79468 - DNA, 576 bp, Triticum aestivum
  Clone ID: PAT_TA_79468
ggagaaaagaagcgccctatgggttctcctaacagtgcaagtgtcctagatgaagatgcagagataacataaaagttgcaatggctgtcacaagtgtttgggactggtcctcgacggcgatgttagcccacaggttatgtccctactccctctctgtgtgtacttgtgtgtgtgtgtggtattcattgacaatctccttccagcatctcgggaaggagtggtataattgtgcttccagggcaaaatgccggagagacaatgccgctcggactgctctcggtgcagaggacttccatgggggctaaaggaggttccaccaaaccagggccaaaattgatctccaagatttcgctctttcctttcccatggaagaatttgttcgctgccaccagctaactagggaatcgtcatgcgctgccgccatagccgggctcatgttcagcttgcagagtgtcaggtgccaagcttccttcgcaaaagagcaagaagtaagcaggtgggcagcagtttcaggctcttgtagacatagcagacactgtggattatggggccaccctcgcttagcaaggttatccg

SEQ ID NO: 79469 - DNA, 577 bp, Triticum aestivum
  Clone ID: PAT_TA_79469
cggtccggaatcccgggtcgacccacgcgtccgggtcgccgccatggcgcgcagtgacaatgcatggtgttttgtctaggcggttgtggccatgcctagatttacttcccacattcactagtgtttgaggcgtgttatagccacagcgtctctagtgagattttgatacacagtctcttctcacgagtctatgatgcgactggagccacacgaatgttcctggctccgtaaacggcaattgattgcctagtgtgtgcatagtttcagtttgcgtggttatgacgttcggattgtgtgctccttcatcatcttcgttgcctcagtgtctactcaacatggatcgtcactacttttttcccctttctctttgtttttcaatttgcctaggcatagcttcagccttctttggctttgctttgctggtgtgatcttgatgtgtgtgttggtgttggctgtgtgcatcttagttatgcagaggtcgggtgtttactcatcgtgttttgtatttccttgatgcttcactatgagttaataaaaagacgctatttatggaaaaaaataatatatgctatccaat

SEQ ID NO: 79470 - DNA, 639 bp, Triticum aestivum
  Clone ID: PAT_TA_79470
ccacgcgtccggttagcttccagccgttgaacttctgtctacattaccccgttctacatcgataaatttgctggtgatgctccctactagggagctggcataccaagtggctgttgaggctaggaagcttcttaagtatcacagctcactgggcgtgcaggttgtaattggtggcacaaaattatctcaagagcaaagaagcatgcgatccacaccatgtcagattcttgttgctacacctggaaggctcatcgatcatcttcaaaacacacctggtttttctgcccggattaaaggtgtgaaggtccttgttcttgatgaagctgaccgcctattggatatgggattcagaagagatgttgagaaaataattgctttcattcctaaggaacggcaaacactgctattttctgctactgttccagcagaggtccgtgaagtatctcatttagcaatgcagaaggattacaagttcatcaatactgttcaagagggtgatgaggagacacatgcacaggtaaatcagatgtacatggttgcaccattagacctccacttctctatattatatggtgtcttaaagaagcatattgcggaagacgcagaatacaaagttattatattctgtactacagcaat

SEQ ID NO: 79471 - DNA, 588 bp, Triticum aestivum
  Clone ID: PAT_TA_79471
ccacgcgtccgcggaggaagaaatatcagcaagacgtgagtatcttctgcgaatggcggttaattcttgccctcctgctatccggacttctaccaaatgtaagtgttattgcaaccatataagtatttttgaagttgaatgatctagaaatcagaataagattttatctttccattgctaaacaacttttcgtgtgaaatcaggaataataccacaactttctgcctggagaagggcacttatacttgttctctgaattgtgcagtatagaatacagtaaatcacacatatggatcttcttgaattaagtctaactaaacctagcaagagacccttgcatctaattatttattgagagtaacaaaaaggaggtttagatgcacttttactgagctaggcaaaagaatcagcttcatgtgagacatgcatgcgtctagctccaggttaagttttcaatttcagtgatttacgcgcggctagttttcttcttccaatttctcttcgtgtacgtaccggcgcacttggccagtgcgtggacgtgttcgtcgcgttctcaaggatgtggatcctcgatgaccttgtcgagtt

SEQ ID NO: 79472 - DNA, 584 bp, Triticum aestivum
  Clone ID: PAT_TA_79472
ccacgcgtccgcccggattaactagcttagctgttcttctgattcatgggaggccaagaccgatgtctgggagtttcgctgatagcgccttctttactagtggaggtgcttcattagtaacttgccacacagacaaattgatttctccttttctgtttgttcatgtgttgatgttctgttggtttgattcggggagctcagtcccattgtccggccgccgttctcttggtggatctgagtttaccaagctcccgaaaggtattcaggtggcgcttagagcacaaatccgtctgatggatcttgggttacgctcgcccccaaattcctgtttaatctttcttcatgctttcttttgtcttgtataattcgagttcttgttgcaccactattttggtgttttgaacttttgggggtgcagtgattataaaacattccttgtactgacaggagatccctgtgaacgactcctatacacccatagaatctgagcatcaacaaaccatgcttgtttcattggattcttaatttgttttcttatttttaatatgcggttcattgttattttcacctgatctgtctctttt

SEQ ID NO: 79473 - DNA, 619 bp, Triticum aestivum
  Clone ID: PAT_TA_79473
ccacgcgtccgcgcacgccacctcctcgccgtgtccccccggaaaaaaaaaagaacctcctcgccggcgggaccgcttcgcgcccctcgcttccccacctccgctcgccggccgttcccccggccgtccatggcggcggcggccgtcggcatcagcaggaccagcgcggcgggggcgggaagcagcaacagcagcgagttccgcttcttcctctcctgcgacatcagcctccccctcaccttccgcgtcctccaggcccccatcccgcctcccgctcaagatggtctcgacaagaaggtctcggagctcttcgtcgagtgcaagctctacatcgacggcatccagttcggccttcccgtcaacacaaggctcgaatcgtcaggaccgccgtactgctggaacgaactcatcacgctgtgcaccaaatacagggacctaacctcgctcgcgcagctcgctttcacggtttgggatgtgtcgtctggtgagggcaaaagtgttgttggtggggccaccatatttctgttcaacagcaagaaacagcttaaaacagggaagcagaagctgcagctatggccccaaaaggaggcagacggaagagtacctactacaacccctg

SEQ ID NO: 79474 - DNA, 562 bp, Triticum aestivum
  Clone ID: PAT_TA_79474
ccggtccggaatcccgggtcgacccacgcgtccgcatatttacagagagcaaagttttgcaacctgattcactattgcagcttgccagggcactgatatgggctgcagggcggcctcaaaaggttgccagctcgccagacgacgaagacacagcagtattctgcttggaactcctcattgccatcacgcttaacaatcgagatcgaattgtgctcctctggcaaggcgtatatgagcatattgccaacatagttcagtccacagtcatgccatgcgcccttgtggagaaagctatttttggccttctgcggatatgccagaggttacttccatacaaagagaaccttgctgatgagctgctgaggtcattgcaattagttctgaagctggatgcacgtgtagcggatgcatactgtgagaacatcacacaagaggttgcacggcttgtcaaagcaaacgcgggacacataaaatcgcagatgggttggagaactgtggtgttgctgctctccattacagctcgccacccagatgcttcaggggtaggcttcgaggctataat

SEQ ID NO: 79475 - DNA, 541 bp, Triticum aestivum
  Clone ID: PAT_TA_79475
gaaaaatgacaatgtattgttgaaaagtcagatccgaaacaaacaaggaaacaaacattccttagggcgataaaacacacattttttccattgatgacgtgctttcgtagatggaggcccgatgatgagcatgggcatgggtggactatattggtttagagccaatcacacatggagcggccaattacagatcctcagcttacatcccgttgattccttagcaccactataatgaaaattaaacaaaatgaaccgactttagacctagaccaaacaaaagataaatctccagtggcggttgcaacacactcgacgacgttgtgcttgatttagagatggaacagactaacaggtagtctcctgatattctaatttggatcattcaattttttagctctgtccaacaagtggtttactgtttaattaagaaaaagtgtctggaaaaaaattgttcagttgaagaccaaaatagaagaagaaacaagccagactaataaagtccatgttggtttgatctaacaaagttatattaaaccgtagt

SEQ ID NO: 79476 - DNA, 514 bp, Triticum aestivum
  Clone ID: PAT_TA_79476
acgcgtccgccgaaattttcggctccgcgtcggcgcgcatcgtccctatccgcctccgcctccgcctcgaatcccatccccatctcggagccgaccgaacaacccccctcccccgaccgaccttaaatccccactcctcggcgccgccggaaccctaaggacccaaatccgccgccccgattcggggttccagggcgtcgcgcgtccccacccccatgccctagccgccgccggcgccagtgccatgctcgcctcccgcatcccgcccaagcgctgcaccgccgccgtcccgtacgagctggagccccccgccgccgccgccgagggcatgccgcccgccaagcgccgccgggagcgcgtcctgccctcgcggttcagggactcggccgtcctcctgccgccgcccgccaagaaggcctgcaaggcccccgcgccgcccaaggtcgaggacagggacggccaggtgtacgaggtggaggtgcgcgccgtcggcccgaaaggctccgcctttggg

SEQ ID NO: 79477 - DNA, 440 bp, Triticum aestivum
  Clone ID: PAT_TA_79477
gacccacgcgtccgcccacgcgttcgccatcgccgccccccccccccccaccgccaccaaatccgcttcgctgcaccgcgaagtcgccgccgaaagcggcggtccaagctcccgacccgcacttctatcagccgctgccccaccgcgcggggagacgaagacgcccggcactgcagcatttctgcgctgacgccgctgtgatttgaccccggcgcccggacgatcgcttcttgctattggcttcccctccttttggccgggtcgctgggttccagtacaggagttcagctccggctgctttgttccttccgcttcttggagctttccccgccctcgcctcgtggaagccgccagcccgcccgccagagcttcctcggaggtttgtgctggaggctgagagggtacaatcggccccgtcgtcccggcccgcagcacaacag

SEQ ID NO: 79478 - DNA, 287 bp, Triticum aestivum
  Clone ID: PAT_TA_79478
cccgcgtccgcggacgcgtgggttcggctcaaacagtctctagtttcacataacttgtttctggcattagagggttatgttatcaattcttcgcctttcatctgaccgaaggctgttgagtgcggtggtgcttcttaatggcctagctctccgtatccacatgagctgcagtatgtattaacttgatcctctatgatcccactagctttcttttgttgatgtataaattgttatgatcaagaagctctggctgttacggtgttaaaaaaaaaaaaaaaaaaaaaaaa

SEQ ID NO: 79479 - DNA, 419 bp, Triticum aestivum
  Clone ID: PAT_TA_79479
atctctccctcagctccggcaagcaacaccagctctcctctcccctcgcttccctgctgcaatgtcgaccgacgtggccgccgatgtcccggcccctgaggtggaggtgaccgccgaccccgtcgtggagaccacggccgaggccgccgccggcgacgcgaagccggccaaggagaccaaggccaaggcggccaaggccaagaagccctccgccccgaggaagccccgcgctacccccgcccacccgacctacgccgagatggtttcggaggccatcaccgccctgaaggagcggacggggtcgagccagtacgccatcgccgagttcgtcgaggacaagcacaaggcgcacctccccggcaacttccgcaagatcctgtcggtgcagctcaagaagctggtcgcctccggcaagctga

SEQ ID NO: 79480 - DNA, 486 bp, Triticum aestivum
  Clone ID: PAT_TA_79480
taccgcacgccgcggtccagtgaggaagcttcttggtggtacaggagtccctcggggcaagtgatacctcctgtttacccacacgttgaacggtcgccgtcaccagtgccgcagcgaaggccagtcgatgatgctgagcagcaagaacgcggcagctcatctaggccagttgtagcaactccttcagcgtttcctgaagtggaactattccggtcactgagcaaggaccctgcagtggaagctttggtacctgctgtgaccaatgtcgttgccaaaccagcagagccagcattgctgcgcaaggaggtggcaatagagagccgtgccgctgttgatcatgaacacgaagcaggattgaagcacagacatgccgtgcagctgatggagaatggaattcagataagtgaacagttaaagcgtgcagccattggtcaggaaagcaaagcaggatcgaaggacagccatgccgtgcagctgatggagagt

SEQ ID NO: 79481 - DNA, 633 bp, Triticum aestivum
  Clone ID: PAT_TA_79481
cccgcgtccgagggttataggagtggaacagcgtctgacacgtaagtctttaaactgttgcaatactatttttgtgatgaatgagattaggaaattttacagctaggtattattgttgctctttttcttgaaaatgaattgctttacaagaaatattgaatttttagtggacacctacaccctgttcgtgaagtcattctcattatactatctgtaatacatcctgtgcgtccagtaacttatctgaacacacctatcagctataggagtatggaatgctaaggttagttgcaaaccaactaaataccagtcttctaggttggtatgtcatatttggtttctttggcagcacctttcaaattttactagtgtactgattgccagatatattcacgaatgttctaggttgctatattcttgaattttacctgctgttcaagcgtaatttcagttggaaacctgacaacgttcctgagttctaatatgatacgcccagtgaagaaacttcttgttttcctgcactttgttgggcaactttgaatgccatttgccttcactcaataaaatctatcatcgtgtcttatttttctccttaagtcttatgatagcgctttcatacaatctgcaaatcat

SEQ ID NO: 79482 - DNA, 178 bp, Triticum aestivum
  Clone ID: PAT_TA_79482
gacccacgcgtccgcgaagccagtcggcgacacgtatgctcgattcccgtcccgatcacaacccaaccttcccccgctgcatcctccatgtctgttctcacaggcatacgcttgcgaaagctagcccgctgctcgatcgtcgacgacctcgatcaggaagcgaattaagcgccggccg

SEQ ID NO: 79483 - DNA, 692 bp, Triticum aestivum
  Clone ID: PAT_TA_79483
ccacgcgtccgatgaccttatccacatacactgccgccttcgattggcagccggcgaaggaagatgccgccgctagcttatgtgaaactaattcctgatctatcccggcgctacttcttgtctcttatcttccagtttccttctgttttggtactgtccccaaaccctagctctggtgatcttagattgggcatgcagcagcgatgaactcatttgggtaggtcttagcccgttggtggcgagttctcgccttcctcatggttggtgctttcggacctctgccagttgccaaatcagatgtgaagcagatgttgaagaaataataagacagagatgtgtcggctggctgaggtgagttgtggccctcattgttcgtcatgccgggttttcacatgtatgtgctacagcttcatatcattcctacttcctccatagcgggtgattcttcacatgtatgttttcagcctctaactgagctaaaaatatataatgatttttttagcatatatttgcaagttatattacatatacgtctgctccacctgtgctgagcgtagagggctagccgcgatttatacctgtaaattaaaccttgtgtcccgaggctgagcatcctcctccctctgctccaccttgcaacctcctaaacgctggcttgtgtacgtctgcgagggagcatccctgtaacttgt

SEQ ID NO: 79484 - DNA, 680 bp, Triticum aestivum
  Clone ID: PAT_TA_79484
ccacgcgtccggttcttattattcacgaaaaggaaccaccaggggatattttggtgtttttaactggccaggatgacatagatgctgctcttaagttgctaaatgatgaaattcaacattctgggaaaacactatttcgatttggtgattttgcccttgtactctggccttccacggggagaccaagatctcatctttgctcctacttcgaaagggaaaagaaaagttgtgatatcaacaaacattgctgagacatcattgactctggagggggtggtgtacgttgttgatagtggattttccaagcagaagtgttataacccgatttctgacctagagagtctagttgtcgcaccaatatcgaaagcttctgcaaggcaacgagcaggcagagctggaagggtacgacctgggaaatgctttaggctttacacagaggaatattacctaaatgaaatgcagtcagatggcattccagaaatgcaaaggtctaaccttgtttcctgcataatacagttgaaagcgctaggcatagacaacatcttgggatttgattggccagcttctccatcaccagaggcaatgatccgggctctcgaaattctattttcactaggaatccttgatgaagatgccaaactaacagttcccattggtttccaagttgctgagatgcctct

SEQ ID NO: 79485 - DNA, 711 bp, Triticum aestivum
  Clone ID: PAT_TA_79485
ggtcgacccacgcgtccgctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaagtactcaaaggcgcgttatgaagaaattgtcaaggaggtctcttcctacctgaagaaggtcggctacaaccctgacaaggttcccttcgtccccatctctgggtttgagggtgacaacatgattgagaggtccaccaaccttgactggtacaagggcccaacccttcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaacgttggcttcaatgtcaagaatgttgccgtgaaggatct

SEQ ID NO: 79486 - DNA, 603 bp, Triticum aestivum
  Clone ID: PAT_TA_79486
ggtcgacccacgcgtccggtacggcatggttgcgcccgagataccgtcgatcacaatcgcaacattctcttcctccgtgaaaggcgtgactgccaaatactgactcaaaaggatccttgtttgcagttgactggcccgtctcgtgcagttgtttctatagatcctgttgacttgaaatcaagctgaaagtgaagggcagaagcaggtcagaagatagagtgctgatccatcagaccttcaactacagtggtaatgagaccactctgtcgaatgacttctgcaaaattatgctacgggtgtgcgaaattggaaaatacagtccaagcaactatagtgagtgtccgtgttactaattggaggaagaggaaatggccttttaaacatgatggtagagttagttgcattgccaagggaacttctaagcccgttaaacccgagcaacctgaagaagagcttgtacttcaagatcaagtgacggctaacagttcagatggttaccttgatctgtcaaggcatgttgtttctgtagagttaaacggaaggctggaagttatcatcagtgcggacaaatcacgtgccctcaaatcatgtggtcgtgtcttc

SEQ ID NO: 79487 - DNA, 660 bp, Triticum aestivum
  Clone ID: PAT_TA_79487
accggtccggaatcccgggtcgacccacgcgtccgcggacgcgtggggaaatttgcactccatcttccatatccgaagtggtcaagtttaattaattagagctgggtaaagaaggtgagcccgaccaagaggagctagccagatatggagttctcattgccgccatcctccgttgcccatcaggcctggcctttcataggtgtgtactccagatcatgtcgcgccgctgtactgcagggccggccgtccggctcaggccggccggccctctccggctcttccactctctcttggtctctcccctcccctccagccgtctctctcggcctctccctcccctgcagcagcagcagcagggcgctgggcggaggagagaccgagagggccggaggcggaagggagagtcggagcccaagggcaggggagggagagcccgagagagccggccgaagggaaggggagggactgagggagagtggaggcgtgggcagccgccggcgcgaagaagcctcctgtagcgtgccctctcccccttctatgtcactggataagatataagaaaggagcgcggggttgaattctaaaaattcaggggttaatgtataaaaccgaatcgttttttcagaataccacttaaagagggactgcgggtttaatttt

SEQ ID NO: 79488 - DNA, 653 bp, Triticum aestivum
  Clone ID: PAT_TA_79488
ggtcgacccacgcgtccgaaccctagcccgtgggcgggcatgtcgaccgagctcaggatccgcagcatcctcttctcctccaagagcaagaacaggaacgtccgcaaggtcaatttgctccctccgatctgctctgcttgcgtgaaggggcccggccaaggagaagctgctgcttcagctttttcctcctccccgatgtgtgtaggtgttgaaggcgttcaatctgggcagccggaggcgtacgagttctaggacatgcgctgcccatcgttgacctccaggtcatcaagaacgcctgggacggcaagagctacctcctcatgcagagcacgtccaagatggcaagcaggacgaggtactgcatggggaggatcaagtctttcgttgtccccctcgccaactactccctcgacaccaccgcctctctaggtacacgtataccaagtagagtatgcaagtacttgtacatcgtaccgcgtatgcagcttccagagtaatttccttatttccgcgtctgcttgcagtgtcccaagtatacacgtttattctagttatatgcttgcaagttagatcatagtctgacagtttgtttgcacagtatgctgtcatttagctgcagttaatcagcttatgtactaagcgttcctgaaacc

SEQ ID NO: 79489 - DNA, 655 bp, Triticum aestivum
  Clone ID: PAT_TA_79489
ccacgcgtccgccaaatccaagagacgagcgacctagtttccacctgacaaagctctaaaaaatctcgattccccgatcccactaactcagccaccaaataaatcttccgcgttgtaactagggggcgcgattgaacccttctgaagccctagttgggaggagtccggcggcggagaatcggcggaggtgggtgttgcaggaggcggcgcccacaggaggcggtgatctgtaccagcggtactctgcaccagaggcactttttaagcaaggatcccaggttcaagatggaaggagttgagaggaaactgaagacattgcaactttctaaagctgaaaggaaaggggttaaactaagtaaacgaagcacgggttcctctctcaatgcgaaagcacaagcagtcgggaaattgatgtcaaacagaccagctagagtggattccttggtgagtactcttggctggatttggtgccccttcagaggaatagagtgtaaagatttagggatgaacatattcctgtttaccttcagagaagaaggggggaagatgaaagctctaaccagtggccccgatgtttaataaatccctgctggtgttagaagatttcaaacccaacaaaacactagaggagtatcaattcaaatcccgatttggg

SEQ ID NO: 79490 - DNA, 134 bp, Triticum aestivum
  Clone ID: PAT_TA_79490
gtccgtagcaagcttcgaaagctagctccctcctcgcggcaggctccaccatccctgaggcacgtgcgagcagtgcacggcatgcaggagttccagcccatccccggcctggccgggcggctgttcggcgccgc

SEQ ID NO: 79491 - DNA, 688 bp, Triticum aestivum
  Clone ID: PAT_TA_79491
ccacgcgtccgttggattcaaatggaacatcagaagaggtccgcatcagagcctcagcctgcttcaggtatcatctctagtggcatgatcaataatgtcactgctgggatggttataccacctggcaatgctctgaagaccgcagaagttgcacacattccttcttataggccacaagcaacatcgcaaacagcctctgtgaattcacaaaatgaccctggagtaatacgtatgaaggcgcgtgatccccgtcgtgtcctccacaataacacatcacagaagaacgatactctgaactctgatcaagccaaaagcaatggtatcgccctgccggccttccaggacagcaaagacaatttgattaaccgtcaacaactggcagagcaacttcagactactgtgttgccatctcaaccagtctcattatccagcattgctcgacagtccaccatgagcgcgagtaaggtcgatcctgtctctaattcacagttagctgcttcatcactcattgctcctcaagaaagtttagtcagcgtaaatagggcagatccaagagtagctgctggacagaatgattccaataatgctgcccctgctacaacacttggtaccaggccaccagctaaccagtggggtgatcttgatgatctccttaacggttatgatgaccagcagaaggctctcatac

SEQ ID NO: 79492 - DNA, 309 bp, Triticum aestivum
  Clone ID: PAT_TA_79492
ggtcgacccacgcgtccgatgaagcagagattacccgcagctacattatacatttctgggttatagtttctacttggacttcaggccacctctgacttattcgagaatcatatattcatatttgcaccacctacctatatgaatatatgattcgagaatcatatattcatatttgcaccacctctgacttattcgagaatcatatattcatataggtaggtggtgcaaatatgattctcaagttgtgcctatcgtccgtgtatttttgttactcaattaagttgtgtcaggaatgaagaaccattgcaa

SEQ ID NO: 79493 - DNA, 633 bp, Triticum aestivum
  Clone ID: PAT_TA_79493
accggtccggaatttcgggtcgacccacgcgtccggccaaagcagatgctttcttcaattcttctccaattcaataggaaatcaaaggaggagaggaggggattgctcccacggctccaatgggaggggatttcgccctcgatcccgcattcagggatgtaaatcaggggaataaaggtcagtttagtccatcagtttctcttggtattatttcagatttgaagaatactggaaacggacagcagggtatgagtaattgggatgataatttcggtgatttggaggcggattttggggaggacaaactgtatttcaggagagagatcatagggaattttcagaaacctactcgtgttgcttcttgcccgctctctgtttctgcctgtgtgttccaggaacctatggggaccaacgaggggaaaatggaggtgaacgacattggggcgggtcaggagactcgcctagactcgccgtcttctgctgcaggtctccctgctgtgggtgcctccgaccatgcctcccatggggtgacagtcatgcctcctactgtccctgatgttcagggagcgcggacggctcctgtgttggtccaagggagagctgtggtgggagggccgtctggcttggtgctct

SEQ ID NO: 79494 - DNA, 136 bp, Triticum aestivum
  Clone ID: PAT_TA_79494
ccacgcgtccgaggattctgccggcttttggccttggtagaattgttctttttacattctcgcttgctcaagttcagagatgtaactgagatcccgggctgtatctgacttttttctctctaaaaaaaaaaaaaaa

SEQ ID NO: 79495 - DNA, 555 bp, Triticum aestivum
  Clone ID: PAT_TA_79495
ccacgcgtccgttttatgctgccacatattcagagttttcacacagcttggagtcatcgaaataccagcgcagtacatagtgcccagatgggcccgtgaattcagagaggaacggctgaaagagtacgaggagaaatgctcgaagagaacagaagacagaaagagatgtgcgatgctattgggtaaaatggccgacatcggcaaggggatatgcgcggacagtgcgaaaagcggctgcttcatgctcgaactggacaaggttcaagagaagttggtgggtgccgatgatcagatcgtattgtggagcaaatgagagttggcgagtttggttcagatgtctttatcctgggacgaagtagaatagttagcatgttcagtttagcgtatgatagaggtaagattccaggaaaatgtagggtagtcttgtgtgagacttgatagtgatgaggattggatacctctgaccatccaacatttttgcctgctatgtgttttcttctgttcctcctcttatatgacagcacattctgtcgaaaaaaaaaaaaaaaaaaaaaa

SEQ ID NO: 79496 - DNA, 719 bp, Triticum aestivum
  Clone ID: PAT_TA_79496
accggtccggaatcccgggtcgacccacgcgtccggtattctctcgacatgagatagtaactgtcttagcaaagatatatgactcaagaccaggaaaccttgaagtggtattcgacagcgaaatgaaaagagtgagtgccaatgattctagaggagatatgtatttgattccgtggaactggagagcatttgcagatccttctccagatcggtactggctgcaaatcgaagcgatggatataacaggtgacattagtgtcagccagttgaggccattctctgtgaatgggttgtttgcagaagttaactggacatggaaggagtttttcgtgatgggcatccagtgggcgtcggtatatcaccccgcactgcagtgtgttcttgctctgattttcacactgcttcttgtgccacgagcttcagtagtgctacttaaggatcaacaatctgtgtacacatatctgcgtgcaggcggtagtcagtatacatcactgaagtatctacttggtggttttatctggctttttgttgagctgtccaggatgattcttgtgtggtctttgctgttggtgtatataatctatctgttggtcttcccttggttttctggtcaccctgtaaccgaggatagtagcctcgcatccatgacattcagaggttgggctcttaaaaatggtatgaaaactttccatgccggcactccagacgtcatggtcatc

SEQ ID NO: 79497 - DNA, 661 bp, Triticum aestivum
  Clone ID: PAT_TA_79497
ccacgcgtccgcccacgcgtccgaatccatgctacaataaataggcctgctgccttgcttttcataatttaaatttgtatttattttcttatattcaatgaaatgtttgtagagaacagtgttcggcgacttagatagctttagtgagttgatggtttgacttgctaggtatgcctgcaaggaggacactgtaatttggtccaacaagtacacacaacaatcttctgattgttcaacattctttattgcgtgaatttctgacatatcaggatgcaggtacatgacactattgtgttgtctgcagaggttctcattctgaaagaaactgcaactatgcaagagcttattgacggagattatgaaatttgcagttcaagttctggacatcagattgatactttaccaaaggtgcaccaatcggccctccgtctcctagggtgatggcacaatgacatcgacagcggcagcaattgcgcacatgtgatgatggatttgtcaactgacttcatatctctatctctactacctacaaaacctgtaacattccattcccgtctcccgtcttatttcgttttgtccaaccgcacacatttctctggtcgtatgctagattgcaagaactgaaacatttcctactgcgtttttaatgatgcagtacggt

SEQ ID NO: 79498 - DNA, 300 bp, Triticum aestivum
  Clone ID: PAT_TA_79498
ccacgcgtccgatgaaccttctcatgagggcttcagtgctttcttcctccctgcggctgtggagccttgtggtgtgtagtgtcctgtactgctcttgttgttcttcagaggtagtatcatggcgatgtcagagtgtttgttagtttggaatgttagggggctcaataacccagctaggcgcagttccatccgtttgttcctacaatcctataacatttcacttgcttgtgttctagaatctaagttggctgtggtggaaaaaaaaaaaaaaaaaaaaaaaaaaaaaaaaaaaaaaaaaaa

SEQ ID NO: 79499 - DNA, 524 bp, Triticum aestivum
  Clone ID: PAT_TA_79499
ccacgcgtccggagtggagttccaactctgccggtaaaacaagattaagtggtaagggttgaaacccttttgcatgtaaatgtttaacttaattatttaagatggtctaaacttctttagcttgcaactatttactgaaattattttatgagagctatcacagtgacaccataccttgagtaccacttagtacatatgaagaaattatgataattgacctttcattatcagatctcatggcaatcataatattctattttgcagcttcaaatttaggatattgtatttgcttcaccagctatataattgtactgatacaactggaacgcgatagttagattttaccataaaaatatattctcagcacagtattattacattttagaattatgactgcagtggtattttgtgacttgtgagtgtcaggtttgatgcatagaaacaatgtggtgtattttttatgtgcaattctgcttgagaatttcatccccaaaaaaaaaaaaaaaaaaaaaaaaaaaaaaaaa

SEQ ID NO: 79500 - DNA, 718 bp, Triticum aestivum
  Clone ID: PAT_TA_79500
cccgcgtccgggtagatcacagaggagaggaggaacagtatagctatgaagacattcagaactgtatgaagaaagtcatacccttggacttgaagcaaaccattccagtagatagagaccttgtgatccgtgcctattatgctggacatgttttgggagctgcaatgatttatgcaaaagttggagatgctgctatggtctacaccggggattacaatatgacaccagacagacatcttggagcagcgcaaattgatcatctgaagttggatctcttaataacggagtctacatacgctaaaactgtacgtgactcgaagcatgcccgtgagagggagttcttaaaagcggtccataaatgtgtttctggaggaggtaaagttctaattccagcatttgctttgggcagagctcaggagctatgcatattactggatgactattgggaaaggatgaacttgaagattcctatttatttctcagctggtttaaccattcaagctaacatgtactacaagatgcttattggatggactagccagaagatcaaggacagctacacagttcacaacccatttgactttaagcatgtttgcgacttccagcgttcattcattaatgatcctggaccctgtgtactttttgcgacacctggtatgattagcggtggattttcccttgaggtgtttaaaagatgggctccatcagaaaaaaatct

SEQ ID NO: 79501 - DNA, 574 bp, Triticum aestivum
  Clone ID: PAT_TA_79501
ggtcgacccacgcgtccggagctttggaactttggtcctctgcaagccctagtgggcctttaacggcgaggccgacacatgaggcccacctcgcgtaataaggccgtgaactctaagcagcgaacgggcgcactcaaaccaaaaaaaaaacaccaccgcaccgcgcgtccccggccgcgccgggcccagccatgccgccgccgtcgccggggaagccgctggtcaccacgatcacggcgctgctcaggtcggcgacgcggccggcgcacctcctccagctccatgcggccatgctcaaggcctcgctcttcccgcaccacgcgctcccgaccgccaggctgctcgcctccccgctcgcgccgctgccctacgcgctctccctcttcgccgccattccgtgccccaccctcttccaccacacggccctcctccgcgccctctccgcgtcaccctccttctcctcggccgcctccgcgtccctcgccgtcctcgcctccgcccgcgcgcgcctcccggcgctggacgagttcgccttccagccgctcgtcgcgctctgcgccaagaactccggcga

SEQ ID NO: 79502 - DNA, 743 bp, Triticum aestivum
  Clone ID: PAT_TA_79502
ccacgcgtccgaatcgttcacagttattgtttgagctgcttgatgcttcattgggtgccacatcatctccagactgttcagtgaaaatggcgtatattttaaccaatgtagcactgacctgtatggctaaactgcgggatgaaagattcatatgcccaactggtgcagattctgatgcagttacgtgccttgacattatttcggcaaaacagttgtcaaatgcagcctgtaactcattgttgttcaagctcattatggcaataatgagaaatgaatcgtctgaaaccttgagaagacgccaatatgcattactattgagttacttccagtattgtggtagcattctcgactctgatgttcctccgtcagttatccgtttcttgctacttgaagaacaggagggagatgatgatgaactcactcttcaaaatgttctgaaggagcaaagtgaattagcacgtgccaactttgctatcataaggaaggaagctcaagcggtcatcgatttggttactaaggatgctatccatgggagtgaaactgggaaagcaatttcgttctatgttcttgattcattagttagtattgaccatgaaaagtatttcttaaaccagcttcaaagtcgaggaattctcagatcatgtctaactgatgttagcaactatttgtcaaaggacatgtcatgctcatcagagttttcacagcggttttgcactattgatgctcagttttcattacttctg

SEQ ID NO: 79503 - DNA, 258 bp, Triticum aestivum
  Clone ID: PAT_TA_79503
atctcggtgccgccacccggcctgctcccgtacaccttctctccagcacgagcacccaccgacatcgcctcccgttcgaccacggcctccgccgccaatctccgctcccgcacacactgctgccgtcgctctccgcttcagcctatctacagaaaaggggaaacaaaaaggaaatccaattcccatccaggccgccgccgccgccgcccttctgatctatctccacaccctctggcgcgtccccccacgccggactag

SEQ ID NO: 79504 - DNA, 603 bp, Triticum aestivum
  Clone ID: PAT_TA_79504
taccggtccggatttccgggtcgaccccgcgtccgggtgttgctgctgcaggtgacttggtgctcaatgcgtggttcggcatcccggagatccccataaccgctgtaattccctgcttgataacccagaagtatttgcttgctgttgagtcatataagaatactgcatccacttgcagtctctcttcagtactatatatatttgttgatccacaacagcctaggttgctgctaaaacaataagttagcatcttttgcgctcccagtctgtcgctatagaacaacatgtcatcattttctcatcggtttgaagatttaaaatgtagtgtaagttcttgagcactttgcattataacgaacctcttgcaccaatttaacccttttagaatcaacatgaccattcaaggacatcagtgtacaagttacaaaagcagagtggagcctggatatactgaacagagtggattgttgttctaatgttctactacttctgtatccttgaattagaccacaaaatcggataaagaacagataaagggtcccaagtctctaagcatttacagtctgatgatacctcacttgctattgtaccattaattatgat

SEQ ID NO: 79505 - DNA, 509 bp, Triticum aestivum
  Clone ID: PAT_TA_79505
cccgcgtccggtgcagattacaagatattagtggctgttttctgtttgtgcagagtgacaaaagtagggatatgattcatgttcatgaagctactgatggatatgctctttttgttactggcaatattagtgatcagcaatgtttgggtcactggagagtatccaagtaccaaggaaggttgcaggaggtcttaacagaggcagatcagtgtgttgacaatttgaataacaaggtactacgacggccatgggatgtaggttattggagttttggtggttacaggtcctacatattggctggtggaaaaactaaatggccatacacatttgcattttacacaaagaagccacgacagatattacaaggacaaaaatcttcatgccgcttgcgtgcaaggagcttagtggttgtgtacttctcagaaaatctgcaagatactgtgtgctgcaacaaggccattgcttggtttctcaaactggcaactcctgatggaagcccaatatacatg

SEQ ID NO: 79506 - DNA, 672 bp, Triticum aestivum
  Clone ID: PAT_TA_79506
gggtcgacccacgcgtccgaaggaaacacgcttcttcccggcgcttgcctggcactcaacaacgaaacgcgaggggtgtgccatgccgaccaccgtgagttctattcagaagggtgcccaaacaagtatgggtggctggcgctgctcgcgctgggcgcatacatcatctcctactcgcccggcatgggcaccgtgccatggatcgtcaactcggagatatacccgctgcggttcaggggagtctgcggcggcatcgccgcggtggccaactgggtgtccaacctcatcgtgacacagacgttcctgaccctgaccaaggcgctgggctcggcggccaccttcttactcttctgcggtgtgtcgttcatggcgctcatcgtggtgttcctcaccgtgccggagaccaagggcctgcagttcgaggaggtggagaagatgcttgggagcaagaactacaggccttggaagcggtaccaccccgaggcaccgacaaaagggcgcgagattgggcccgctatgctatgaaatctgcatcgacggtagctgtttgaattcttcggttctactgtaagtagcaatagtattacagcacaagattagcgtgtagaggcctccgttgcgtttggtcatttctagttacgttacggcagttttcttggttctttggaaaaa

SEQ ID NO: 79507 - DNA, 431 bp, Triticum aestivum
  Clone ID: PAT_TA_79507
cccgcgtccgcgccacaccatcgccgccgcctaccctcggcgggcggtccaccccctcctccttctccgccgtggcgcggtgctccgcggcaacctctcgctggtctggtccggcttgagccccttcgcgctgaccccaacccccccccccccccccgtcttccaagctggcgtggccaccatcgacggtgagggccgcagcaggagcaggagcacggcgggaaggaggagaacgaccaggggaggtcgagccgccatccgtcgccggccgtcgacacctcctgttcgaccacacagcgggagcaccggaccgttgtccttgtgttcgtgctcctccaggaagaagacaacccaaggggagccgcctctgatccatcttgcggaggcaacggtgagcgccctctccactcccccgattctctctctctctg

SEQ ID NO: 79508 - DNA, 491 bp, Triticum aestivum
  Clone ID: PAT_TA_79508
ccacgcgtccgcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctg

SEQ ID NO: 79509 - DNA, 623 bp, Triticum aestivum
  Clone ID: PAT_TA_79509
ggtcgaccccgcgtccgagcctcgggtctatcctcttccctcgctgccaatggcgtctccggcctccacctccgcgccggtctccctctccctcccgctccgcccttccccgtgccgcctcctccccgcggccttctcccgcccctctccccgccgcctcgccctcgcgccggcccgccccgccgccgcgctgctctccagccccagccccagccaggcgcagcacgaagacgacgaggaggaggaggaagaagaagaagaggagtacggggaagatgaggagctcgtggaggaggatgagttggtggaggtggggtacgtgagcggcgcgcacggggtgcgcggcgacgtcctcgtctcgccccgcaccgacttccccgagctccgcttcgccacgccggggaagaggtggctgagggctcgcgccgccgggaagatgcaggtcagggagctcgagctccttcggggaaaagcccacacggggaagaagggctggatcgtgcgcttcgacggcgtcgactccttggacgaggccaggcagatagttgggtcggctgttctcgtgaagaccgaggataggccggaactggaggaggatgagatctattcgctcgatcttgttg

SEQ ID NO: 79510 - DNA, 362 bp, Triticum aestivum
  Clone ID: PAT_TA_79510
ccacgcgtccgcggaccggacccgaccggaccggactactccccaccccgccgcccgcccgctctgttccatcctcccccctcgccattccctccggcgtggccggtggccgggcgggagcagcagctggtaggggagggaggcggggagaggggtttggatggcggcgtgatcggcggagggggcggcggcgggcgatggggaaggcggggttcggggtggcggcgggttgcgcggcggtgacgtgcgcgatcgccgcggtgatggtggcgcagcgggtggcggccagggcgcgctggcggcgggcggtggcgctgctgcgggagttccaggagggctgcgccacgccgccggcgcgcctg

SEQ ID NO: 79511 - DNA, 486 bp, Triticum aestivum
  Clone ID: PAT_TA_79511
ccggtccggattcccgggccggagtgctacaacatctcaacccgccgccgccccccaccccccacccccaacaatcggagtgcatctacccaaaatccggcggcctccaccgatgaaccagccgtcgcgcctcccgagttccccaagtcgcgccgccaccaacctgcaattcggcgtttagatagaagagcgacctaattcccaaatcccgaccccaatatatccagatccatggcgctctctactgtattgttccaccccatcaacctgatggagccatacgctgccggctccacctcccgacgctccggctctcccgactgggtcttactccacaggtcggcgcgtttctccgacctccagaactcaaccaccgtcaagtccaagacgagggatggccaggccgacgaggtgaccttctgggtcgtccatccgccgggtgtctcctacttctccgaccactgcccctgcctgaatgaggatgac

SEQ ID NO: 79512 - DNA, 674 bp, Triticum aestivum
  Clone ID: PAT_TA_79512
cccgcgtccgggggagaagtgggcaagggggtgcagagccaggaggtgggggtcgccgggtgagcacagccgcacagggcctggtgccgccgctgacagagcagagtggcggaccacaagggggtgcgatggggtggccgagagagcatggcatccggcgagacaggcggctcccaagcagggaatgcagcggcgctggcctctcctctccctgtctgccgctgtcctgtgtcgtcactgccgctgttgtcctgcgtcgtcactgatgtccccaagtgcttctctccacaaatggtgccaccatgtccagatcaagtcaagcgccaggtgcaggaaaatagaacacgtgcacttaacttgtttgaggaaattccatctcgaaacaagatttgattaggacttgtgttcttgatgctctatctgtggctaactcactacaacagcacagatgtaaagggaatccattgtaagaaacacaggtaaaaaggcattttccttgttcttacagttttggatcaaagttcacatttaccttgagtgtctctttttttggtataaaatggattcaacaaccaattttatctgaagaccaaactatcagtaaggaagtgcaaactgagagaagtgggcaaaataacttgagcaaagaactaattctatgaaatgctactttc

SEQ ID NO: 79513 - DNA, 659 bp, Triticum aestivum
  Clone ID: PAT_TA_79513
ccacgcgtccgacaagctcaacacatggtgttcccttcttgattccagctggaaaggaagccatgcgtcggcgtacgtcaatgattcgggtgcctgcggcatgacgacattgcagaagcacgcatcgttcttcgacggcaaacaaggatgcatttgttttccattcagtttctttttgttccctacgctttttctcagagagatttctctaagtgattctccgtttggtgttcgttgattctgtctcacgtacaatttatcctccttgcatatcagcgttttgggccctcggatttggatttgcagcctccacaatgagtgccaccttcatcaatggcgtccttggcccccagataaaaccggtaatccttcgacaacaaaatcatacgtctttgtctataggagttattttctctattggagttgagaaggatgacatagcgaaggaggattccgacatggtagctcccacaatcacgcagttggagagcatgcgcgagttcggtaaactatgtattctattggtatagctctgaaaggttaggatgctttgggtcgcggcctgaactatgtatctgtggatattattacactttcagcatgctatttcctattcttttgacatcagtttctgtgaattatggctgaactatgatact

SEQ ID NO: 79514 - DNA, 538 bp, Triticum aestivum
  Clone ID: PAT_TA_79514
ccacgcgtccggagtctttaggagagagatccagatgagtacgatgagagcattacagaggcgacaggctgataaaaggatttcaaggtcatcagatccatcttcgcgtctacatgttccagtaccagttggtgcttctgagatgggaagtgagcctgatgtggaaatccctgcggcaccaactactaatgataatacgatgttgtcagtcaatctcgaagcatttgctaaggaaaattatccgagcactaacttggaaagttctgtaaaggagatggaaagagtggtaggtttagaggatcatcagatggaagatagcacacagaaaaagcagagcaaagatgaggcggacgaagactcatccatccactcaccccggcgagggagccctacaccgccgttactgttgaagaagccgggcaagatcgctctcccctcccacgagtccaccatgggcagattcctctgggctccaacgtgggacagggacaggatgcagatcgggatgttcaaggacggcgacggcaacctgctcgtc

SEQ ID NO: 79515 - DNA, 635 bp, Triticum aestivum
  Clone ID: PAT_TA_79515
cccgcgtccgaaaaagaaaagatccatccccaattcgagctccacctccaccgaaccctcaatcccaccctccacccaacaatggatccggccgccgccgccgcccggcggcaggcggacaagtggatgagcgtggccgagaagctcctcatggcgaaggacctcgagggctgcaaggagttctcctcccaggccatcgccgccgacccccgtaccccgggcgccgaggatctctacgccgccgccgacgtcctcctcgcgtcccagcgccgccgcttacccagcggccagcccgatccgtacgccgttctcggcctcgactctgccaagcccgcatcgcgcctcccggacgtcgtccattccaagttccgccggctctccctcctcctcaaccggtcccaccccgaccgcccctgctcggtgtacgtcgccgaggctgcccgcctcgtcgccgatgcctgggccttcctctccaacgccggacttaagtctgccctcgacgccgaactccatgcagccgctgcacctcgcgcttcccaccctcccccgacgcttcagccatggcaggaatggcaccggaaggttcccagtttgacgctaagaactatgattctaagatgcaggagctgctgagc

SEQ ID NO: 79516 - DNA, 664 bp, Triticum aestivum
  Clone ID: PAT_TA_79516
ggtcgacccacgcgtccgctcgtgcatgcgtcgcactgctccccaccccgcggcggcccggctacctacaaccgccgccgccctgtcagatccggcgagatccggcgcatcccacctccattgccccgtgtagggacttcgggtgcctggatctggcgcctctgcccccgagagcagccatggcgcccctgccccctacttctcgccggcacctccagtggtcgtggccgccggcgactgtcggatccggcctccaccgcgcctgtagccactggatccgtggatcccccaggcgggtgtgcccctgttagccccacatcgccgaccacgtgtccggtggctcacagtagcggcgcggctcggtaggctccgtggctgactctgcctacgagcgtgcagttctgcccacacgggcgtgcagctcgaccaacggagcattgcagttcggctgacggcaccgatggcttccggtgaattctcgcttggacggcggtgcgacgttcagttcaatcacttgggcgagcggttcggcggccgtatggttgcggtgtagtgcgccatcatgcgcagttctgtaggcgtgtactccggcctccccgtagccgctgtgcgcaactgctcatcttcgcgggcccgggcgcgccgccgctcccctttatcttct

SEQ ID NO: 79517 - DNA, 564 bp, Triticum aestivum
  Clone ID: PAT_TA_79517
ccacgcgtccggcctcttggatcaggcggtaaggcgaacccagtctgtgcctcccttcattggctagttgatggagatggttgatggcaacaacggcttcgaagtccaccactgtgagctgctcaaggcgtctgtctcggttgacctgctccgccgtctccctttccccttctggtggcccctccctacgaagacgatgacagggaggagggcccgccttttcctcagagaggaggtcgaccgtgggagtctttgtgtggaatgaagcgaaacagcaggaaggaaatagagcgggtcgtgtgtcatcgtgcacagtctgccttccattgtgtgagtactcgcacttggatcgcccaattgtgtgtgcacagcaggggaccatgcactggaacatcgaattcaacctgctcacaagttgaagagaaggctacatatgctttttgtagccagtactaagtaatctaatgatccgctccttgcaatctaagaaaaataaacattcaagtaatttttgatcgtaggtctggctaccaactatttgtgtttgtgtctaacaaaaaaaaa

SEQ ID NO: 79518 - DNA, 701 bp, Triticum aestivum
  Clone ID: PAT_TA_79518
ccacgcgtccggcagaatcagaacatgacaagttggtttctcataaaacctttgaagcaggccctaaggagatcccaagtactgcagtccctggtgaatttggagtatttccccaggacgtatcaacttcgcaacagattaaggaagtggaagatgcaagtgaaaggtcacttgacgtcatggctgacatactgagcactcctaacacaaattctgtgacaatttctgctgatcctgatgcccatgcacccatccacagtcctactgtcttcactggcaatgcagatgcagtggttcctacaggacgacgcttggagacttcacagcagattagggaagtcgaagatgtaagtaaaaggccacttgatgccagagctgacagactaagcactccaaacacaaatgttgtgacaatttctgctgatcctgatgcccatgcacatgcatcacaagctgatagagtcgaagttgtagctgcagactcagaacatcacaaattggtttctcgtgcaaccttccaagcaggccctaaggagatcccaattactgcagtccctggtgaatatggagtatttccccagaaagtatcaacttctagtgtgagaaatcctgctgccaagaggtcacggagtcctgaggatgaaacggctgctgtatctgtacatagtagctgtgactttgctgcttcccagtccaagcat

SEQ ID NO: 79519 - DNA, 499 bp, Triticum aestivum
  Clone ID: PAT_TA_79519
ggtcgacccacgcgtccgatttagcagtgaatcaagaagcgacctttatctgccaaacatcattttgatgatctaggaatcatatccacaatataatttttgtgtgtgatggtgcaacttaagatattagaggaaactggcaagctcatacttgaaggacggcgtgtggtccatcaacatcctcacgtaggccaaatggccaaggttgtccggctgaaaatctgcaagggctcatcgatgctctgtgttgctgtccattcagcaggcatcgccgacgacaccgtcagtgtctccgccggctacatgatctccttatcagcggcagtctacctcatctggtgggctcaacagaaagcatctgctacaattcccgaatcaaacatgcatgtcgtgatttgttctcctgatatgtttggaccatatgcaggtggtaaaccgggcaatatatatgtatataaacctggattcagtaattcaacatataaactggccaaaaaaa

SEQ ID NO: 79520 - DNA, 436 bp, Triticum aestivum
  Clone ID: PAT_TA_79520
ggtcgacccacgcgtccggtggaatgcggtcctggcggcgcgcgcgcgggacgggcccctcgggatgggggacttccggctgctccgccggctcggctgcggagacatcgggacggtgtacctctccgagctcagcaagggcggcggcggcgcggcgagggcgccgtggttcgccatgaaggtgatggacaaggcgtcgctggagagccgccggaagctgagccgcgcggagacggagcgtgagatcctgcagctgctggaccaccccttcctccccaccctctacgcccacttcgagaccgacaagttcgcctgcctcgtcatggagttctgccccggcggcgacctccacgccctccgccagcgccagcccggcaagctcttcccccagcacgccgcaaggatctatgccgccgaggtgctccttgcgctggag

SEQ ID NO: 79521 - DNA, 243 bp, Triticum aestivum
  Clone ID: PAT_TA_79521
gtcgacccacgcgtccgtgaacttgcagagattgcttctcaagaactattcaagttcaacgttgcgatgcacacggcaagcgtggagaagagcaccccaaatgccagcatccggcttgaaaggcatgtcagcaataaattgcatggctttatccaacttcccagcccggctatataagtcaaccatgcaagctaagtgatccacccgaggtgctcttctccacgcttgccgagagcatcgcaa

SEQ ID NO: 79522 - DNA, 482 bp, Triticum aestivum
  Clone ID: PAT_TA_79522
cgggtcgacccacgcgtccgctacaatccgatcagaatttcgcttcaacctgtattcgccctgcaaggctgcaactgcgtcctcggcgtgtcatcggcgtgcagctgaggccgcggcgagaagctgaaagccgcgccatggaattggaggccccggtggtcgaagcagatccggggagaaggatcacaagaggagcaggaggcggcggcggcggcggcggcgagggggagggcccggctggtcgaaccaccctcctgccctgccccaactgcgacatccaggtggtgcacaagctggcgcagctgctgctcccgggcctggccgcggcgtgcgtcgacagcaccctcgggagcccctcctccgcgctcgccgtccagctgcgcgcggagctggtgcgctacgtcgcgcaccgcagcagcagcccgcccgaggcggaggaggaggaagatcccatcgaccgcgatgacccggccgaggcggtg

SEQ ID NO: 79523 - DNA, 654 bp, Triticum aestivum
  Clone ID: PAT_TA_79523
accggtccggaatttccgggtcgacccacgcgtccgtacagttttcggcggggctggccgaaatgctggcgcgcgtggtcctctctggggaaagcagcggcgccgcccccgccgcggcgtggaagtacgccgaggctgccctcgccgcgcgcctcgcgtcaccggcgctcctcctcacgctcctctcctcaagggtcattcctcaacgggtggcaaggccaacagcgtatcgactttatttggagctcttgcggagacatggattcaaattatgttttcagatgaaagcggcaaattccaacaagatcaggcagttaatagatgataaccttaacctctcccagatatttggcttttcagcatgtgaaccaggagtctttattgttgaatttgtcctttgcattttatggcaattggttgataccgcattagatgatgagagtctgctagagttaaccccagaaaagaaagctcaatggccaactaggcctcaagatattagtgcatttgaagtttctttttcggaacaaaagccagagaaaattgagaaattacagaggatgaatagtgtgataactatagagcttattggacatcttcttcacaataaagtaattactcgcatcctctcattggcacgcgaaaacatgcaaa

SEQ ID NO: 79524 - DNA, 208 bp, Triticum aestivum
  Clone ID: PAT_TA_79524
gtcgagccacgcgtccgattttctgctgcatacttagggcctgaagtcctccagctccgggcttcacaaactccacgaatgaaattgtcccgaacatttgggctccgagaagttgaattcatgaagctatacccgatgatagtgcaaaaacgtggaggagcatcggcccagctccaccgaaactgaaagctggagattgcccaaatta

SEQ ID NO: 79525 - DNA, 498 bp, Triticum aestivum
  Clone ID: PAT_TA_79525
cctgcaggtaccggtccggaatttcgggtcgacccacgcgtccgtgataggttaaggtcattcatcatgagaggtgttgatgtggagtcccatgtgtacctactgttgccccatcaattatgtagtggcctctttctgaacattgtttggttccaacgaagatctattagtagtgctgaaccgattttaaaaacaacaacattggtcagtttcttaatttcgtgtactgttttcactttaggaccagaaaactgaacctcgacataatgacatactccaccggcttaaactttcctctacacacagtaccttctcattcatcatgtgcacgataatgctctcttcttatattattcatgattactttgcttgctactagcatggtacatgacattaccatcttaccagaggtttgtgcaacaaacctggcctgtgtgtcatagacttctttatattattttattctccaattttgccagctaaggatttaattatact

SEQ ID NO: 79526 - DNA, 614 bp, Triticum aestivum
  Clone ID: PAT_TA_79526
accggtccggaattcccgggtcgacccacgcgtccgcgcacacgcacacacgcacccacgagcacgccatgccgcccaccatgctcgcgccggtgcccacgaggccgcgctcccaccccttccgccgccggagggacgcggctactccgctcccagaccagatcgcggcggcgatggcggggaagcggcccgcggagtcctccacatcggcctcctcctccttccgcagcgaggtcgtctccaccaccaccgccacctcctccgccgccctcgccgcgtcgcagcgcccggagaagaggccccggcgccaggactcgggcgacgcgcggcccgccgcctccgagtgctcggaggtcatcggcggcgccacggcgcgccccgcggaggtcgaggcctccgagtcgtcctgcctccgctccgtcctccagcccgacctcgcctgccccgagctgctcgccgacgatgccgaggcgacggagtactcttcggcctgcgacgagctcacgcagtccgacgcggaggaggaggtgctcagtgctcccagcccctgcaccgactactccctcagccccctgctcgacacctcctcttcctcctccgaggaggaggaggaa

SEQ ID NO: 79527 - DNA, 637 bp, Triticum aestivum
  Clone ID: PAT_TA_79527
taccggtccggaatttccgggtcgacccacgcgtccgctcgtgccatgctgctacggctcctcctctagctacttctccttgcgtgcctgcctacctaatactctctctctctctcttcgtcatcttcttcctccgatctcctgtggccaaaggtacgtgcctcgcgcgtgccgacgtcgtgcgtgccgcgcgcgcgtctcggtctctccgacgttctagcgagcggagagagagagagagagacgggggtggcgccgggccgggccgggccggccgggtggatggaatgaaccggcggcagcccggatggtcccggctcggaacctgcagctcctccgcgacgcgcatggcacgcctttcatccgcgacgtcgccgccggcgtcaacgctcggcccggcgtccccgggccccagtggcgcagcgcccgacatcgatctctttgcggcggaccgcgcggggacggcggggccgcggcaggagacgctcccgggcatggacgtgccgcccggagccttcctgcgccccgccatgcccggcattccgcaggcgtcgttacaaatgtctgtgccgcgcgctgggccaccttggctgccgccttggagccacgcggcgcaacaaccgcagctgcttctccc

SEQ ID NO: 79528 - DNA, 273 bp, Triticum aestivum
  Clone ID: PAT_TA_79528
tcgacccacgcgtccgcgccgtctgatctggagtagtggtgggagtagcgcatggccggccgggcgtgctgtttaatgtagctagaacttgatttggaatccgatcacttggtccaatgctattttttaaagagaaggataactcgggttccgcatcaagcgatgcacataatgattctaaaagtattattctccatatcctataaaataaatacaaagattcactcaaaatcaccttccaaaaaaaaaaaaaaaaaaaaaaaaaaaaaaaaa

SEQ ID NO: 79529 - DNA, 612 bp, Triticum aestivum
  Clone ID: PAT_TA_79529
taccggtccggaatttccgggtcgacccacgcgtccgaaagttgctccactctctttcggttcacccggacgacaccctctcttggaattcgaattcaggcgagccaacggagagaggcgagcgccgcctcctccccgagcccaccaccggagcccttcccgagcgcgagacctagggttcaagccgccgctgccggtcctccgccgcggcgcgcccagccggccgaaccctccgcggccccgcctccctccctgtccctggagcagccgcccccgcccagcaacgccgccgccggcgaccagtccataggcagggcatcagcattgtcgattggagaggcttggaactgcttcggtatccacagcagagcaaacaagaaggcatcagttctagaagcttgcagaaccctcacccgtgcagatggagaaccgaaagaatgccggcctcaggaagaggaagcttcccaacgatgggacggtgcaggagcaggagcctactatcaaggagatgtgccaagccctgaaagagatggaaagtgagctccagaacctccgggacgacaacaaccagctccgggatgagctccttggcaaagaccggcagcttgcgga

SEQ ID NO: 79530 - DNA, 349 bp, Triticum aestivum
  Clone ID: PAT_TA_79530
gtcgacccccgcgtccgcaccaatttcgtctccccggcgactcccttcaccaccaggacctcccctaccccacgcaccgccgccgcgagggtgaccacgcgaagcagccgtcgctgattagctacaggggggcggaccaacaagaccgccacagcccacagacaccccaggaggccgggtggcataaaccctaggaagcccgcggctcttccctctctctctctctctcccgacagagcacgccgcgacccgccgaccacaagaatgagcgcggagaccgacgcgacggcggccggcgggctcgcgggggagatggaggtcgaggcgaaccgccgcctcctccccctcg

SEQ ID NO: 79531 - DNA, 136 bp, Triticum aestivum
  Clone ID: PAT_TA_79531
cgtccggagggatatgtccttaagtaactgatgcaccttaaagacctctccctctgacagggaagttccatcaaccttgtcagagggagaggtccttaagtaactgatgcaccttaaagacctctccctctgtacc

SEQ ID NO: 79532 - DNA, 513 bp, Triticum aestivum
  Clone ID: PAT_TA_79532
cgcgtccgcctcgtttctacctggttcacacttccttcgaaaaatgggcgccgccgccgtcctcctttgcgcagccctccgccggagccgccccgccgcggcagctctcctcctcccccgcacccttccttccgcgccagttcctctacctccccctcctctcgcccgtgctttacctctcctcccgcgccttccattctccgccggctgctcgtactccaccgttgcagagatatcggagccccccgcgaagcccaagggcaagccaaagaggagcccaatgaagcagtcccgcatcgacttcaccaaggtggacgcggcgcttctccccaccatcatcctcgtcggccgccccaacgtcggcaagtccgcgctcttcaacagattaatacggaggagggaggcattggtgtataatacacctggagaccatgtcacccgcgacatccgagaaggagttgccaagcttggagatcttcgttttcccgtgcttgactcagctggacttgagac

SEQ ID NO: 79533 - DNA, 658 bp, Triticum aestivum
  Clone ID: PAT_TA_79533
ccggtccggaatttccgggtcgacccacgcgtccggtagatatgggcaagtggcggcagctggaagggcagcagcagcctgtggggcgttgaccggtccatcagcgaccttgatggaggagaagggccaggcaggatttgtgcccctgcacctccaggagtatgccattggcacttccaacatctagcagtaaggttcgtaatttattcaggtacttctaaggtaaacattcatcttctagccatgttcgtgaagtaattgtgaaaaaaaatccctgtagattatatttttggatgaatttacctgtagattatatttttggatgaatttccctgtagattatatatttggatgaattaaggtataattagttatctgcaatgccatgtttgtgaagtaattgtatttttttagctgcgttatctgtttgaatccgagtaaaaaaattggatgcacaagcctggatatgtttggatttctttggatggattaggggatctgcttggatccccgggtttcttgttgctttgcgggaggctcggtcgcatgctgagattcgtgacagttttttgttgcctttcttaactgtctattgttggattctattagtttaagatatttcgccgatctgactgttggtttgcgctagtacagtttt

SEQ ID NO: 79534 - DNA, 443 bp, Triticum aestivum
  Clone ID: PAT_TA_79534
ggtcgacccacgcgtccggtcatgaacaggggatgaggctaccggcgtggctcaccgccgtgccgccggacccccgcgtgtacggtgacctcatccagcgctgcgcggaagccggccacctcgccgccggcaggcagctccacgcccgcctcgccaccctctccgtgatcccctccaacttcctcgcctccaagctcatctcactctactccagaaccggacgcctgcacgacgcccgcagggtgttcgacgccatcccgcagcccaacctcttcgcctggaacgccatcctcatcgcgctctccctccactcgccccaaccctccgcggctcttcgcctcttcgcggcctccgacgtgtcccccgacgagatcaccgtctccgcgctcctcaagtccctcgccgcgtccgggacgggcctgtcccctctcgtcgccggggag

SEQ ID NO: 79535 - DNA, 645 bp, Triticum aestivum
  Clone ID: PAT_TA_79535
gggtcgacccacgcgtccgcttgaatttaccatccgtgactgtcgatggtccggccctgtgccgtctgctcgcctctaatttcacgaggatgatgtcgattcgttcggtcctcctgctgcgatcggcggaacaaaagtcagtcaactcccggcgaggggtcgcttccatgcctctatcactgtttatttattttaacgggggccggagagatgtcgctgtccctctcgtataatctagtatctcgattcgaatttcagaagaaaaaagtatcacgattcgagactggggttcgatatttacaagtcattcgagtatacggcatgagtttttccgcagctcgtctcagattggcgagccatttgggcgtggaccgcgtggtgaccttaattagtacctccgctgctacccaatcttttagtcaattgactttaggccacttgcagtgtggataaaatcatacagtatcatattttccccacatccacgcttcccacgccaccggccacctacttcactgtatcaagtgcgttattttacgtcttcccctaaacctcgtaaatacaagatttggattcggtgtggaaatttgttctagatgtgttagtgctctgctagttcgtaggtaccttgacaaattaatcttg

SEQ ID NO: 79536 - DNA, 623 bp, Triticum aestivum
  Clone ID: PAT_TA_79536
cctgcaggtaccggtccggatatccgggtcgacccacgcgtccggagaaatcgtacagcaccggtactccagacactgtttggaacgtaaaggttctcttgatgagtggtatgagcaacggtgccttcgctgatatatgttcgttgagaagtgccgaggaacgaatagcgcactggaacaatgtcttgaaatttgctgtatttaagaaggatcatgcacttattacaattggaggtccttggagtgcagcaatagatggtggagatccattgattgactgttcgtgcttggtgcgaactgctatcagatgcactaaagaactggttcagattgatctatctaattgcacacactggaatcatttcctcgaggtccattacaacagaattggcaaagatggactctttagtcataaagagattaccgtactgtttgtgccaaacctgtcagaatgcatacctttggtagagttatggaagaaaacctggattacatacagaaattcaaaagtatacagggagaaactggctataaagagtgaaaatgccccttgtgatacaaaggaacagaaggaaggagcagatgatggtcatatgagggagggggatattttgcaggatgct

SEQ ID NO: 79537 - DNA, 371 bp, Triticum aestivum
  Clone ID: PAT_TA_79537
tggacgcctgcggtaccggtccggaatttccgggtcgacccacgcgtccgggggcaggccggcctcaacgggctcgccgtcggcggcggcgggagcgcgttcgcgtccaacacctccgtgccgatgcccatggcctaccacggagccggcgggtactactactagctcctcctcctcctcctcctcgagccgagcagcctctgctcgttcctgattgatcgttgagcttttatctgtgaataataatactctgatcgtgatttgccaccagaaaaactgtaatccgaattgatttgatcctgctcggacgctgaggtaaccatggcgattgagaatttgagattaatggtaaaaaaaaaaaaaaaaaaaaa

SEQ ID NO: 79538 - DNA, 446 bp, Triticum aestivum
  Clone ID: PAT_TA_79538
ctgcaggtaccggtccggaaatccgggtcgacccacgcgtccgggtgtttttcgccgctgtttctataaggacacactcagaatgaatgtttagatggttgagtatcatgctgcagatctttgttcattttgagtaggagggacaagagatccctatagtacttcatgggtgctcaagagaaggctacgataatgttcagaggcagcagaagactggccagtgaagatactaattatggaagcttataaacatggatatgaacagttgcagaatctgacaaccaagaccacatggcacgtttatgcacttgcggcatatgacttgtcaattaattgtcttctctagacagccaaatgctgataatggaattcttcaacttgcccgcttcttggatgttgtgccccgactggagacgttgcatttggatatggtatatctgaacctt

SEQ ID NO: 79539 - DNA, 658 bp, Triticum aestivum
  Clone ID: PAT_TA_79539
ccggtccggaatcccgggtcgaccccgcgtccggacgcgtgcgccaactcggaggccatcgaggaggccttcctctacttcgacgccatgtcccgggaccacgacatcgagcccggcatggagcactacgtcgggatcatcgaggtgctgggcaagtcggggcacctcaacgaggctgtggagtacatcgagaagctgccgttcgagcccaatgccatgatctgggagtcgctcctgaacctggcacgcatgaacggcgacattgacctcgaggaccgggcggaggagctgctggtctcgctcgacccctccaaggccaaccccaagaagctcccgacccctcccccgaagcggcggctcgggatcaacatgctcgacgggaggaacaagctgggggagtacaggctgccgcccaagatcgagaagaaggtggtgaacgagcagcgctacgtccccgacacgaggtacgtgctccacgacattgaccaggaggccaaggagcaggcgctgctgtaccacagcgagcggctggccatcgcctacggcctgatcagcaccccggccaggaccccgctgcgcatcatcaagaacctcaggatctgcggggactgccacaacgccatcaagatcatgtcgaggatcgtggggggggagctca

SEQ ID NO: 79540 - DNA, 514 bp, Triticum aestivum
  Clone ID: PAT_TA_79540
ggtcgacccacgcgtccgaatatatatcttggtagttataaatgatacatctatttgatcatcagatgcttatctgtagtgtttaggagagtttttttgattggaaatgacttttgattcttggttcttgaggtggtatattactctgaagcacttcaatttttggctctggctaagcataatatattactttactactgagatttggctactaatgatatatgttaccattgtttttgttgtctttgatagtataaaagatcggaagtgcatcagctatcactgctcctgtttgttggtagatttggcaaaccctctaagttcattttccacgaaaatatagtttgtaacactggttcgaattaatatattgatataagtagggcaatatccaagtttctttatactgatataagttcagaatttgcaacaccattctactacttacacaagagccttgtggctaatcatacttgatcctgtgtgctctcatctgtaggtatgggtttcacat

SEQ ID NO: 79541 - DNA, 792 bp, Triticum aestivum
  unsure (1)..(792): unsure at all n locations
  Clone ID: PAT_TA_79541
tggacgcctgcaggtaccggtccggaattttcgggtcgacccacgcgtccgggaggagaaagaagcaagaaaaaatggaatgaaatggatgaaaaaggaggttcttcgagcatttgaaaactataaatcagcagataaaaatcttgagtacgaggttgtgatgattcactcccagtgtctcatatttgacaccttctcaaaatcataccatcactacaattttacaatgaggacaagacagtctcggtcaaagcattggaactaccagcaattctttgctgaagccaaatccatggagggtaaaacgcagtacttttgcatcccgctgcagcctagtgagcatggtcattgctttggatgccggaaggttggcgtttctcttagacatcccgagagtggcggctatgagaagggtaattcaggctctggatttccatttgacactgatagtgagagtgctgactgactactagtggatttcctcgatcgcgtgggcgtctccactgaaattaatctgatgcaagatgattcacatgagttctttttaggaagatttacatgaggttttagttgacttaatctaagtattatgtagtcgtctgatttactaaatcatctagcctacctttgttgattggatttgagatagcttaacgcccatgccgagcggncatctagcttacccttgtatattgtggatttgtggaaccttatgcttggattttaggacatctagattcatcttatagttattatggactaattacatccaatggatgcagtattgttgtt

SEQ ID NO: 79542 - DNA, 655 bp, Triticum aestivum
  Clone ID: PAT_TA_79542
ccggtccggaatacccgggtcgacccacgcgtccgggagacttattgtgctacacaataagtctccatcccaagtccagagataggggtggttatagccatctcatcaagtcgagaagcgtatatctttttacagtttctaggcaaaatgggtggttttagccatctcatcaagtccagaagtgtatgtcgttttacattttctaggtaaaaggatggttttaggcatctcatcgagtccacaagtgtgttgttttggcattgctctgattaacgagtatttctcctgttaatgctcttccttggagagagcacaccagaattaagaaaaaaattagaggacctaggattaagagaaggaaatgatgattaactgagggtattccttaagtctcatgaccatggcaaaaacgaccaacattactgaacagagggagtacttaatttagcatttgtcacaaaataggaatatggagaaatcacagtaacgagcccttttaaaccattgaaagcactttagaaccttacatgatcaagaaagaagaaacaaaagggaatatgtgactgaagcctacaacatgacataatgctgggcaacttggcacttggaatgggaatgcaaaactcattagacggcgcaatgcatttttcatgtt

SEQ ID NO: 79543 - DNA, 426 bp, Triticum aestivum
  Clone ID: PAT_TA_79543
ttttttttttttttttttttttttttttttaaaagaataaaaatctgttataaaaattaaagcaggagatattcttacctctatatattaggaaaatagcacttgagagcgcaatcatcaggaactgctagatgattccatcagatactatcatcttccttggacagttcacatgcctatacttgtaaacactcttgggggggcatatatgttgaattaactcttgacaataaaccaacggaatgattgagactcagtcaccgaatacaaaaaaaagtaacctgcaatcatcatcaaaatattgcgactatcttgatctggggggtctctcttcatggcaacagaacattggggacttcatgggggatgcagcagttctcctcccctgaccaagcaaacacttcagccggctgcatatccacctga

SEQ ID NO: 79544 - DNA, 652 bp, Triticum aestivum
  Clone ID: PAT_TA_79544
ccggtccggaattcccgggtcgaccccgcgtccgtgatactccatttaaccaggctgcatatggtcttgtggataaattaggaagtctggttgttagaatagttttcctgccatttgaggagagttcttatgctacattcacccagttagcatcaggtttctcttttgcatgaatataaagtttcattttgctatgatagctaagtacaattgcttatcatctgtttggcctgaaagattgaatttcatgcatttgcatcattgcggtctactgatctggagaatctgtctgtaagatttgcttattgagcatttctgtacttgattagtcaaaggaggttaacctatgttgtgctggtatcagctaaacaaaaacacccatgagatataattttcctttcaaatccatttggtcagctgaattgattatcttcttgtgaagcgactgctttgtgtattggctactggtcgtttgatatttctgcccacttttggcatgtttgctattctcattgttcagtatttgaattactcatgacctgctcacaggaagtaagcctcttgcaagtactatgaattattattattgctaagataagcattgctgccaatgcaacaaaactagattaccttccgcatattccttgctatc

SEQ ID NO: 79545 - DNA, 588 bp, Triticum aestivum
  Clone ID: PAT_TA_79545
cgcgtccgaaatccaccccctccctcccccaaacccacacctcgtcgttgccaccaccattgccgccgccggagagcccgccctctggaggcgcagccgcccgccgataccaccgtcgtctccgccgccatgatttgcgcaagtaagccctcgtgtcttgccccatccctaccaccgaaacctagctctacggccccgctccctatccaatttccaagcactaacccgccgcttcctcctgccgccgcgccctcccctctcaagtctccggcgaggtgccggaggacccggtcctgtcgaccaagtcggggctgctcttcgagcggaggctcatccagcgctacatcgaggaccatgggaagtgcccggtcaccaaggaggagctcgccatggacgacctcgtgacggtgaagaccaacaagattcctaagcctagacctctgcaagctgcaagtgtccctggactccttggtatgtttcagaatgagtgggatgctctcatgctgtctaattttgctttggagcagcagctacatacagcaagacaagagctcagtcacgcgttataccagcatgatgctgcttgcc

SEQ ID NO: 79546 - DNA, 677 bp, Triticum aestivum
  Clone ID: PAT_TA_79546
ccgggtcgacccacgcgtccgcgccttcttcctccccgcgccctagccttcgatccacccccaaattcgaccctcccttccactccctcctcatcgccatggcgtcagacaccgagggcatagccgcgctgttctccatgtacaacgatgacgacgaagaggacgccgacgagcccggacctccttccccgccgccgcccgctgcggcaacctccccctccacgtcacctcgagccagaggcgagagctccaaccctaactcgaaccccaacccttcgccggagcactcgccccctccccttcccgaggagcaggccggccgcaaaaccctagcgagcccccaggtctcgccggcgcttccgccgctgccctcgcgccgttcgcccctgcccttcgcggtttcgtccccctccccatctcgtccccagctgtccgccccgccgcccgatctaccccgcccgccacggcgcgggtcgcttgctatagtggactacgcgcacgacgagatggcaatgtcgcctgaccaggaggacggggagatcatgagtggcataggcggtttgggctcggatgctcaggatgctgaggggattcttgaagaaagagttctctcagggactgttcatattctcaccccaaaagtcctatcagaaacttctcagcatttggatgcccct

SEQ ID NO: 79547 - DNA, 452 bp, Triticum aestivum
  Clone ID: PAT_TA_79547
cgagttcctcaaggacctcgacgacggcaagatcgacaacgtccccgcccctgccatcgccatcgactactggcgcctccctgccaacgccaccctcaaggacgtggtcaccgtggtccgcgccgacgaggctcaccaccgcgacgtcaaccacttcgcatcggacgtgtactaccagggtatgcagctgaaggccaccccggcgccgatcggataccactgaggctggccgtgttctgctgaattttgcaacgctactactgctactaccaccaagcaaatgagtgtttcgttttgaaggcagaggaaatgagagctctttagctgtataggatgttgcaattgttgctcgtttggtaactatcgagtactgagaaataagcagtgtgcttgtcagttacgtatctaggattgttgaaccaccatttcgctctaagatgaacctatttggc

SEQ ID NO: 79548 - DNA, 520 bp, Triticum aestivum
  unsure (1)..(520): unsure at all n locations
  Clone ID: PAT_TA_79548
ccggtccggaattcccgggtcgacccacgcgtccgaggaaaattaatcaaagtttttntggagaattcctatcatccgttcacagatttcttcactgcaggtactgttcgagcgtgaagtactgttccagtcactgagccaccagtgtactgttccagccgttgagccaccacagctgcggggtgatcacatgattcagttgaccaataggttttcttcagcaaccagtcatatgttgatgatttgctatgatacagagttctaaattcatctcctatatgaagacaacaacaaacaacaacaattgcaggtaagcactatgtggtaagaaaactaggtgagtagggagggaggcactatcacggacattctaatttagattttatcagtcctcacggttatcatcatctctttgcaaattttgcaaaaaatagtgttctgtcatggtcatttgacagaatgaagagaaaaacaagtgtaggctggtagaagtggaacttccgaattaccaccttgcttt

SEQ ID NO: 79549 - DNA, 602 bp, Triticum aestivum
  Clone ID: PAT_TA_79549
accggtccggaatcccgggtcgaccacgcgtccgcctggccgtgcccctccttgttcccctcctccgccgcgtcgcttccccgagcgaggagaagcctcgatttctctgacctccccacagaagccgcagctgccctgctccaccaccgccgcaactgcctcctccgccgctctctcctgctcgcgcagctccagcttgccttcctcccctagcttccccctccctagtgacctccgctctctgctccgtctgcttcagatccggcgtcggcaaggctgatatggtggttgcgaggccagacggcaggagaagtagccgacgagcccgatgacagcaagctcgatggcggcggagacatcttctctactgcgagctccaccatacctgcacatattgtactgcgagctcgacgacggcggtggcgtcttcttggcatcacgagcagacccgccggggaggagcaacaacttgcagacgagcagcaggtcgaggagaggagtgggggagacaacacggagctcgaggttgaggatgaacttcagttccaggtccgggcgctcgagacccaggctggcgcaggtcctggcggcggcggcgcatg

SEQ ID NO: 79550 - DNA, 629 bp, Triticum aestivum
  Clone ID: PAT_TA_79550
taccggtccggaatttccgggtcgacccacgcgtccgctgactcccaccccctcacgccacgccacgcggcgagaagatggacaagcacgccgccgccgacgccgccgccgccgcagcagcagaggacgtcgagacgggcgagcacgagcgcaaagggacggtatggacggcgacggcgcacattgtgacggcggtgatcggctccggcgtgctggcgctggcgtggagcgtggcgcagctgggatgggtggccggcccgctcgcgctggtgggcttcgcgtgcgtcacctactacacttccacgctgctcgccaacgcctaccgcgcgcccgaccccgtcaccggcgcccggaaccacacctacaccgacgccgtccgatcctacctcagtcccagagaggtcttcatgtgcgggatcgcccagtacgggaacctgtggggcaccatggtcggctacaccatcaccgcgaccatcagcatggttgcgatcaggaggtcggactgcgtgcacgagaacggccagggcgcgcgctgcgacgcgccggggaccgtgctcatgctggccttcaccgtggtccaggtggtgctgtcccagttccccgggctggagcacatcacgtggctctcg

SEQ ID NO: 79551 - DNA, 445 bp, Triticum aestivum
  Clone ID: PAT_TA_79551
taccggtccggaattcccgggtcgacccacgcgtccggtgatccggagccgctcatcgactgactgcttgtcggccgggccctatcgccatgggagatcgcctccgcgcgcctccgagctagcgaggagttgatccgaggttcgtggctcccgtcgctccgccccgtccccgtcgccggccggttccttggttggtgcgtatgcggcggagggtctgaggattgccgagcgagctggttgtggccatggagcatccgatgcaaaggagcgacgagggcggcctgcggggcagcagcatgcgtgccgacatggacgagctggatctcatggaggagttcctgctggcgtcgcccgggcccgacttccccgagttcctgcaccccggcggcgcctcgccgagccctcttctccccgctgttcgacctcggcagcaccatcaccaccg

SEQ ID NO: 79552 - DNA, 487 bp, Triticum aestivum
  Clone ID: PAT_TA_79552
ggctgtgcgcgctccgtccggtggtactaccacgacattccgacaagaggtgtcctcgtgtcaatggcgacccggtgtggaggggcgggcggcggcggcgttgtgggcgccgtggcgagcgtcctggtgctgtggctggcggctggaggcgcggccggcctggtcgccaccgaccctggcgcggaggagcgggcgcgggaccgggtggaggcgctgccggggcagccggcggtggccttcgctcagtactccgggtacgtgacggtgagcgagcgccacggccgcgcgctcttctactggctcaccgaagccgccggcggcgacccggccaggaagcccctcgtcctctggctcaacggcggccctgggtgctcctccgtggcttacggcgcgtccgaggagatcggccccgttccggatcaagccccacgggacggggctctacctcaacaagtactcgtggaacagagaggcgaaccttctcttc

SEQ ID NO: 79553 - DNA, 342 bp, Triticum aestivum
  Clone ID: PAT_TA_79553
ggtcgacccacgcgtccgcgaagtgttatcccattgtttgaccctcatgtgcctttgtcgatgttacatgtggaaatgccccaatgtcattacagtgaccatcctgagggaatgcccccgctttactacagtgaccaccccgaaggctgtctggaagcagttagtccactctgccattccgacgatcatcagcgtgaaccccaatggactgaaacttactacatgagaggtaggagcttcgacaggattctagttctagatcgcgagcggccgctctagaggatccaagcttacgtacgcgtgcatgcgacgtcatagctcttctatagtgtcacctaaatt

SEQ ID NO: 79554 - DNA, 692 bp, Triticum aestivum
  Clone ID: PAT_TA_79554
gtcgacccacgcgtccgatggctttagccacctaacctgtaatcctcaacactacttagccacctaacctctaatcctcaatactacttgtcggcactgcaaatcctccgatatactcctacctaccagatttataatgtctgcgtgtattttaaaatttactttgaccataaatctggccagtgaagtatgagttatgtacccccaaaaatataccgttggattcatattcaaaagaaatgcccaatggtattattttagatggggtatgggagaaaaactgaagaaatgagtctcggtctggaacatctatgtacaatagagctctatgcgtatcttctgccggtactagaatatgtagctctagatgaggcatttcctgctgtacagtacgactagcaggaaggacttggcacccacaatgctggttgagaagtcaccctgctctgacccggtggcgcacaaaccagaacctggacccttcacagaaagttagcttgatcatggccagcgcgcgtttgagggggccttggtcacccagacgggaggaaaacattgtgttgaccgcggcgatcatcgctgccctactcagctggagctccgcgaggccggagcggagacccttaccttgttgattgtactccgaggtgaacaggagtggtgtggaggtcgggactaggcgttccttgccg

SEQ ID NO: 79555 - DNA, 661 bp, Triticum aestivum
  Clone ID: PAT_TA_79555
accggtccggaattcccgggtcgaccccgcgtccggagcaatcgaggatctcgtcggtgccttcagacgacggagcaggccggtattccccgcgcagcgaggttttcccacagctagatggaagaagaagaacaacatctcaggcgggagatacagaccccgcccaccatggaaagagatggagagcagctggtagtataaggagaagcagcagctccgtcgggatcaacaagcagttcaactaaacacacacctaggatagctattcagaaagtaatagaggtggtagccggactgtcagattacaaaagattcctagttgaggagattggatttgagggtgtactgcgtattcccatgatccagaaaatcaatctgaagtttagcaagttcctcatgacaaaggtggatgtggaagagcactgcatcatcctgtgagatggcggaactccaattccattctatccagaggattttcacaaagtgtttggcatcccatgcgggcagcgagacatccatggaaaagatgcagacaccacacctgaagcaatcgaggtcattaggaactctatagggtggactgataaatctgatcgcagcttaagctcgcttgaagtgttcatcggcaaggaaataaatgaactgtcccagccgattggag

SEQ ID NO: 79556 - DNA, 675 bp, Triticum aestivum
  Clone ID: PAT_TA_79556
gtccggaatttccgggtcgacccacgcgtccggtaatatttaattagtagttatgcagatgctgtcgcttttactttgtgcccagtatgtcgtctggaggtgctatggttgatacttcgtttattagctggcatgtaatgctgtaatgcttgacccttagtggtgtggattgatgtaagtcagtctggtactgaacctggttttgtgaaatcggaggggggaagcctctcttttgctaaaaaaagtaatatttaattttccttttacatttcagaaataaaaaaagaatggtttgaggaaactatttcgtttttgtgaataaataagtgagtacaccttaggtgggacccaaatgacctttattatggggacacataagtgaccttctctttcaatatcatcatccatcgtaactagtactccagttgttattattgcacaacataaactcatagtgaagaaattttgtgtggatgaagaaagtatacagtacaatataattgaagtgatatatactcattaaatttcttcagtggaataaccaataatgcaacttaagagtaaaaattgtacactgacttcctagttccaacccccgattctgattttggccatcttgggggacataacccaaatggatctatatcctgattttttccacagactatatggctg

SEQ ID NO: 79557 - DNA, 620 bp, Triticum aestivum
  unsure (1)..(620): unsure at all n locations
  Clone ID: PAT_TA_79557
taccggtccggaattcccgggtcgaccccgcgtccgagcaagagttggccattcagaaggtcaatacagaggcgccaatcaacaagatgcaggcgacgctgggcattctaatcgactcggacgacgacggcgactacgagggggctgacagcgactggagcgcctcctgcgtgatcctgaagttggaagcagggtgtccgggtgatgaggtggtggcggaggaggcgacgagcgagggggagggggaggcgctagagatcctgaggcgggcgaggaagcggcggcggagggaggccaacgccaacgccaacgccaccgtgctcgtccaagaccaacgctgaactgaggctcgtacagcaacccaacggtaacgcgtggctcctacggtgggtcgacactcgacagaaagtgctttaacagaggtgtggttaacggggcatacaggacaggttacagacgccgggagaggtaaaaattcacacactatctcaccgtgtggtgatgtgatgtacagacagagacaagtacagnatttttcttctttttccctttgcacagacgaaatggaggctcgtactgctaagcaagtttaagatttatcggaaaaggagttgaactct

SEQ ID NO: 79558 - DNA, 671 bp, Triticum aestivum
  Clone ID: PAT_TA_79558
taccggtccggaattcccgggtcgacccacgcgtccggatgagtcatacaaaagatgggtgttgagatcagccagtaaaaaatggaaagacttcaaggttgttttaaagaggaaatattacaaagctgatttgtcacgggcacggaatattcttaatggttgtgataatagaatcccaattggacagtgggagtggctagtaaaacactggagaacagaaaaagctaaggaaaaatctgagagaaacaaagccactcgggcatcgcaactcgagggatgcaaggggacccacaccgctgggtcacgaagttttgcagttgtccttgatcaaatggagatggtagagggtagagaaattgggcgtgccgagctttacgtggttacgcatacaaaaaacaatggatatccagtcaaccaacaaagcggagtaaaaatggatgacattaaaaaaaggattcgggaagatccttctttgattggtgaggaggcccgtgatggtgatctttattcatcaattttcccaaaagaaaagaaaggaaggccaagtggccttggtctattagtaggtggagtcgcttcggagcgccttgctcaagttgaagctgaactacatgctgctaaacaagagaacatggagcttcggcatgtggtgcatactctggtggcaaatc

SEQ ID NO: 79559 - DNA, 694 bp, Triticum aestivum
  Clone ID: PAT_TA_79559
ccggtccggattcccgggtcgaccccgcgtccgatgaaaccacagaagacattcagttcagagatgctgaaatggatgaagcaatggataccatgcaaagcaatcctgaaactacagaagacattcagttcagagatgctgaaatggatactatgcaaagcaatcttgaaactacagaagacattcagttcagagatgctgaaatggatgctgagggtttccaaggagagcatgtacatgactctccaattgtagcattcaaagaagcgatgcagcttgtgcgtgtcaagctggagcatgtccaaggcaagcttgtgactgcccaggacgcagtgcaatatttcaaactgcttgaaatggctagcaccaaggcagaggaactttcatcaagcattcagctctgctgtctagatgttcagaaagagcaggaagacatcaacgccctcaagtctgcactgtcagcatcacacgagagagaaaacgctttggaaggcaagattttctcgcccgcggcatcatgctgggacttgcatctgaaaaccgaagcccttgcgagttctcaggctactcaactgtcccatctttttattcattagttcgactagttctagatcgcgagcggccgctctagaggatccaagcttacgtacgcgtgcatgcgacgtcatagctcttctatagtgtcacctaaatt

SEQ ID NO: 79560 - DNA, 746 bp, Triticum aestivum
  Clone ID: PAT_TA_79560
taccggtccggaattcccgggtcgacccacgcgtccgtgcaatttatatgcttcagaactgtaatcagatgtggatttacctctaaattgttgtagggcttacactgtaatataccgcagatttacactgtaatttgtatgcttcagcactgtaaatgttgtatgctttacacagtattttttggactgagtatagtggatttttacctctgaattgatgtagggcttacactgtaatatactgcacatttacactgtaatttgtatgcttcagtactgtaaatttgtaggtcttacacagtattcgtcagatgatttacctctcatttttacagtgtgatttccatgctttttagctctgtacttcatgtagtttcttgcatttttgttttcttcttttcatgtgcaagtgtctctgttgcagtagtattgagcgaggtcctgtttttcactctgtaattactagtattttttgcctcagacttactatgcaaattgcatggtagtttctatgtaagtcagcccatagtttcagtgttttttcacataattactagtatttactgtgtatttttgccccatttttactgtgtaattcatcatgtagtttcagtgtaatttactataaaattattttgtaattcatcatgcagttccagtgtaattccatgtagaattactgtgtaaatcatgccgtatttttactgtgtaatttactatagaattactgtgtaattcattatgca

SEQ ID NO: 79561 - DNA, 684 bp, Triticum aestivum
  Clone ID: PAT_TA_79561
ccggtccggaatttccgggtcgacccacgcgtccgaagcccacaaccatggccgcgctccaccgcctccttctcctcctccttcccctcgtcggtctcctagttctacacccactcccaatcgtcgcctccgacgactccagttacctcctcgccgccaaggctgtgctctctgaccccgccggcgccctctccatctgggaggccgggtccagccattccctctgcgcgtggccgcacgtgctgtgcgccgggaaatccaccgccgtcgccgggctctacctcggcaagctctccctcgccggcggcttcccggcctcgttttgctctttgaggtccctgcagcacctcgacctctcccagaacgacctggtgggccctctgcccgcctgcctcgccgccctcccggcactcttgaacctcaccctcgctgggaacggcttctccggcgaggtcccgccggcttacggctacggcttccggtcgctcgtcgtgctcaacctggtccagaactccatctccggcgagttcccctggttcctggccaacatcagcaccctccaggagctcctgctagcctacaacgccttcacaccgtcgccgttgcgggagaagctcggcgacctcgccgacctccgcgagctgtttctcgccaactgctccctgagcggggaaatcccttctt

SEQ ID NO: 79562 - DNA, 408 bp, Triticum aestivum
  Clone ID: PAT_TA_79562
cgacccacgcgtccgctttctagtggcgatcaactgataatctttacaataaaggtaattgtcttcactattttattttcagcttgtatgttgacccttggaagtctaacatggaattcgaaatggtatgcacatcttctatcctacagcttatgaggatgctaatatggagttgtggttactgactgaactgtattaaagaagcttaaatcagctgaaacactaaaataaccaacaacttcaatcattattgcaatttgggttccttaggcttttaactccaggaaactgatataaccaaaaggctgaattgacgggacatatattcacacacacttgataaattatataatattgcatatgttgataatgaaattctaacaattgctcttaattataatatgcttt

SEQ ID NO: 79563 - DNA, 459 bp, Triticum aestivum
  Clone ID: PAT_TA_79563
tgcaggtaccggtccggaattcccgggtcgacccacgcgtccgggtccgcgccggcgaggcccatgaggcgggtgcagatcatctactacctctgccgcagcggccagctcgagcacccgcacttcatggagctcgcgcagtttccccaccagccgctccgcctcaaagatgtgatggacaagctgacgctgctgagggggaaaggcatgcccgctctcttctcatggtcttgcaagaggaactacaagaacggctacgtgtggaacgacctctcggagagcgacgtgatatatccgtccgacggcgtggagtacgtcctcaagggctccgagatcttccccggctgttcttccgccgttgcaggggagcggttccagcacctccgcgtgacggacaggtcgccgaccaagcccccgctggccctcccgcacaaccacccccacccggcggcatgaggg

SEQ ID NO: 79564 - DNA, 250 bp, Triticum aestivum
  Clone ID: PAT_TA_79564
ccggtccggaatttccgggtcgacccacgcgtccgcacctacactacacaaaaccctagccagtcccttcccctcccctccagcccgtccccacctcgcatgctcgcacccctcttctcccgaaaccccagcctcctcttctcccgaaaccccagcctcctcttcctccccgcagtcgtccgcatcgcccgcggagcaatgtcggcctcgccggtcgccttggcgtccggcaaaaaaaaaaaaaaaaaaa

SEQ ID NO: 79565 - DNA, 493 bp, Triticum aestivum
  Clone ID: PAT_TA_79565
gggtcgacccacgcgtccgcactctggcctccttgactccacccccaaatcccatccccccacctccggccgccgcagcgtctcccgtctccggcgacatgggcaccgtcacccccgccgatccgcacccggctttcctcgccgacaagggcgccagggtcttcgtggcgggccaccgcgggctggtgggctcggccatcctgcgccgcctcctcgcgctcggcttcaccgacgtggtcgtccgcacgcacgccgagctcgacctcacccgccaggccgccgtcgaggccttcttcgccgccgagcggccccgctacgtcgtgctcgccgccgccaaggtcggcggcatccacgccaactccaccttccccgccgacttcatcgccgccaacctccagatccagaccaacgtcgtcgacgccgcgctgcgctgcggctccgaccgcaagctcctcttcctcggatcctcctgcatctacccaaagctcgcgcc

SEQ ID NO: 79566 - DNA, 459 bp, Triticum aestivum
  Clone ID: PAT_TA_79566
accggtccggaattcccgggtcgacccacgcgtccgattgcttcttgcagattttagcttagtgttgcttacgtctctccagctatattcttactctatggtcgacattttgttagtcttgtttgttcttcctcttggaatactggcaccatttccagctgggataaatgctctctttagtcatggcccacgtcgctcagcaggccttgctcgtgtgtatgcattgtggaacattacatctctggttaatgttgttgtggcctttgtatgcggacttgtgcattataagtcatcaacaaaaagacatccaagcatgcagccatggaatttgggcgggtaagcatctttgcccgctctgtgaagaagggttacatgagcattaaatgcaattggtcggccatatcttatactccctccgtttggaaataactgttgtggttttagttcaaataactgatg

SEQ ID NO: 79567 - DNA, 465 bp, Triticum aestivum
  Clone ID: PAT_TA_79567
gggtcgacccacgcgtccgattggggttctcttgtggatgtcgtgggttattgcttcttaaatcttggcacaaagtatcaaccgccgccagagctctcacagtggcttcaacaaggttccaaaccgatatacatcggttttggtagcatgcctcttgatgatgaaaaaaaggtcactgctatcattttggatgcactaagagaaatgggacagagaggaatcattagccgtggttggggagatcttggaagcttttcagaagttccagctgacgtcttcattttggaggattgtcctcatgactggttgtttcctcgctgtacggcagtagtgcatcatggtggagcaggtaccacagctgcaggcctgatagctgggtgtccaaccactgtagtgcctttttttggcgatcagctcttctggggtgagatagatcatgcgcgaggtgtgggacctgcacctatc

SEQ ID NO: 79568 - DNA, 456 bp, Triticum aestivum
  Clone ID: PAT_TA_79568
tcgacccacgcgtccggctcgccggcgctcaagatgggcgtcgacggacagcagggcggcccgctcgggctcctcatcatgcactaccccgagggagacgacccggccacgcacgccgaggcgggcatcgcggagatcctggcggcggcggagaacgcagtggccatgccattgccgggcggggccgccgcggtggcggtgcccgtcctggaggacgccgttgatgccccacacgaggaggacgccgttgatgccccacacgaggagggcgccgttgatgccccagaggaggagaacgcggtggaggctgatgatggcggccggtgagccggacgagaggctgccccggccaggggatgccgatgctgagtgagagtagcccccatgagttcagtgtagatcgatcgatttccaggtgtgattgattcttggcacgacacaaggaaacattatttg

SEQ ID NO: 79569 - DNA, 500 bp, Triticum aestivum
  Clone ID: PAT_TA_79569
ccgggtcgacccacgcgtccgccccccagcctccccccacgaacccacagcgcgcacccgagatccgcagccgaagcccgtgagagcagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccggaccaggattgaaaccgagctcagcaagatctgtgatggcatccctcaagcttctggactcccaccttgtcccctctgccactg

SEQ ID NO: 79570 - DNA, 671 bp, Triticum aestivum
  Clone ID: PAT_TA_79570
cctgcggtaccggtccggaatttccgggtcgacccacgcgtccgccgctccagaacggaacgaacgaaaaatccccaaccaatctcgtcgccgatcaaccctaggctcgtcgaatcctcctcccccgccgcctcaagatgcagatctttgtgaagacattgactggcaagaccatcacccttgaggtcgagtcgtctgacacaatcgacaatgtcaaggccaagatccaggacaaggagggcatccctccggaccagcagcgtctcattttcgctggcaagcagcttgaggatggcaggacccttgctgactacaacatccagaaggagtccacccttcaccttgtcctccgccttcgtggaggcatgcagatcttcgtcaagacgttgactggcaagaccatcacccttgaggtggagtcgtctgacaccatcgacaacgtcaaggccaagatccaggacaaggagggcattcctccggaccagcagcgcctcatctttgccggcaagcagctggaggatggccgcacccttgctgactacaacatccagaaggagtccaccctgcaccttgtcctccgccttaggggaggcatgcagatcttcgtcaagaccctcaccggcaagagtatcacacttgaggtggaatcctccgacaccattgacaacgtc

SEQ ID NO: 79571 - DNA, 229 bp, Triticum aestivum
  Clone ID: PAT_TA_79571
ccacgcgtccgcaccggttcaccagccgcgtctgtcaaccgaaagcagcacagctccccacgggcggactacatctactccccaccgcctgcttctcctccgaaaccacgcgcgtacgtacgtaccagctgtgccgatcgaacaatgcaccgccagatggccgtcgcggcgtgggcgctgctgctgctgctgtcggaggcggcgtcgcggagcgcggggcaagcgctgg

SEQ ID NO: 79572 - DNA, 762 bp, Triticum aestivum
  Clone ID: PAT_TA_79572
accggtccggaattcccgggtcgacccacgcgtccgctgccccctcagctgcgacgactgcccgctgctgattctggcgattctgatggctatccccgacgatgagcacaccacggatctcccctcactcgggtgcatcctcccctccggcaagattttcccctctcagcctctaccactcgcccaaaacacacacccgatctagggtttcgtcctccgacatagccttcatcgtcggcgcatctctggcgtcctctagcggctcttctccatcatctgtagcgccacctgacgcgctctcacctcctaatggtccacctcgagctgggcggcggggaggaactcctctcatgggatccacggacgcggtgcaccctgcagccattggtccgagacgagggctggcaccacggcttgtcttggtcgacgacggttgcggtgaatatcgatgctgctcctcatccgcaaactcctaggacgagtgccagtacagcataagcacgccccgcccctgaacaatggccttggcgctagaaaaagaatgtatctatgcgtagtaaatatccagcatgattttgttaaagccttggatgtataataggccaaagcaaggactgtgccggattgagcagtgtaatggaattgtaactccaagctattgtggcatgtcatctgccttcaaaacaaaattatgtgagcatttccttgttccacacactcctcttaatttgcaccgatttgattcaactgtgtgtacagaaa

SEQ ID NO: 79573 - DNA, 258 bp, Triticum aestivum
  Clone ID: PAT_TA_79573
accggtccggaatttccgggtcgacccacgcgtccgagtcaaagtcacagacgtgtcgttgttgttagtatcttcaataaatactttgatagcatgtgtccaatctagtacgccagcttatttgggctttctttctttctgtttcaacaaaaagcgcctcgatcacggctgtgccatattggttccaagatgtgctagctcatggatatttttcttcaatcattgcacatcagatcaaatccaaaaaaaaaaaaaaaa

SEQ ID NO: 79574 - DNA, 339 bp, Triticum aestivum
  Clone ID: PAT_TA_79574
ccggtccggaatcccgggtcgacccacgcgtccggtgcattggcatcgtttcttgtgaaggcaagcaaagaggattcagctgtgtctgttgagagctcctttgttgtacaagtgataaatgcatgcatttctcttgggttattagagcaagcacatgaccttcttgacgagatgagattttctggagttagagttggttcttccatttattcgtcactcctaaaagcttactgcaaagaggagaatcatgaagatgatataactgcacttttgaaggatgctcaacaggcaggaatccagcttgattcaagctgctacgaagatttgatacaatccagg

SEQ ID NO: 79575 - DNA, 695 bp, Triticum aestivum
  Clone ID: PAT_TA_79575
accggtccggaatttccgggtcgacccacgcgtccgccatggtcagggtcacacggactgcacatctggtaggatatgaatgatttgacaagctcctacagaggatcatgaacgattttattcacagtcgttggcttctacttgagcagaggtttgagcttgattggacaccattggaccaaacaccatgagaactgatgctcctagaatctgaagtcaaatctggccaagtactgtcctatggcagtaactgtttctacttggagaatcatgagacagccctactggtgctggttgtaccttgttagcaacgaaggaatacagttctcacatgaagaaagggagaggagataggaacacagcttgaagaaaagcagttacggaattttcgttctcaaatctctgcttgtctggttgcaaaggatgttgtctgccacaaacttattatgaactccttaatacgtatgagaagcaactgatatgtggaccccagtgatagatggattcaggcagattatacatctgttgagacttcctttgctgatttcgagccacaaactctcatgagagatatgtgtttgcctgcctgcgggatattgtgcagtctgtggcatcagaagaacttgcgcgtatggtgtctcatgacctgatccatcttccccatatattttctgtatacatcattaatgatcctt

SEQ ID NO: 79576 - DNA, 222 bp, Triticum aestivum
  Clone ID: PAT_TA_79576
taccggtccggaatttccgggtcgacccacgcgtccgtgcagacacacgcacgcagagttgtatgttgttatctcattcgatgtggtcttccatctcccccatcttttcatgtatctgctgaaagatggcaagattgcggggttttacaatgtctatgtttatataaacaccacttgtttatgtttatataaaccttttctcacgaaaaaaaaaaaaaaaaa

SEQ ID NO: 79577 - DNA, 586 bp, Triticum aestivum
  Clone ID: PAT_TA_79577
ggtcgacccacgcgtccggccctcttgctagctgcctaaggtagaacaccatgagcgacaccaccacccacacatgctacattgattcgctagacagccttcaggaagccgagcggttcttcaacaagaaccacaaaaagtatggggaggttgtgtttagcatcaccggctgcgaccaactagttgcagcgcctatgctcttggccgctgtcaatagagccaagaagaaggccaattccgataagctgtccatcgagggtctccctcttctccaagagttgaaggagagggccgaggagctggagcggaagctgcgggtcttggaagccatagctgacaccgaacacaacgatgaagacaatcatttcataggtgaccctgatacccacactacttcttaccaccacaccaccaatatgcagagcctcttgagttctgtccaaacgatggacatcaacgcgttccacgagctcgacaaggatgttgatggaaacattagaagatttgagcaccaccgtgctatgtttgaggacactaggatggaagcaaaagaaaagtggatccccagtgttgagaatgagttgta

SEQ ID NO: 79578 - DNA, 587 bp, Triticum aestivum
  Clone ID: PAT_TA_79578
accggtccggaatttccgggtcgacccacgcgtccgcgcgccttcaggggcacagggatagagcgctcgctcccgatcccctccttatcccctcgctctctctctctctcaccatctccctcgattcctccccgatgcccatctctcttcctgctcgatctctacctccttcgttcccgcacgcgctcgcagcggcaggatcccgttcccctcgcccttcctcccctcgtctccctctcctctcgtccgactcgagccaggggaggagccccaacgccctatcccctccaagccgccagagacgaccgagcctcccccggcgcgcccctgcatcgagaagccatagctgcgtcgccggatcccgtccgatgctgccatggatcccgcagaaccaggccgcggccccgcaccatctcgtggacagcgcccgcgccaccgcttctccccctcgcccggagctccaagttcaccggccaccgctgccgctaccgacctctgcagcaccaagtccttccagccgcgaggcagtgccccctcgcgcgcccatggtcctccattcttcctcgtgagcggcaacaggagcgtcc

SEQ ID NO: 79579 - DNA, 812 bp, Triticum aestivum
  Clone ID: PAT_TA_79579
accggtccggaatttccgggtcgacccacgcgtccgactcaatattaagtattgactaaaagtatatgagttggggaaaaaattccgctgctgtgttttttttaaaccgacctaacttctgtaagactttagcatgaacactttgatttaaaattcttgattgatttacgcaacaacgtatttatagatatgaaacacttgacatcattaggaacccaattgtcttgcatgtggatcattggattagcttatctgatcttgggccttaatgtttcttttgaatgaactacttatgatttctagtatatataatgacatttgtccactccagtcttcctcccttcttataaataatatcaagtatgtgtgtggaatccatgtaaacagaaaaagtgaaagttgaagcaacagaaaacttgattttatatcacctcaactgaggttggtgggtcacggacattgatgagtcattacattattgatcatcaatatttagtttttgggtttaaaaacgtattatcatcattttggtgttgtcaacgaacagttccaattgtttattaagatacatagtgctaatctaacttttaaaattgtgctattatacattgagtcaggggataactggtacagtactttggaagctaaatactactccctgcgatccaaaataagtgttgcagttttgaactgaggttggttcaaccttagtgcaaaactgcgacacttagtatgggtcggaggttgtattaagggtggtgtgtcggaacacagatgaatcatagcaaaccagacatgttgttataaaatga

SEQ ID NO: 79580 - DNA, 634 bp, Triticum aestivum
  Clone ID: PAT_TA_79580
gacccacgcgtccgctcctcttgcaaacccctccaatctaaaccctcgccaccgcaatggcgatggccgccgccgggcggtgcctcctcctctcccgcccctcccctctccgcctccgcgtgctccgcgccgccctctccaccgcagtccccccttcctcccccgccctcgccgcccccgcgccccctccccgccacgagctcctcctcgagcgcctccgcctccgccacctcaaggactcgtcgtcccccggccccccgaagccgctgagggagagggccaggagcggggagaggggctcaccgcagcagcagcagaggagtgttgaggtggagagcttcgaggagctcgggctagaggaggaggtcctggccgcgatgcgggaggctggcatcacgaagccgaccgagatccagtgcgtcggcgtgcccgccgtgctctccggcaccagtgttgtgcttggctcgcacaccggctccgggaagacgctcgcctacttgctccctctcgtccagctactgcgtcatgatgaagtgacgctgggtatgtcaatgaagccaaggcggccaagagctgtagttttatgcccaacaagggagctgactgaacaggtcttccgtgttgcaaagtctat

SEQ ID NO: 79581 - DNA, 648 bp, Triticum aestivum
  Clone ID: PAT_TA_79581
ccggtccggaattccgggtcgacccacgcgtccgggggagtgtcgtgccgcccgagggagacgccgactctccctacagctccaaggcgacgacgacggaggaggaggggagtgctggaggtggcggggaggccaattcggcgtcctctgcggctgcgacgccgcggaggccgtcgccggcggcagctgctggcccctcaccccgcgacaccagatggggtgacaccagctcctacggtgctaaaaagaagaatagagttttttgtcagcttccaaatggtgattgggccttatgcaccgtgattactacctctggtgacgagtctgtactaaaggttcctgaaggaaaagttctaagattgaaaacggagagccttcaacctgcaaatcctgaaattcttgatggagtggatgatcttatgcagctgagttatctaagtgaaccatccgtgctgtacaacttgcagtacagatattcacaagacatgatttatactaaagcaggtccagttttggtggcagtcaacccttttaagaaggttgcactgtatggtaatgagtatattaaagcatatagaaacaaaacaatggacagtccacatgtgtatgcaatagcagattcagcgcttcgtgaaatgaaaagagatg

SEQ ID NO: 79582 - DNA, 416 bp, Triticum aestivum
  Clone ID: PAT_TA_79582
gggtcgacccacgcgtccgggtgattcctggtcctgcaaattggaaattaaatggcatggagcaaagtcactcatgctctacgtttcacttggctattctctagactcctgtgtagtgatgcatctccactggagtctagagaatagccaagggaagaggcatgactacgcagacttaacgggcacagaagcttgcaagatgaaggggagatgcccatgataggtgggcaccaggtgttgggaccatttaggcgaggaacccgggtgctatctaggatcagatcctcaagcggcgatgataaaaaagattcacttgctatgaacgagtccaatatggttattgtgagtgctagaaattgcaccgaggtccctttgcggttgcactcgatagccattgaatctgatggtgatgggaa

SEQ ID NO: 79583 - DNA, 605 bp, Triticum aestivum
  Clone ID: PAT_TA_79583
caagaggaacaagggcttcgttgtctgcgacctcgtcaccagccagcggtggaaattcggcgaccccgagtgctacaacgtcatgtggtggccgcacggcgatcacatggacaagcgcatacgctgtagtgccacggtgctctgcgccaaggcccaatgtgaccagctcgactgccatggcgatggcggccctttccgcgtcgccttggtgggcaccgactatagaaacttgagatcccacgccaccgtctactcatcagagactcgtgagtggagggacaccatctctgttcacaacctggatttcgtcaatggcagggggaacagtgctgttgtgggaaataaggtctatgtccaatgtgtagagagtgacaaagtcgtggagtacaacacgcatgagcaaaaactatctctgatcaccctgccattcgaggaccaggaggggatcgacgagagcattgacctcatgggggtggacgacggcagtctgctgtttgcatccgtgctgaaggctaaactctgcctatggactatggaggctggtcccggcggagctgcggggtgggcgcggcgctgggccatcgagctcaaacatcgctccctgc

SEQ ID NO: 79584 - DNA, 550 bp, Triticum aestivum
  Clone ID: PAT_TA_79584
gcgtccggaaactttcaggtgtacacagcttgcggccgtggctcacgctccacgctgcggatccttagacctggccttgccatcagcgagatggcccgatcaatgctgcctgctgagcccattgctgtttggactgtcaagaagaacatcaacgacatgtttgacgcctacattgttgtgtcctttgctaatgtcacacttgtgctctcaattggagagaccattgaagaagtcagcgacagccagttcctggacaccactcactcactggcagtttcgctccttggtgaggactctctcatgcaggtccacccgaacggtatcaggcatatcagggaggatggccgtgtcaatgagtggaggacgcctgggaagaaaactatcaccaaggttggatcaaaccggctccaggtggtaattgccctcagtggtggagagctcatctattttgagatggatatgacaggtcagctcatggaggtggagaagcaggacatgtctggtgatgtcgcgtgcctggacattgctccggatcctgaagggaggcaaa

SEQ ID NO: 79585 - DNA, 740 bp, Triticum aestivum
  Clone ID: PAT_TA_79585
taccggtccggaattccgggtcgaccacgcgtccgcccacttttccgggactgcaggacttgctctggaatccgagctgctgggtttcatgaatgagttggagggccagtgggggagtcggaggcgccggaggaagtttgtggaagcagccatattcggtgaccacctgccccgtgggtggaagctaatccttgggattaaacggaaggagcgtgctgcctggatcaattgccgccgctatgttagccccaggggacatcaatttgctacttgcagagaagtttcttcctatttcatgtcacttcttggatatgtggaggcaaagccaaccactgttcagaacaacgatgtggaagttcgtgacatgagtgctgtgaatactgcaggtcttcaccagcaaaatgattcaactggggacatgcaaagtgcagtgtcagccacttctgttacattgcccattcacaatggtgattctcagggacagagacaaaaaccttataaagatgaagctccgatagaagcagtcaggaaagagtgcaaaaaatgcaatttgacttttgaggaccagggtgcctatgtgcagcatcagttgtcctttcatcaaaggaaagctaaaaggcgtaaggttgataaatctgttggcctgggagtcggtaaagatggaaagcttgagactcaggaaagtcagaggacctctgaagataaacctggctatttttggcatggtgtagctgatgtta

SEQ ID NO: 79586 - DNA, 172 bp, Triticum aestivum
  Clone ID: PAT_TA_79586
gagcaggggggaggcggtgatggcggtgggcgcgaagctgcacctctcgccggccgcccggcgcccgacgctgccccagctcctggccgtcgcgctgctctgctccgcgtcctacctcgccggcgtctggcaccacgggggcttcaccgctgcccccgcggccgaaaagaaa

SEQ ID NO: 79587 - DNA, 728 bp, Triticum aestivum
  Clone ID: PAT_TA_79587
accggtccggaatcccgggtcgacccacgcgtccgggaggttgcagctaactttttctataaatgctgggccatctgcctcacaaagctcaagaaataacagcatattactagctcaaatgaagtaagctgatcagagtttggatctgaagagagtatgattcatggacttgttaggaacatgaagtattgacaatgtttggcaagttccttagctctacatgattgttgtaactaatcccccttgagctgttgacactccaatgctaatgcctcttctcagaaacaaatccaggaaggaaaaactacgaactacgtactagtctcatctctggtggggaacaacaaccactacttactggactgagataacttgtacaggtcaagaataatattttcgacagactcctgagcttcaccgggacaatggtcatggaaggatcttgtcattttgatggcctctccagcccgatctgctattgaataacggcccagaacactacaaaaacacagcttggaccataggggaggggaggagcgccagtacactgtacacaaggatgcctccaaggaagtaaacagcacccacatgcatcgccatcacacttgggaattatcaggcatatgaaggccacaacaaatgaagagcacattgctaaggtgtcagagaccaagaatgcttggaatgcaatctgtttagacatgatgggaagtcctgcgcttccagca

SEQ ID NO: 79588 - DNA, 668 bp, Triticum aestivum
  Clone ID: PAT_TA_79588
gcgtccgaaaggaatcccgggtccgttgagtccgttcccatctgcacatcgtccccgggcttgtcgccgtcgacgactccgccattgccgccggccgagcgagcgagcgagcggacgggcgggcgaggcggccatggagggcgacgaggcggcgaggcgcgggagggaggcgctgagcgggggccacctctgccacgtgtgcgggcaccagtaccccaaccccaaccccagcgccaagctccgccgctcccaccgcaggaattcctgccgcaaggtcacgccggccgccgaggaggaggacgccgggccgcgcaatgcgggcgagggccgcctcgtgcttggtgctgcgggaggaccaggagacggggaggagcccggcaatggcgcggcgagcggaggctctgcgtcgcccggatctgcgaacggaggcgtcgaatcggcggaggacaaggagaacgcagaacatgcttctactaatgctgctagacctcaagccatcaccagtgactacattgaaaccggcctgattcccaataattcttctgaaactgcagatgaaggcaatggaactgattcagaaaggcctagcaccaatggaattccacataaagcgtctgaaagtttcactggaattggaccgcttgcagctgcacacccaactgaacgag

SEQ ID NO: 79589 - DNA, 642 bp, Triticum aestivum
  Clone ID: PAT_TA_79589
gtcgacccacgcgtccgcccctgttcatcctgaatgcagcatatgattcatggcaggtacggaacattttggtgccgggaggttctgatcctcgttggcgaagctgcaagcacgatataaaacagtgctcggcgaagcaacttaagatcttgcagggattcagggaccatttcctggaagcaatcgaggcacaaggggactcacccaccagagggctgttcataaactcgtgcttcgcgcactgccagtccgagatacaggagatctggttcgcgcccggctccccggtgctcggagacaaaagaatagcaagcgcggttggagactggttctacggccgcagttggtttcagaagacggactgcccttacccttgtgactccacctgccatgtcttcaagaactcctcccacacgtagcaagtgcagcggcctcgcttcgtactactgttcccattgatcacattattgttgctattacatttgattggtgcaccgccattggtgctccgtgctcgcaacagggcacggcctgataaccggccattgattttgtttacaggaatagtgttgctaaatgtcgactgagacttggttggatctatattccgtgagatcttgcatgaaaaaaaaaaaaaaaaaa

SEQ ID NO: 79590 - DNA, 764 bp, Triticum aestivum
  Clone ID: PAT_TA_79590
accggtccggaatttccgggtcgacccacgcgtccggtgggccagattgttgcagagtttatgtttctcaataagcataatgatcgcgttctcaacccagatagaacaactttcatctcaaggcttgcacaactacttgcatctgttccagataaagcaagaatgggagcctcatctgcgcttacagcgtcgtcattcttcaagagtgttgtcagccaacttcttgttcgagcggaagaagcagctatcgagtcgtctgctaacaaagagtttaacgaacaggatgcactaagttctgtgttgctctttgtgggtgaagtgttatcccgtgttagccgtcgtggatctactggcattttagttgctgaattgatccctatgatccgcaatcacttacaaagatgtgtagcaccagactgtaagacgataattcctgacatgatcaagcatgttcctcagtctcggttttggttcaatgtggttgaagcattgagagatcagcattctattgaaagattgactgaagagatgttgcgccaacttgcatcacaccatttaaatgatgaagaagcgtactggattttgtggactctgtttaatcagagtatcatgcatattgctgttatgagggcaatgtttattgacaaatttttgctttggaaaacatttccattatgctgcctgagatggattcttcattatgctgtctttgaattcccaccaaattcagtcgcagaagctcaaatgcgaaagccatcaaactt

SEQ ID NO: 79591 - DNA, 588 bp, Triticum aestivum
  Clone ID: PAT_TA_79591
accggtccggaattttcgggtcgacccacgcgtccgcgtagaccccattaaataagttaaatttatttatttgtttagataaatagtctatgacatgtgggccacacctgcccttttgactagtcaaattgacttggtcaattcggatttaacatataaacgctgctagactacccgccattccagcgccatcgatgtttcaaattcatcctgtacgctcgatttgcactgctgtccaatgacatcgtactttccatcgccgtggtaaacatctgggcgctcgttcttctgtacgctgcgtaatcaagctagagcgactgacacttgggccagccttgcgcgcgggccagcctagcagcgacacggtgtatgcttctctttgtccgggcgggtgaaagcaggggcaatcgatcgtgggttgccaggggctttcgcgggttggatggtcgttttttaccgtcctcgtttgcacccagcggcggcgcctccgcttcagccgtggcgggcccatctgtctgtgtcgcgggtgcgcggctcagagacagcagcgagcgagcgggcgacctgggctagcaggcacgacagaaa

SEQ ID NO: 79592 - DNA, 456 bp, Triticum aestivum
  Clone ID: PAT_TA_79592
ccggtccggaatttccgggtcgacccacgcgtccgcccacgcgtccgtttagtacaaacaataagcattaagctgaaatcaacaatgagccaaaacatgcatcattgcattgtttacgacactgatgctacagaccaaaagtacaacaaaacttccagcccaggtgatatgattggcacccaggactgaatcaaatggcgtatatgaaagcgactaacttagtcgacctcctcgatcttggggccagcaccgccgctggcagccggcgcgtcctcgtccatgcctcccggcatgtcagcaccagcgccctggtacatcttggcgatgatggggttgcagaggccctccagctccttcatctgactagttctagatcgcgagcggccgctctagaggatccaagcttacgtacgcgtgcatgcgacgtcatagctcttctatagtgtcacctaaatt

SEQ ID NO: 79593 - DNA, 696 bp, Triticum aestivum
  Clone ID: PAT_TA_79593
taccggtccggaatttccgggtcgacccacgcgtccgcaggaattcaaagatgggtacaccaaggttcttatatcaactgatgttcttgctcgtgggtttgaccaagcacaggttaacctggtcatcaactacgacatgccaatcaagtataatacgagagatgaacctgattatgaggtgtacctgcacagaattggcagagctgggcgctttggccgaaaaggagctgtgttcaacctgctatgtggtcaaactgatgaagctgtgatgacaaagatcgaggactacttccagcacaaagtgcctgaggtccccaactggaaaagcgaggacaattttgagactgctcttaaggatgcgggtttactcgagtaaacgtttcctggcagaaataggtggcggcaaatgcgcgcttatttgattatcttgtcaccagcacttgggttctttcctttgcaccagatgcttgtgtctggagtggattatgctgagctgatgcgatgaattctatgagagagtgtgtccatttttatgctcgttcgtttgaggttttcaagtcttcttcacacacgcccatgtaatttcctttgaaaattcatttgtatgttacttgtgctacgagatgcgtaccgcatgtgtacagattgatcgcaattggcagttacaagattcactcccaaaaaaaaaaaaaaaaa

SEQ ID NO: 79594 - DNA, 608 bp, Triticum aestivum
  Clone ID: PAT_TA_79594
ccggtccggaatttccgggtcgacccacgcgtccgcccacgcgtccgatttagatttgctcctctgtctatccatctttgagtctctgaaatattggaggaacccaaacatatatatcttctaacgcgtaatctgccctcctgccatcttgctatttagttgtacgggtacatttgccccgccaattacattatgcagcgggagcctatgtccgtgccatcggcgatgagtctctcgcaccctaatctgaagctgtacatgttgttcactgtcattatcacccgtgctttcattgtcaacgtgttcactggtcatgatcttccgtaccttggccgtcgtcgaggagcagaaagtcacggcgcaaaaaacgcttttgaaaggttttcatacgacggtgtatatgggttaatgaagaaatataccggtcctccttgtttctttttcagaattgtagtgccataaatttctccattaatctcgtatagtacttatagtatattttagaaaagcacatgtattgttgacaggtggtcccagatcccacgggtatgaagaaaaaaactttctatccaattactcggggaaaaaaacatcccgattggcctcta

SEQ ID NO: 79595 - DNA, 634 bp, Triticum aestivum
  Clone ID: PAT_TA_79595
accggtccggaatttccgggtcgacccacgcgtccgcaatttgaatcatggacagcaacatggtgaaggaagcagtataacaagctttcaggctttgactgaccttttacgctctctactgtactgcaatgatgatggaagaatcatagttgcacggcacaagcctggtggacaacctgaagatgcatatattaaattcgtgatgctttgtgcagagaaaacattttctgaggttacagatgacgcacatgttgttattatggctggtggaaccctccagcctattgaagaaacaaggttgcgcctgtttccaggcttattgcctagtgatataaaattcttctcatgcaaccatattgttccccctgagagtattcttcctatagctgttacatgtgggccctcaggcaagaaatttgatttcagccacagttcaaggagctctcttaacatgatcgaagagcttggacgttttctttgcaatatagtgacaatagtaccagaaggaatagtaatgtttttctcttcctacgaatatgaaaaacaagtttatgatgcatggatggcttcaggcacaatttctaagatttctaagaagaaacacgtgttcacagagcccagaagcagtgttgat

SEQ ID NO: 79596 - DNA, 611 bp, Triticum aestivum
  Clone ID: PAT_TA_79596
gtcgacccacgcgtccgacgccaagtactaggtcaacgaggaccgtcaagtttgtcttccgccgtctccgaaatcgccaagtacatgacgatgcgagaacaactaccgtcgaccctcgaagactccatggacgtcaagtatcttgccgtgaccctaaacatctacggaaacttgtgcgactaagaacgtgaacgactaccgtcgccgaggaccgatagtaccactacttccactaccgtcgtcacgagaacgtctacttcctctacattgcaccggacccgaaccgtcccgtttgcacgcttcgaaggtataaccgccgaaacgacgctcgtggaccgaatacatgtggtatgtatgagatgaatcccgcgtttgcgccatgtccgaaatattcccttgcatgttcctcgtcgttgccatgccgtccaccagtgggaactcgatattcgggagcaccccacaatcttttgcatgctccacacacttctcttttgcatcggtatctcaatcgagctacgttgacgtggcaaccattcattccgccatggggacaaatgcctcgtatcatattataccaacattttgataaaacttgcataaaacttgcatat

SEQ ID NO: 79597 - DNA, 442 bp, Triticum aestivum
  Clone ID: PAT_TA_79597
accggtccggaattttcgggtcgacccacgcgtccgtgtccaattgcttcatgagagagaaaaccggatgaatttttctgttgtttcacacagactggaaagtgaacaatctagtgctgacttggaaagaacaacgaattcaagttcggcgggcacatttttgcatggtgaggcgataaaagtttctgatgtagatgctgctggtcctccattgagcttaactgaacttgctgagactcatcgtggttgcagaaatatttcagtaaaagatactatgactatgagtacgtccccttgtgcattgccagatcatacatttcgagattcatttgggcagcaccagagttggttttccaccagcggcaagttttcttccgggccatctcatgaatctaatgtgtcacccagtaaggagttaaattttcgatctcagttgaacgtg

SEQ ID NO: 79598 - DNA, 679 bp, Triticum aestivum
  Clone ID: PAT_TA_79598
ccggtccggaatttccgggtcgacccacgcgtccgacagggcagtcctcccgtgaacccaccacacccgcaccgcaccgtagtccaaacccaaaagccacacgcagaatgctccgccgcctctccagcgccgccgcgggcgggctccgccgctccctctcctcgtccccggccgcctcgcggcccccgtgggccctcatccagctcaccaacgtcgacaagtcgggggcgccggcgccgggcgcgaccctgcacctcgacgcgcccccgttcgtcaccggcctcaccgtccccgcccacttcatccacccgcgccccctccccgaccccgccaccggcgtgttcggctccgtcccgggccacgtcgccgccgtcagcagcgacggcctcctcctcgtgcgcttctgggagtcccgcttccagttcgacgtccccgccaccggcgagtcgatgctctgcgcgatccgcgacatgtccttcttcaccggcatggacatcaacccggaggtcacgcgcttcgtctgcaacccgctcagcggcgagctctaccgcctcccggacctcgacggcaccaagaggaccaccatgtaccagcacctcgggctcctcactcagtcccaaggcgggcacggaccgcctgacaggtatgccgtagccgagatgtttaccatcggcggcag

SEQ ID NO: 79599 - DNA, 472 bp, Triticum aestivum
  Clone ID: PAT_TA_79599
ccggtccggattcccgggtcgacccacgcgtccggaaaaagagcaaacgcgatgcgtcgctgggccgtatccccctcccttcctccggcggcgttcgcgtccgcgactctcggactcggcgtcgggcctcctcaagcccgaaccctggcttccgctgccaccccccctcctctcggccactgctctccgccatgcccccgccgcccccgccgccgccgcagcctgtgctcctcctccgcggcagcgtcggctgctacgacggcactggcggtagaggaggcgcggcgcgggcggaagcagctgggcatggacccgccgctctacgactacctcctctccaacgtccgcgagcaccccgtgcttcgggatctgcgggaagagacggcatccatgagggggagccagatgcatgtttctccggcacaggctcagcttctggcaatgcttgtgcaaattcttggggcagaacgat

SEQ ID NO: 79600 - DNA, 224 bp, Triticum aestivum
  Clone ID: PAT_TA_79600
accggtccggaattcccgggtcgacccacgcgtccgcgtctttctagctctgcgaataattctgatagtgagaacactaataaaatgttgccaatatcttctgtcaacttgtcagaagatctaaatccttttgttgaccacaaaagtgttgttgatatggattttgatatgacggactctggtgaggttgactctatcacagctagttgtcagcaccccataca

SEQ ID NO: 79601 - DNA, 549 bp, Triticum aestivum
  Clone ID: PAT_TA_79601
gcccgtcccgcgcatccaccacgcccccgtcctccgcgttgccacgcaggaagactccgccgcctacgccctcgccatcatgaagcatccggatccgattggggaggggctggccatggaggcgttcgcggaagccgccgggccggagtgcatcgtgcccggacagcaagcgcctctaaggctcatgggactcaaggtttggccccttgatatagatatgaagttcctagagccatttggacgggaattacaatcaatgaaaaaattcatggacaaatcgtgcagtgttatggactcatctatggcaaacaagtaggcacatggcacatcagtccaatacagctgttgttgtatccacctgcttgctgaagttacaagacccgaaaaataggaatttggaagaagagccatggagaaagccacattcttttgcatatcttgcccaccgtcacccgacggaacaagatatggcatcgggagtgcagtaacaattagccagtaatcctgtgtggagcctgggcgcaacctctgccagtataagtgctctac

SEQ ID NO: 79602 - DNA, 610 bp, Triticum aestivum
  Clone ID: PAT_TA_79602
taaataagtggaatgaagccctgcagttgtgttacagcatatgtgatgagggtgtgaactggcagagcaacaactcttttgatggagggtagagctttgttttcttacatggttactccaaatgaaggcattgtcccctaattttgatgggggtgattcggttcaaatcaaattaaacttatctgaatgatttcctgttccaaacatccctctagggagtcattcatttctgacatcttactggaagattacagtatgatgtggtgacccaggcgataaggattagaatgtgcttttgtgcaactcattgcttgcttgggaaaacagcactatgggatgattaaaactgtatatgttcatatatgacctttctgggtgctgaaggataaagtgaagaccttcaaaaagctatatgcaatcaagctgcactaatgcctagctggtttaccttcagatggacaaaggatcatctcaatgtctttcaagaataacctgtgtatataagttactgatggctagacacaagggtgaaatatgcggtgaaagaaaacttctgaagttcataattctctattcaccagttcagtgattcatccttctagctccttcc

SEQ ID NO: 79603 - DNA, 503 bp, Triticum aestivum
  Clone ID: PAT_TA_79603
tcacgcaccaccagagccgagaggaaaggcgactatagcaggcatggcgacgcgggcggacgtggagaagggcggcgtggtgaggaaggagcccggcaaggtgccgtcgccgctgtacccgcagcacgagggggagagggagtgggtgccatggatcgtccccgtcttcttcgtcggcaacatcacagtcttcgtcatcaccatgtacgtcaacaactgccccacgcacaccaccacgccgcgcgacgccaagtgcgtcgcacgattcctcggccgcttctccttccagccgctgcgacagaacccgctcctcggaccatcctccgccacgctcaccaagatgggggcccttgtttgggagaaggtggtgcaccaccaccagggctggcgcctcctctccagcatgtggctccacgccggcgtcctccacctggtcgccaacatgctctgcctcctcttcgtcggcatgcgcctcgaacagcagttcggatacgtgaggatcg

SEQ ID NO: 79604 - DNA, 142 bp, Triticum aestivum
  Clone ID: PAT_TA_79604
ttctagctacgtgacagccagcactacacactgtcccttgtcgacacaaagagagtttgtttgtaacaggacagaaggcaagaagaaagaaatggcgtcgacggtggcaagcctctcaattccggcgaccaccaccttcgcg

SEQ ID NO: 79605 - DNA, 375 bp, Triticum aestivum
  Clone ID: PAT_TA_79605
attccgtgattgagtatccatcacctgcgtccatctcactcttggcataccatcagtttcctgccagaaggcatcctgtaatttttctgttgaaataataatgtcaattggtgtcccccactcatcgtcctatggatgctacaaccaaacaccatcctaacttctgttacaggcagatcctatgaaaccttacagaatctcgggcactgcatatcatgcttctgtttgccttgtgagaagtatatttaggctgctaggttctgagccctgatgtgtacaaacatacccgaattttgagaagttgaaatgtctcggcgcatcctgaaattctgccttgtgtcgaggcggagaatctttactgtccaaaaaaaaaaa

SEQ ID NO: 79606 - DNA, 626 bp, Triticum aestivum
  Clone ID: PAT_TA_79606
gcattggctacgctatgcccttcattctctggcgctgatatgctgctgcctaccctgcataatctccttaatgggtttccgggaagatctgaacgaaaacagaggtgctacttcagatgcaatcaatgccctgggcacatacaagttcaaaacgaagaagcctcgtaacacagagggaaatgaaggcggcggtggagtctttgctcctggaacagacaaggaacgagctgtttctgctgaagatgctgtttgctgtatctgcttggcgaggtatgtagataacgatgatctccggttgctcccctgcgggcacttcttccataaggactgtgtcgacaaatggctcaagataaatgcactatgcccactctgcaaagctgagatcgacatcgtcccgacaactgctcctccagccatcggatttgggcgccgccacagtgacaacagggtaggaaacgacattgaatcacaacggtaactttatcacggcttccatgatgtatagtgagagagcaacttgcctccgatgtgtggtttccagaagagcaacatgtaaattatgcagtgatagagattatgtgatgaatcaacgagtccttacatgatccagcgagtaatcgcctgac

SEQ ID NO: 79607 - DNA, 622 bp, Triticum aestivum
  Clone ID: PAT_TA_79607
ttttgtttgtagctatggttgtggttcatccactcgtgctactatttgaccggtaccgtaggagagtgcagcactacatcgcgaagatttgggctacgttgacaatttccatgttctacaagcttgagggaggtgcttcaaatttataagcaagaccagtatctttatgttccctattatagggtgggctatgtatctcttgggtgtgattcctctgcggcgtatggacagcaggagccagctggattgtctcaaacggtgcgtggacttggtgggaaaaggagcttctgtatttttctttccagagggtactcgaagtagagatggcaagttaggtgtatttaagcgtggtgcattcagtgtcgccgcaaagaccggagctcctgtgatacctattactcttatcggaactgggaaattgatgccttctggaatggaaggaattctcaattcaggttcagtaaaggtgattattcaccgacctattcaaggaaatgatgcagaaacattatgttccaaagcaaggaatgtgatagcagatactcttgttctacatggctatggagtgcattaaattaagtgggtgctttggtctattttttttcctgaacgagtgctttgg

SEQ ID NO: 79608 - DNA, 534 bp, Triticum aestivum
  Clone ID: PAT_TA_79608
cacagcatcaccagaggaccgctgctccgtccagctcggcgccgcttgaggcgacgtccaaccagaggaaatggatgcggagaatgcggtcacagaagtcacagggagaaggtggtgatcactaggcttgtgagcttgtggctgtgttcgtcaaatcgtcagtgccttgttcttaccagctggggattatgcttcgcatcagacgctcgagatctgcacaacactgtgttggacatggatgctctttgctctctagctatcgaacgaaaattcatcacgttgcttcaaatggtctttttgcagagtaatgcggaactttcttccttttgagggctgtgctttctgcatgtatgtagaggaacctgcttgactgtaatagcactttcggtctttcagacgcccagttttcttgaattgcgatggtgtgatcgggatgcgtagataaattcagtcttgggacactttcataacttaccaatcgagcgttcatctattgttggttaacaaattcagacaaaaaaaaaaaaaaaaaaa

SEQ ID NO: 79609 - DNA, 764 bp, Triticum aestivum
  Clone ID: PAT_TA_79609
cgaggccggaatcctgatgatcatcataatgtccttctccttcacgctggcaacacattccttcaggcggagtgtggtgaagctgccatcgccgctgcaccaccttgccggtttcaatgccttctggtacgcccaccacctgctggtcattgcgtatatcctgctggtggtgcattcctacttcatattcctcaccagggagtggtacaagaagacgacatggatgtacctgattgtccctgtcctcttctatgcctgtgaaagaatcatcaggaaatttcgtgagaacaactaccatgcggaaattgtgagggctgcaatttatcctggaaatgtgctctctattcacatgaagaagccacagggtttcaagtacaagagtgggatgtatctgtttgtaaagtgcccagaagtctcacctttcgaatggcaccccttctctataacttcggcaccaggcgatgactacttgagtgtgcatatccgcacgctgggtgactggacatccgaacttcggatgcttttcgggaaggcttgtgaggcacaagtaacttccaagaaggctacccttacaagacttgaaactacagttgtggcagacgcacgcacagaggacactaggtttccgaaggtctatatagacgggccatacggtgcaccagcacaaaattacaggaaatatgacattcttctgctaattggtcttggaataggagcaactcctttcatcagcatactgaaggatatgttgaacaacctaaaat

SEQ ID NO: 79610 - DNA, 234 bp, Triticum aestivum
  Clone ID: PAT_TA_79610
attttgacccttccacctcctaagcacgggtatcgcacgtcgggggtggggggagcgaccccacatatggtggtcttacttttgttctttttatagttgtaggagatatgaagaacatgcttgacgatgctccgggtagatcgaccgagtgcaatgtaaattcaggcctggtttagttcacccctaaaataaaaaacttttcaagatttcctaaaaaaaaaaaaaaaaaaaaaa

SEQ ID NO: 79611 - DNA, 642 bp, Triticum aestivum
  Clone ID: PAT_TA_79611
atcactgccatcccatttcctacaaaagcatggcattttgtgctaatttgccttaataccttaatctgataatgtgcttcttgcatttgtatgttgcctagctacctgtatgactttccattccttggagatgacagcactatcactgtggatgacaactgtgtcgatccactatacaagcatattttcccacccgaagtggcacctcatctgtccttcatcggattgccttggaaggtcagttttgctgcaaattgctgccccagttgagatgcacctgtaacttaccctgtgaagctctaagatcttaaacattccaaccactgttctttccagattattccctttcccctttttgaactccaaagtaagtgggttgctagagttctatcaggacgggtcaaacttccatctaaagacaagatgatggaagatgtgaaagctttctattcgaaactagaagcacttggatggcctaagagatacacacataacttttcaaaccatcaggtagcctagagatgtctgtcaatacttagttaagctttgttacctgaccacaatcgttttgtattaagatttcactgttgatacatttgaatatatatatatgcatatctttatgtgcaaaaaaaaaaaaaa

SEQ ID NO: 79612 - DNA, 502 bp, Triticum aestivum
  Clone ID: PAT_TA_79612
gctgggcgcgctgtggcggcggatggtgggcccgcgcagggggacgacccggacccggacccggacgcgggggaagaagccggcggggctgctctcgcgcgccgcgcgggtgctctcctgcggccgccgctcctactgattcgattgccatgtcatcgtccgtgctcgcatatatatatatatatatatatatatagcacatccgaatcgtcctcatgtgttcccgtgttcgtcgtagctgtgtggtgtggggtggtagctctgtcgtcgacgatgcatgcactcgtgtgttaattgtgtgtacatattcttctgtatatgcatctatgtttacttgtaataatatttttgtcgcggcatcctgcattcactgtttgcctaaacggcagtatagaccgtttaacacacagcggtacgctgtttttatttaaccattcagtttatcagtccgtttaattaattgtttagtctgtttaatgaattatttagttccaataatgac

SEQ ID NO: 79613 - DNA, 645 bp, Triticum aestivum
  Clone ID: PAT_TA_79613
tcagaaggttccacatgttattttctgcgctcccccgtccagttcagatgattatcctggggatgttagaaaatgcgtgcagattggcagcatcaaattggagtggtgaaggatctttcctgtttacatcaagtacagctctgtatgactgcagtgacaacagcatgtgcaacgaggattgttcgtcagtgccaattggcaggagccctcgtactgatgtacttctaaaagtggaaaatgttgttcttgaggcaggaggctgtgttcttaggctagctggactttataagatagacagaggtgctcatgttttctggttgaggaaaggaacgttagacacaagaccagatcatatcatcaatcagattcattatgaggatgccgcttcccttgcagtagcaatcatgaaaaagagactgcggagtcggatatttttgggctgtgacaacaagcccctttccaggcaagagataatggatgctgttaacaaaagtgggaaatttgacacgaagtttgaaggctttactggtactgacggtccattggggaagagaatggagaattccaaaactcgggctgagatcggttgggaaccgaagtatccaagcttcaccgaattccttgggatcaggaggtaacatcctt

SEQ ID NO: 79614 - DNA, 403 bp, Triticum aestivum
  Clone ID: PAT_TA_79614
gacgacgacgagctcccccggatcgtcgcggcgccccgccgcctcgtccggttctagagactgacggacggatctccagactccagcccaccagggtccgggggcgccagatcggcgtggcgctgccgccgtgcgcgcgcccctgcctatgaattgagcggctccattacctgattattagctctcgattaggactagtacttgtctgttcatctgatttttttttttactttttctctcgccttggttgctcgagtttggtgctgtacttgtaaataccggcggagtgctctgctctgatgatgatgatgatgatgtacgagcactctgcacctcgcagcagggtctgtattgtacaggctttttctttcctttgggaaaaaaatgcgaagagatgagaaga

SEQ ID NO: 79615 - DNA, 551 bp, Triticum aestivum
  Clone ID: PAT_TA_79615
ttcttctttctttcctttgggctctcctctcaaacttgcgaatcctttgtttggagattaatagccattcttcaccttgatctggctctaatagcatgggaacctggtgctgactacttaaccctagcttctcatgttcacacctgcaagacaccaccatggcaaaaaaaatgtctatttgaaagctcaatgttagaatctgaaatgtttcttcgatggaatcttgggtttagatgacaaatttccatttcgtttggaacttctccagcctagttgaaagacatctttcaattacgttggaagttgcctactccacatgtagttgaaaagtgagcattaggagaagacggatagaaattgcttctgatgttcgaattgaagcgctgcttttttcttttatagctgagtaacttaagacaccccatgttatcagcactaccttacccatatttactgctgtcccatgaaattggtcttgtaattcctgagctttatgtttctgttttatgtaataaggagagcactagctccaacaaggccaaaactgatgg

SEQ ID NO: 79616 - DNA, 395 bp, Triticum aestivum
  Clone ID: PAT_TA_79616
gcaagaggagcagcggcggcggtggcggtggcaagggcggagacggcggcaagaagcaccacttcgccaagagctgatgagaatgagagagggagctggtccgtgctcgcctgatctgaccattgttggcgtgttgctgttgctgatgacgtcttcttctcttttttttcttcttcttcttttctactgtacttgtgttggtctaccctcgctgatggactgttttaactgttgtttacgtagcaatcccgtctctccgaccgttggtaggactactcaccactactggtagttttcttggcagggtgtcacaacgccgtgtaattttcttcttggattgtacctgcaattcagccttgcggtttggcaattcacaaaaaaaaaaaaaaaaaaaa

SEQ ID NO: 79617 - DNA, 575 bp, Triticum aestivum
  Clone ID: PAT_TA_79617
gatccacatccttcccgagcgagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaatttccttgtccaggccggcattgtgaagaaggaacacatcaagattcatggtttctgagcgaccgccgggtccatagcaagccctgcatgcaaagcagctatatatctgaggtggagcatatctatctggctgtgtacaagcaggcctactactacgcctgcgcgttctcctatactacacataa

SEQ ID NO: 79618 - DNA, 545 bp, Triticum aestivum
  Clone ID: PAT_TA_79618
atccttcccgagcgagttcttggttgacctcttcctcttcgaccacctcctaggctcttggtgtagcttgccactctcaccaatcaagttttcatgtctgatctcgacgttcagatcccaactgccttcgatccctttgctgaggccaatgctggggactctggtgcggcagcaggatcaaaggactacgttcatgtacgcatccagcagcgtaatggtcgcaagagtctgactactgtccagggattgaagaaggagttcagctacagcaagatcctcaaagatctcaagaaagagttttgctgcaatggtacagtggtccaggacccagaacttggacaggtcattcaactccagggtgatcagaggaagaacgtctctaatttccttgtccaggccggcattgtgaacaaggaacacatcaagattcatggtttctgagcgaccgccgggtccataacaagccctgcatgcaaagcagctatatatctgaggtggagcatatctatctggctgtgtacaaacaggcctactactacgactgc

SEQ ID NO: 79619 - DNA, 615 bp, Triticum aestivum
  Clone ID: PAT_TA_79619
atccaggatttttcaatagtgtgtttccaatgttgtacgaggtttctagccaatctgtcatttcgaagacaaaaaactctgctggtgcagaactagatgaaagtgaaggtgcttctatttctctggataaagtgctcaattgtgcaacatcatgcatcagtgtcgcttttccacaggatattatcaaccaaaagaagaacgttttagaattaatattgaattctctctcacctgaggagagttggcaagttaaactatcatccttcttgtgtatcaaagagttgtgcctgaaatttcatagttctggtgatagtaacacatggcctcaagacacagcttgcttggttcaggagttatttcatttggtatcaccaaaattagtagactccataagattagtaaagattgctcaggttcacattgctgcatcggagtgccttcttgatttgagcaaactgtacagagacttcccattgttggaaagaacagaggccaagttcgaggatgaacttacagagctctgcgagtctgaaaaaagtgagcaagcaaaggcgattctggaggaatgcctagccattcttaaaactcttcctggagtaaccatgacgactgatt

SEQ ID NO: 79620 - DNA, 259 bp, Triticum aestivum
  Clone ID: PAT_TA_79620
accacacaaccaatcgcatcgaccgaccgtctggtctggtgcgggcagggaagaatgggcctcctcgaccagctctgggacgagacggtggccggcccgcggccggactccggcctcggcaggctccgcaagtactcctccttctccccctcctcctcctcctcctcctcggcggccttcccgccggcccccgctcccgccgcggccacgtccgacgcgccggcgccggcggtgacgcacaagatcaccatcggccgcc

SEQ ID NO: 79621 - DNA, 485 bp, Triticum aestivum
  Clone ID: PAT_TA_79621
gcctcctcctcctccgccgccgccgccgccaccgcagcatcagccatggccgaagtggagctcccgcagcaggaggtcaagctcttcagccgctggtccttcgaggacgtccaggtgaacgacatctcgctggcggactacctggcggtgaacccgacgaagcacgcgacgtacctgccgcacacggcggggaggtactcggcgaagaggttccggaaggcgcagtgccccatcgtggagcgcctgaccaactcgctcatgatgcacggccgcaacaacgggaagaagatcatggccgtgcgcatcgtcaagcacgccatggagatcatccacctcctcaccgacgccaaccccattcaggtcatcggcgacgccatcatcaacagtggccctcgtgaggatgcgacccgtattgggtctgcgggtgctgtgaggaggcaggctgtggatatctctcccttgaggagggtcaaccagggaatcta

SEQ ID NO: 79622 - DNA, 530 bp, Triticum aestivum
  Clone ID: PAT_TA_79622
atttatatctgtcacccctctgaatgttcatgggcaagtggagcctgaaatgggagccccagcttcagattggctctctgcagctgtatctctagataaagaaaaggacgctgctccagctgcagctgagcaacaagatgttgcagctgaggaaaaagaagctccttagcagcctaacaaacacgcagacatgtacacactccgtaggtgtcttagttcctgtggcgacagcgatcttctctctcttgtttaccagtttggtttgtttagtattttgccctcaatatttgtttggtgcaatgtctatttttttgttcatcttctctaccgattactggcttccttggccgtgcaaatgatttgatgcagtggccctacattttggatgtaacaatgtaggctacggcaattaccagatgaatactgcccatcccccactattttttttttcagtgtggtttattctaggaaggtgttgtattcagcatgggatatgtgattgattttgtcttgctcccgactgaactatg

SEQ ID NO: 79623 - DNA, 500 bp, Triticum aestivum
  Clone ID: PAT_TA_79623
ggcttcaaagaagaggaaacattcatgaggcttgaaactgcaccatcagcagagcctgaagaggaggcaatccaggaggatggtgaccaggagggtcggaagaagaagaagaagaagaagaagaacaaggaaaccgaggagactcctgctgttgaagctgatggtgagaagaaaaagaaaaagaagtccaaggaggacggggagcctgtggctgccttggaaggtgagaagaagaaaaagaagaagatatctgatgcggatggtgagaatgttgcaatgcaaactgaagcgtctgctaagaaagataagaagaaaaagaagaaaaggcatgctgatgatgagtgagggctgtccggaaaatggtatcacagggttagaaaccatgttgagtttagtttccctttttttcgacctgggttgtattcaagtacttacactttctggattgatggatttaaattttgctgctgcgatctcataaataaattatgatgattgct

SEQ ID NO: 79624 - DNA, 709 bp, Triticum aestivum
  Clone ID: PAT_TA_79624
gcacgaggactagaatttgttggtgatacatgcaagaagctactaagactcagaattgagcggggggatgatgatcccggtcaagaagagcagggaggagtctctcagataggtttgacagccgtagctgttggctgccgtgaactggagtacatagctgcctatgtatctgatatcacaaatggggcgctggaatccattggcacgttctgcaagaatctctatgacttccggcttgttctgcttgacaaacagaacaaaatagcagatctgccacttgacaacggcgtccgtgctctattgaggaattgcacaaaacttcggaggtttgccttctacctgagaccgggagggctttcagatgtaggccttggttacattggactgtacagtggaaacatccaatacatgctgctcggcaacgttggcgaatctgacaatggattgatccaatttgcaatgggatgcaccaacctgcggaagctcgagctgaggagctgctgcttcagcgagcgagctctggcagtggccgtgctccagatgcccttgctgaggtacatatgggtgcaggggtacagagcctctcaaacaggtcaggacctcatgctcatggccaggccatactggaacattgaatttgtgcctcccggtcccgagagcgcctatcgtgtgatggcagatggacagccttgtgttgacacccatgccc

SEQ ID NO: 79625 - DNA, 688 bp, Triticum aestivum
  Clone ID: PAT_TA_79625
tcaaccagctctttactcaaaggaactgctggagcaacgtgctgctggtcctgcgatgatgcatccatctgaggcagttgctaaaggtccaagatgggctgacctgtttgagcctggagtgaagcatgcactgtttgttggcataggaatacagatcctgcaacagtttgctggcatcaatggtgttctctactacactcctcaaattcttgagcaagcaggtgttggtgttcttctgtcgaacattggccttagcgcatcttctgcatcaattcttattagtgccttgacaaccttattgatgcttccaagcattggtattgcaatgaggctcatggatatgtctggaaggaggtttcttctccttgcgacaatccctatcttgatagttgccctagctatcttggtcgtggtcaatattgtggatgtgggaaccatggtgcatgctgcactctccacgattagtgtcatagtctatttctgcttctttgtcatggggtttgggcctattcccaacattctctgtgcagagatctttcccaccaccgtccgcggcatctgcatagccatctgcgccttaaccttctggattggtgacattatcgtgacatacacacttcctgtgatgctgaatgccatcgggctcgctggtgtctttgggatatacgccgtcgtttgcatcctggct

SEQ ID NO: 79626 - DNA, 464 bp, Triticum aestivum
  Clone ID: PAT_TA_79626
agcagggggtgcaggagtccttctaccgcgacatggcggtcatgttcgggaggtggccggagttcgagccgacggacctcgagaagccgccgttcccggtgcacctgttccagggcgacgaggacggcgtcgtgcccgtgcagctgcagcggcacatatgccgcaagctcggctgggtcaactaccacgagctccccggtactggccacttcttgtcagcggtgacaggactcggcgacaggatcgtcagcacgctcctgtcatcgccgccggcgtcggcgtgaactgatccaggactcgcatctagcgagctacgtagtacatgactgatctgttgtagctgcatgtatcgaaccaatgctggtcggtgaagaaaggcaattcctgtgagctcaggctttactgctattgtaccaagaaactgaatagaagaaagcactttttataaaaaaaaaaaaaaaaaa

SEQ ID NO: 79627 - DNA, 359 bp, Triticum aestivum
  Clone ID: PAT_TA_79627
cttgtccgtagcgaggttttagttgttaacgtagtagaactgtctccatttgcttctccgcagtttgctcttggcagcaagtttaagggccaagtcttattactattgttattgctgatttgctcttctgccttctgatgtaaatatttatgtactcagtcccagcctgtagtaagtagtaagtagcaagcagtggcagtacctttggtattaaccagcagctattcgcggcattttaatcccctgtaagtgtagctctgtagcgtgagataaatggcaaacactggtatatgtatgtctgatcttctcactgaatgtattataagagttatagaggacctaaaaaaaaaaaaaaaaaa

SEQ ID NO: 79628 - DNA, 318 bp, Triticum aestivum
  Clone ID: PAT_TA_79628
ccctggtctgcctcctcacgctcttccccaacggcggcggcacctactctgcctccttcctcggcgacccgttcttcataggcggcatctgaattcatctccttccgtgcagtctgcagtgtgcgtgtatttataaatttattagtacgcgctccactaggctaatagccactctactaaccactcaccactccgcagtttccacggttaaaatctttcttgcgaggtaggagtagatctcttcacgtattgtgtaataaggagcattatataaataaatagttagctggtttggcaaaaaaaaaaaaaaaaaaaaaa

SEQ ID NO: 79629 - DNA, 633 bp, Triticum aestivum
  Clone ID: PAT_TA_79629
ctagcttggcagaatagttaatgttaatcacctgattaaaattcgattagtcccctcctacccagctaactactgcttctatttcacggagaaaaatgtcttcctaggctttctctttcagctcgatcgatccacagctcagctagctctctctctctagcgacaagcaagcatggagcagctgttcgtcgacgacccagccttcgcgagcagcatgtcgtcgcttgaggcggacatcttctccggcgccggccagctgccgtcctcgccgtggctggacctagacctcgacgacgatgtccaagacctctccatggcgccgacgacggcgaacgcggtgtcctccggctacggctccggcggatccggctcccacaggaagctcagccacaacgcctacgagcgcgaccgccggaagcagctcaacgagctctactcctccctccgcgctctcctccccgacgccgatcacactaagaagctgagcatcccgacgacggtgtctcgcgtgctcaaatacatacccgagctgcagaagcaggtggagaatctggagaggaagaagaaggagctgacgacgacgagcaccaccaactgccaaccaagagtgttggggagccagctgatgagcga

SEQ ID NO: 79630 - DNA, 658 bp, Triticum aestivum
  Clone ID: PAT_TA_79630
agataacttacaagatagagcccgtttcactgaacaaggcgatgcaattgtttttgaatccgaactggacagaatatatctgggcactccgtcaaaaattgcgattattgaccatgagaagaaaagaacatttgttgtgaggaaaggaggccttcctgatgctggtcttgtgaatgctcatctttactttacttgctactgcaatagattattatcattgaaacaattcaagaataaagttcatgaggtttcatatattctttgttacagttgtttggaacccctgggataaaaaagcgaaggctatgtcagattttggggatgatgaatataaacgaatggtatgcgtggaggcggcggctatagagaagcctgtcactctgaagcctggtgaggagtggactggaaagttggaactttctgctgtgccatctagttattacagtggtcagctagatcctgaccgtgtgattcaggattctactgtcccggaggactcaatcagctagtccttaagtctattttgcgcaggtagagcattacatcatatgcataagagatgctggcaacaaggattgtccacatgtttcttccattctattcaaatctttggtgttttctattccgagtacatatccgaaccaaggaatgtgaaatt

SEQ ID NO: 79631 - DNA, 477 bp, Triticum aestivum
  Clone ID: PAT_TA_79631
tcacgagtgaggaaagggaacaaaagcggaaacaagccactgacagagcaacctttgtgcaaggcctggtgctctccactttatttgaagactgactgttcaagtagccctagtttttcttgctagatgcatgtttcctctcgctggttcccataaaagcgcaatgttccacccgatttggtgaatctgatttcgtcaacagtgagatggatgtgcttctggtgccccgttgttctttcgcttcagtaaagcgcgaagttgatttgggcatgatacacaccttaatttatgtcagctgccctgtaccattgctttttatgaattaacgggtagccacaccttgactgtaactcgttgttgtacctctccatactgtctaggaacattggtttgtacaaacataaaagctgttacatgttgtacaatgcaaaggcaaatgcagaagcaccgtttatatcgaaaaaaaaaaaaaaaaaa

SEQ ID NO: 79632 - DNA, 410 bp, Triticum aestivum
  Clone ID: PAT_TA_79632
cgttccaccacctacccctgtaatctcccggccggcgacgtcatcctcctcatcatcatcatccatggagggcaaggacggcaagcacgacgtacccgccaccacggccgcgccaccaccggccggcgcgccgcagcccgcggcgcctgcgcctcccgcggagtcggcgcggtggggcacgcggcagatgggcccgccagcggcccccggggcgcacccggagaaccaggaggcggcgcggtggacggcggcgcgcggggaccaggagctgccgccgtacgtcgtcatgggggagcccgtggcggtgcagaggggcaagggggatagccccatggaacacatcctcgacttcttcaacacctggagccgcaaggccgaggagctggcatccaacatctggttcaatctga

SEQ ID NO: 79633 - DNA, 551 bp, Triticum aestivum
  Clone ID: PAT_TA_79633
atccctgctgcaaagcgaatgtctaatgtcgcggtggttgttcccaagtcaggcagcagcatatgggctgatctatgggtaataccatgcgcgacaagatttcagactgaccaaatcggtagccgaaccagaggcccatctccactgatccaccagtggttcgacttctgcctgcagagtgctaggagcctacccttctgccaagacgtcatccccggagcatccccgctgtacctcgagaaccctgtgccagaggtccctcaagataagaacaagaggaagccgaagctggagacgaaccttgtcaggggagtgcctccgcccgagatcctggagagatgcgagtttttggagcccctgtcaggtaaggcgctggaggattaccagtggctgatgtctaaggtgcagagacctcgacttggtttttttgggaacgtgttgcaaaagatgtcagctgtactagacttcaaaagaagattttagagccactgtactgtacttgaccaagggtttttacttcgtcgtgcaactaattgttccgtatgtttgac

SEQ ID NO: 79634 - DNA, 619 bp, Triticum aestivum
  Clone ID: PAT_TA_79634
aatctaaaagagtgtatagagtggcattgagcagtttcccgtcacaatcaggtatataaattctagatttgtatagagttacaagctcaattggaaatgctgggcacccctcaaattgaaaatctttctctggctgaggtttaaagtgagccactagaccgccgattgttgcagcgccatggacttgaagcaagttctggttgtcacctctgtgatcaggaagaccgagacgtgtgatcacctctgtttcctgttcatacacgctacaaatatggtgtaacatcctgtcagggctaggagtggcatgtccccaactgtcagagaaccaatcgttataggattggtggctacaactacatggggcttggagggggatcaaaacagaaggggttcgactcagctcttcgctctagtaagccggcaggtctggaaagggaggaatgcccagttgttccatgaagaaacctcggtgatcaatcaagtgcaaaaagagctctgattgaagcgggtgccacaaagctaggctgtttagttcatatgtaacagaacaactgctactttgtttgattcaatcccgctagctaggttttctgttcatctgtattctgtaatagctcct

SEQ ID NO: 79635 - DNA, 567 bp, Triticum aestivum
  Clone ID: PAT_TA_79635
gtggccattatggtatgaaaccattacagaagacatgcatggctacccttgtgaaccatactatttacacaacaccggcaacttcgaaggagactctgaccttgacagtgagcatcgtagagaggtccacaaacaatactatgatcttcaagatggaaacaatgagatgacctcccgattaaaaaaatatgtagccggattttcagacgattcagattgggaaccatatgcaccatgatcaggtatcttcaacaccaagcaagacagcatattttggcaacaagcttcaagcaatgaagaacaatattctggcagtctggattagacatatatattactactatgtaattgatgcatcctgtacatacatgcatgtatcgtatttatattaatctaatgtacttggctactcagaacaagtatctattcagtacttaggcgaacatataatgcatccatcctgtaaatacatgaagatataatatgtttacgtatatctaccatatataaatctgtgcttctatgcatatgtacaatcaatgttcaaaaaaaaaaaaaaaaaaaaaa

SEQ ID NO: 79636 - DNA, 450 bp, Triticum aestivum
  unsure (1)..(450): unsure at all n locations
  Clone ID: PAT_TA_79636
gtcttctatgctcagcagggtggacccgaggctgtattgtctaagcctcgtcgaaagagagtcgtccgcaaaaaggttgcttcaggttgagtttagtggatttggtagcaatgctggaacaattttgcttctgttccactatgcgagagggaggtctacccaaataatggtaaatgagaaactatcaacgtcaaccagcacggtggtctatctgcgaaggcatcaaagggtttgttactgggaagggttggctaaaaggtgcccattactattttataatttaattgcactgatttccttgtttttggtaagaataatatgttggtttcttgtattgctgtgaggcaaatagacacgtttggtggtagctccgtaagattgttaatgtactgactttaacatgagaaatggattctgcatttttatattcnaaaaaaaaaaaaaaaaaaa

SEQ ID NO: 79637 - DNA, 591 bp, Triticum aestivum
  Clone ID: PAT_TA_79637
ccatagcttcctagctagcacgaccacaggcgctagtagctaataagctactgagtatagcttgtagctagagctctatctcaaagccagcagtgatggccgcggcagccctgaggcccctgacggctccgaacgcggcgctgccgccgagggggccggggaaggagcaccggacggcgatcacggtgccggagttcaagcgctgggtgaagcagttcgacaccgaccacgacggccgcatcagccggaaggagctccgggaggccatccgccgccggggcgcgtggttctccggcctgcgcgcactgttcgctgtccggcgcgccgacaggaaccgcaacgggttcgtggacgactccgagatcgagggcctcatcgacttcgccgagagggagctgggcttcaggatcacaacggaatgaacggcggcgcgatgagctagtctgtcgtctcgtctgctccgatcctctctacagctacaggtcgccgacgacgtacatgccggcgtatattgtactgtgtactgtattgacgtaattacgtgacacgtacttgattaattatgtacggtctgtgtagttttttttcgct

SEQ ID NO: 79638 - DNA, 540 bp, Triticum aestivum
  Clone ID: PAT_TA_79638
cctcctcttccgcccctccactgctccttctctcgcctctgcctcttgacctctccatcgttcgacctcgcaacgcggcaagtagggggtgcggcggtcttcaccgagatgaccaccatcgtgatcaccgtaggcgatctcccgcgacacttccccctctccgtgctttgctagacagagagatccgggttcttccttggtttgctaggtgaggacatcatgtggagctttgcatcaaatgccatagctggaagccttaagaaaaagggacaaccctcaaaatgcagcatatccaatccagattgttctgatgatgaagtttcttcatgtaccagcagagaggaaggccttgattgtccaatatgttgggaatccttcaaccttgtggagaatgttccctatgtcttgtggtgtggccacacaatgtgcaaaaactgcatccttggtcttcactgggcagttgtcaagtttccgtcccttcctatccagctgcctttgttcatctcatgcccctggtgcaacctgttgtctttccgtctg

SEQ ID NO: 79639 - DNA, 418 bp, Triticum aestivum
  Clone ID: PAT_TA_79639
ataaatggacactgattgagggcctacggagaccacggtggggctgcttttggtgcagctttgaagggaagctctatgtcatgggtggccgttcaagcttcacgattggcaactcccgttttgttgacgtgtacaatcctaataaccatgcctgggaccaggtcaagaacggctgtgtgatggtcacggctcatgcagtcctcggcgagaagctcttctgcatcgagtggaagaaccagaggtctctagcaatcttcaacccggctgacaactcctggcagaaggtccccgtgccgcttactggtagctcgagcactcgtttttcctttggggtacatgaggacaagctgctgctcttccctctggaggaagagcctgggtatcagacgctgatgtatgatcctgcagctcccatggg

SEQ ID NO: 79640 - DNA, 639 bp, Triticum aestivum
  Clone ID: PAT_TA_79640
tctctgtgttcgcaccagccagcgccggcacaggcaaacgcaacaccgcaccgagccgagccacttagcgagggagcagcctccacctccacctccacggcgacgagagaatggggagaggagggatcggaggcgcggtgggcatggccatggagaacgccgattccgcccgcgcattcgtcaaggacgtcaagcgaatcattatcaaggtgggcacagctgttgtcactgggcagaatggccgattggcaatgggcaggctcggttctctctgtgaacaggtgaagcaactgaattttcaagggtatgaggtgattctggtaacctcaggagctgttggtgttgggaggcagaggctccaataccgtaagcttatccatagcagctttgcagatctgcaaaatcctcagatgaactttgatggaaaggcctgtgctgctgtgggtcaaagtggcctgatggctatctatgacacattatttagccaacttgatgtaacatcatctcaacttcttgtaacggatcgtgatttcaaggatccaagttttggggaccagctccgcgagactgtttttgcactattaaatcttaaagtaataccgctatttaatgagaatgatgccatcagtacccggagac

SEQ ID NO: 79641 - DNA, 276 bp, Triticum aestivum
  Clone ID: PAT_TA_79641
tcagtcgttgaagctgctgccgcacctgggttgtctagtgcctcttgtttcggccatgtccagtctttgaagtatctgtatggtccgtcattgaagcgttggtcagtctgaagtatttgtatggaagcatttgtatggtctgtgtcgtgtctgagttcgtttcatggaccggttgtgttcctctgtgttctaccctaaactatagtgcggcagcatatggcttaattctaaataaatgtgatgttggaatttaaaaaaaaaaaaaaaaaaaaaaaa

SEQ ID NO: 79642 - DNA, 532 bp, Triticum aestivum
  Clone ID: PAT_TA_79642
tttttttttttttttttatattaacagcatactgcacattgacaatgaaggtctgtcccaaaatacacaaaattttacttattctaaagaatagacaagattttattctgtgtaccagacaatcacacctttatttgactacaaaacaaataatacatcgactccaggtctgcccttttttttcgtcggcatctaacaagagggaatgggcataataataagtcccaggtttataataggcaagcaattgtgccggcatcaaagcaggcattttgtacatatatagcggtgggggttctcagaagatgaacaccacactgtcatggacccgggacttctggttctgagcgacacattcagagatccacatcaggtttctgatctcttgctcacggagcctgatgtaagcaaagaacacagcatagtggaactgctgctcaaaggacaagcatagcctcttgacttcctcctcataaaatgccttatccaacatctggctttctccgtatgaaatcctggaaaatataaactg

SEQ ID NO: 79643 - DNA, 556 bp, Triticum aestivum
  Clone ID: PAT_TA_79643
ggcattccccaccgcaacgccagttgcgcaccgcacgggagaatccggagccgccgccctgccttccgctgacgcagtccgcagcttccaaaaactcttcttgctcagctcagtcacctgacctccaccgttccttcgtcgtcgctctcggtccacctaccgaaggagcgcgacatgcagacggtacgaggtgtggtgctgcagcacctccggctccgcgcggcgcctgccatcgctgcacgtggaggcagcgggaggccggcgctgtacgggttcgctcgggggatgagcgcgccggcgggccaggaggacagtaagggaagcagcagccccgaccccgagagggacatcaggacgcgcgtcgttaacctggtcaagaagttcgacaagatcgacgccgacaaggtgactgagactgcagacttccaaaaggacctgagcttggacagtttagaccgggtggaacttgttatggcttttgaacaagagttctccattgagattcctgatgacaaggctgacaagctaacctgctgtgcggatgttgcaaaataca

SEQ ID NO: 79644 - DNA, 501 bp, Triticum aestivum
  Clone ID: PAT_TA_79644
aataccatctcagagttctacgacgctctcgtgaagctcctcgacaacaacgctgacgcatcaacgaaggagatcgtggaggcgatgacgcgctctctggcctcggtcggctctctgccggaggaacagattcaggacacgacagagctagcaaccaagatgcttctcaagagcctccaggccggcgacatcgtcttcggtaaggtgtcccgggcggtctactttgccttccgcggcgtcgtcctcggtggcggcgccaagggcaagaagctagccgaagcgccgctgcgacgcctcggcgcggcgaagctcgccgacagggttgtcaaggccggggaggtgctgataaagatggcagtcatatcagagaaggtccatggacaatggtacaaggcgcttgccttgtgaagagcagaatagggtttgtgttgttttgtgaatatacattacggattacggactgtaaattcttgtcctaccggggtgaggtaggaaatattg

SEQ ID NO: 79645 - DNA, 507 bp, Triticum aestivum
  Clone ID: PAT_TA_79645
ttttttttttttttttttttttttttttttgctagcgtggaggcacgtcaactaaaaacgggcggattctgttacacaactggttttcactttcactagttcaggactgatttttcctccaactctgtgttcgcttggctggtaaaccatggctgaaaatactattcgctaatttgttgcgagagaaaaacacttgctgaatggctagtaaatttgggatgctgctcaccaatatatcaatctgttaggccttggattaccacgaggacctaagttttacgcagccgaatctgtaatctgtacgccgacgcagtgacatttagtatagtactgcagtagagctttctaactagaaactggagaagcatacagtatttcacatcttgacaattctgtagccagtgcaggtgctctctagtctggtttgaagtcgtttccatctaattcgattcactcagtgctaactcagcttcttgctgaactttacgcaggcttacattcatatat

SEQ ID NO: 79646 - DNA, 263 bp, Triticum aestivum
  Clone ID: PAT_TA_79646
gatgatgaattcaagattcaccttatgaacttcctgtccgactataaaccgtagacttacatgaccaatttcgtaaatgcaaagtgctatttcctttgtagcattaatttttccttgagcagtactgaaattgctacaccccaacgcaatgttgctcatgttgtggatataacgacgtatacttcctagattaatctatattccttaatttactagatttattgttgtcttgaaaaaaaaaaaaaaaaaaaaaaaaaaaaaaa

SEQ ID NO: 79647 - DNA, 557 bp, Triticum aestivum
  Clone ID: PAT_TA_79647
cagcaccaccgctccgtttcacaccatgggtatcgacctcgtcgccggcggccgcaacaagaagaccaagcgcacggcgcccaagtccgacgatgtctatctcaagctccttgtcaagctctaccgcttccttgtccgtaggacaaagagcaacttcaacgccgtgatcctgaagcgactgttcatgagcaagaccaaccgcccgccgctctcgatgcgccgcctcgttaagttcatggaggggaagagtgatcagattgccgttattgtgggcaccgtgactgacgacaagaggatcaacgaggtgccggcgatgaaggtgtgtgcgctcaggttcactgagacagctagggccaggatcatcaatgccggtggagagtgcctcaccttcgaccagcttgcgctccgtgccccgctcgggcaaaacacggttctcctgaggggtcctaagaacgctagggaagctgttaagcacttcggccctgcaccaggagtgccacacagccacaccaagccttacgttcgctcaaagggaaggaagtttgagaaggcaagag

SEQ ID NO: 79648 - DNA, 692 bp, Triticum aestivum
  Clone ID: PAT_TA_79648
atagatgacgaggtgaaagttatcttgatcaagtcaaatgtcccagacaaaattgcactgagcacagcagacctggagagtgcacctggtttgtttctttcagacagagagaaagtgttctcagaagctgaggaaatggcaaagaggtacagggagcagcttccagttatgtctcagaaccctatattagatgatggcattccaggagaaatgctaccatttgatgacgaagctaaactgtatgcaaactggcaatggttcaaatttctgcatcataactaacctggtgacaacagcaacagagatcttccatagttttgaggaaattatggatcacgtcaaagagtatggcacctaatgtagcagaacacatatctggcaattgttgactatgcaataatgcaaagctgaaccatcgctagaggacctgttgaagtcaaatactgaccactggtggtagcactccacctccataaccgagcatcaatcatggagaattatactggacaggcaacttcatccggcaaccaaaataagggaaatggttcctggctgcagaacattggtgtttcgaattgcctcattcctagttccccctggagtgaaatgttgtaatatcattttatctgtctgtagaatatagcttcattgcattcatattctgtcaaacacgagtcagagcactccgtggc

SEQ ID NO: 79649 - DNA, 612 bp, Triticum aestivum
  Clone ID: PAT_TA_79649
gcaaaacaggcttaaggaggtaagctttgttatcaatataattgcttgaaatcatgtttagcctaggtaattgttttgatatgcttttggcagtcaaattaacatgtatttctgaacctaaacttgtattatgcttccagatgatttcagtgagaaacaaattttcggcatcacttttcaattttcatgcaatgtaacaatttttttcccttttttaatctcaaattccatttggcaaaaatctcctttttgggtagaaatttaattagctcatttgcttgcaatgcctggaaagaatgtttttttttcatctttgattgtaatctgagttctgaagagtgtatggctataacagttgtgcgttagttatacgttttcatctgatgctatattaataagttctgccactggcttaatctgttactgataattatctcatagcattatactgcttgtcagtctgaagaatcataataatagtagtgttgctgctgatgctgatgctgatgctgatgctgatgctgatttgttgtgaaagaaaaatattgttttatggctgaaaaatagtgatgataagttcgcttgccttggaccctcttcactatcgataca

SEQ ID NO: 79650 - DNA, 602 bp, Triticum aestivum
  Clone ID: PAT_TA_79650
tttactttgcagctattttgcttctgcttcttcttgttcttgttgctgttggtaatactgcgagagaaattaatcagtagagtgttcatctactatcaatttttgatcgaggagagatggcgggaacggcgaactgcatcgacatcctcatcgccatcatcctcccgcccctcggcgtcttcctcaagttcggatgcgggcatgagttctggatctgcctgttgctcaccttcctcggctacatccccggcatcatctacgccatctacgccatcaccaagtaattcatcattagttactacatcatcaaccaaatcctcaagggatgggctccaaaccgcttcatctatcttctcgattgccgtgtgcttgttggaatttggaaatgatatatgcatccaaaattcagtcctgagtgctccaattcttgtcatctagtcattttcaatgtccccccagtctcttcctctaatgtttgatgatatgtagaatctcttgctgttaatctgttgctttcgtgtgaataagctcccctcttatgaatatctatctatgacttgttttactagtaaacttgattattgagagcttaaaaaaaaaaa

SEQ ID NO: 79651 - DNA, 714 bp, Triticum aestivum
  Clone ID: PAT_TA_79651
aaggtcgaagagcgtgatcaggtttatcagcccactgaagaagaaatcaggcgttggctagacccgtatgagaatgtcgtttgtatagagtgcaatcaaggtggtgatgatagtctcatgctactatgtgacatttgtgattcctcagcacatacatattgtgttggcttgggaagagaagtacctgaaggaaactggtactgtggaggatgtagactcggtgatgagggaccatcatatactggaattcagcgtacagtggcttatgaaagacaaacttacagaaatcatgtcgatagtagttctgtaagttttggcatgcttgcatcaagtggcacatttgaaaggccaccatcaatcaaccctcgccattcttttcaagggattgatctaaatctatcaccaagagagtttcctggagaatcacatcctgctgaatcacaagtttcaactgatagcgtatcaactcccactggaagacgaactgtttcggcaaggcgtcaaatacatcggtacattcggattttgctagccagaccaagacaacctagtagaccagacgtattccacaatattgcgcagcacagtggtggtgtaccaagaactgaaccgaaccgccagaacttcccttcttcatcagaagcaaacacatcacataatctgcctgatggcattcagaaccatcacggtagccttccatttgttcaagctcaa

SEQ ID NO: 79652 - DNA, 552 bp, Triticum aestivum
  Clone ID: PAT_TA_79652
catgatgaatctaatcacacttatttagtattataaatatttgattcttttgtataaatttgatcaaacctaagatagtttgacatagagcaaaactagaatatcattgttttttagatggagtatttatatagctttcaagttttaaaattcaaatactacatatggcctttaattatgttgtcacatcaatgccacctcacaaaaatcattctaaattgaggcaaggttgtaaattaaactgttctgatagttgagagttgaaaagtgaatgattttgtagttgaagggttaaatatagacctagctcataattgagggttgcaaactggaattttattaaataggctataatggcttagtatgtcgtacgacatctatagttcctttggcgaacggtattttgttacaagcaaatctttctatctggtggtagcactcaccatgactttaatgctctctccaaggatgtacttaactttatagcttcatatccgagtgttgagacaatgattattaaggcctcacaatcaacaattgtttctgcacttc

SEQ ID NO: 79653 - DNA, 312 bp, Triticum aestivum
  unsure (1)..(312): unsure at all n locations
  Clone ID: PAT_TA_79653
gcatgacacaccttcctgtcatggaacatgcggttcatcttgggatccaagatgaagtgcccatcgagatatccacggaacgctgatgagcgcatgcagatcattgaagaactggggatgtctttgcctggttttgttcgcttcatgtcgtagttgagaaaaagagatgtatgtcacctttgtggtaagtttgtaagccctctgaactctgtaattccgtagttatcgcgcttgtactcttgcttaagctatgtgaactgtcgcctaatgaagaaaatatttaatactgtagttaaaaaaaaaacntaaaaa

SEQ ID NO: 79654 - DNA, 404 bp, Triticum aestivum
  unsure (1)..(404): unsure at all n locations
  Clone ID: PAT_TA_79654
gagagagaaacaagagggagaaagaagagacaaattcatgtatcctctcttctccttactctctatgatgctgctgcccctctaatcttgttgccccttgctaatcctaatctctttctgctctccgttgttgctccttcccatctactcttctctgaatctccctttgatgtgcttctctgaaccccaacctgctaatgcttcttttctcccaagctaacccaactgctgggtaacttccttggaaaccttcaaaagctggctggctcctnttnaatcaacttnaaagcaacaaacaagggactgggattnctctccccccccccccggaaatttttngnaaaccttccaaatttnatggttnaagaattaatgttatatccaaaattgggggaaaanaagga

SEQ ID NO: 79655 - DNA, 472 bp, Triticum aestivum
  unsure (1)..(472): unsure at all n locations
  Clone ID: PAT_TA_79655
ccaagatggagcgtgtgctcgcggtgctcttcctcctggcggcgcacgccgcctccgcggccgccggtgtgacgagcccgtaccggcggagcctgcagatgctccccgacatgccgctcgacgccgacgtgttccggccgccgcctggcgacaatgcgccggagcaggtccacatcacccagggcgatctgaccggccgcgccatgacgatatcctgggttaccccggagcacccgggcagtaacgtcgtccgctacggcctcgccgccgacaacctcaacctcacggccgagggcaccgtccagcgctacacctggggcggcacctaacagtccccctacatccaacaacgccaagctcaacggnctcgaccaagccaacgtctancantaagccgtcggcttcggntaaaacgtgangtccttttccttcaaaaccccgcccaagcccgggcccgaagcggccannaaan

SEQ ID NO: 79656 - DNA, 480 bp, Triticum aestivum
  unsure (1)..(480): unsure at all n locations
  Clone ID: PAT_TA_79656
cctcgtgccgaattcggcacgagggcgatcgatctacgatggcgccaccaagcctagcccccgccgcggcgctcttcctcgccgcgctcctcctcctgtccgcctccccggcgtccgcggcgaggccgcgctcctcctccaaggcggcagccgggccgcacgacatcccggcagtgttcgcgttcggcgactccacgctggacccgggcaacaacaaccggctgccgacggtggtgcgcgccgaccacgcgccctanggccgcgccttcccggccggcgtncccccctcgggccgcttctctgacggnaagctcatcaacggactacatcgtccccgcgctcgggatcaaggaactgntcccgggngtnccaacgccanggggggtcanccacgccaaagccaccaacgggggcaagcttcgcgttnggngggttccnggctcccaacgacattaacggcgcatgccntcatggtctccn

SEQ ID NO: 79657 - DNA, 467 bp, Triticum aestivum
  unsure (1)..(467): unsure at all n locations
  Clone ID: PAT_TA_79657
ggtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggaagttgttgcaacaactgatgttgttgaggcttgcactggtgtgaatgttgcggttatggttggtggattccccaanaaggaaagaatggaaaggaagggatgttatgaanaaaaatgnttcaatccaacaaaagctcaagcatcctgctcctgaaagctcaatgnaaccccccaattngcnaagggtttggttggtttg

SEQ ID NO: 79658 - DNA, 480 bp, Triticum aestivum
  unsure (1)..(480): unsure at all n locations
  Clone ID: PAT_TA_79658
gctgctctctcgcctttccccattccccccaccctccctctcttccgctcgctcgctccgggtctccctccttccctcttcacacccacctcacctcctctcctccctcttcgcgtgtccaagaaaggaaccaccaggcgggaacggcgtgagcgcagctggggctggagccggatcgatcccgttcgtctccaagaggcggcggcacgggcgcaggagctccggatcggcgctcaagaagtacacgttgctgatttcttctacctagacatactccaagagcaagcaagctctgccctgccgccgtgattctgttatccgccgttccaaaaagaaaaacaatttaaaaaggttgtccggggnccaagcttctgaactttaanctggatctaactaagcggcaanatgtcgtttccgcaacaataattcgttgatgncaagggaacngntttcgggaancctgtncnaaagggggagctt

SEQ ID NO: 79659 - DNA, 465 bp, Triticum aestivum
  unsure (1)..(465): unsure at all n locations
  Clone ID: PAT_TA_79659
cggccccgccatcccgctcgcctacgccgccgcgggcttctccgctctgctctcgtccttctgctacgcggagctcgccaccgagatcccatctgccggggggtccttctcgtacctgcgggtcgagctcggcgacatggcggcgttcctcgccgccgggaacatactgcttgaggccgtcgtggggggcggccggcctcgggcgctcctggacgtcctacctcgccgcgctcttcgggctcgaaaccgacgcgctccgcatccangtcccggcgctcgctgaagggttcaatctgctcgatnccatngccgtcgtcgtcctcaatctgcancttcgccctggncaattccggggcgcggctcaactccaacaanaaatcngctggggtccgtgatncggnaanctcaanaatcnccctcgtcaacnggggggggnttntcggaatttcaatccaagaaactnng

SEQ ID NO: 79660 - DNA, 460 bp, Triticum aestivum
  unsure (1)..(460): unsure at all n locations
  Clone ID: PAT_TA_79660
ggagagagagagacccaaagatacatagctgcgcgtcggagccggcggcgcaccggcgtgtagtttgtggatctaagcgttgtctgccaggtcaatgtcttccgcggaccggccctgggtgcgtgtcgtcccggagacgatgtcgttctccaaaaccggagagaagaagcccttcagtgtgtccatgagcggccatgacctgggcaaagagctctacgtgggagggaaccttgagctgggtatcggagaagcatgtcgtgcgtagccccatcgtcgcccgtcggcacaggaggtgatactgctccgggcaccatcaacatgaacgatgtccatgccaatgaaatncnaatggttggttttcctttgtccttgttcaattcnatttcnggtttaactggttgcaatcaaacaataaaacagttaatnatggggacaagggaatgttaaatccncccaatat

SEQ ID NO: 79661 - DNA, 501 bp, Triticum aestivum
  unsure (1)..(501): unsure at all n locations
  Clone ID: PAT_TA_79661
ggtctcttcacgctcaagcttgaggaattgcagttcaaaaaacttttcgacaccaaagtgcgggattgctactatccatttgaaagtgtctatggtgcaggtacctagaattgtatcctggtttgctgagatgcgggaatggcccttttgctgaaggttctttggcttcacatgaagatcagccatctacacaacgtgcactggtcatctgggaagtagacctgtaagaaggagttaatcatttaagtttgccaactcccctttattatcgaatttctggacaacaattagcccgactggggatgatgaagaaacaattgggttgcctccnggttaantancactttgcccntggtgggttcaatttgccaatttgctttcctgggnaaacaanggttgaaagcaaagccttgncctggcntaaaaggatcctttggcctaanaatttccggcctcctaacgggttccgggtttaatggggcctcnggncncccctccccc

SEQ ID NO: 79662 - DNA, 272 bp, Triticum aestivum
  unsure (1)..(272): unsure at all n locations
  Clone ID: PAT_TA_79662
gacggaaccaacaaatcccaagctaatctcgtctccgatcgacccgaggctcgtcgaatcctccttccccaacgcctcaagatgcaaatctttgtgaagacactcacgggcaagaccatcacccttgaggtggagtcgtctgacancatcnaaaacgtcaagggcaaaattcaagacaagggnggcattcccccggaacaacaacngcttatcntccgcggnaaacaacttgangannggcgcanccttggcggattaaaaaatccaaaagg

SEQ ID NO: 79663 - DNA, 250 bp, Triticum aestivum
  unsure (1)..(250): unsure at all n locations
  Clone ID: PAT_TA_79663
cgctcccaccaccggaataaaccgcgcctcgccggncgacctctccccctcctcctcgaccgcctagccgcttgctgtttgtttcttttgcgcaggccccgtgcaaccgtancgtacccgcgaggaganagaggcagaagccatggnnatgaacaagatcncctgcgncgtgctgatcnccctggtggcctnccgccntcntgggncncggtnacnacccccggccngccnangcgcncggctcnaagtc

SEQ ID NO: 79664 - DNA, 526 bp, Triticum aestivum
  unsure (1)..(526): unsure at all n locations
  Clone ID: PAT_TA_79664
ccagagcaccaatattcagccaaaaatgcaatcctcttcacgagcttggtgaaggccattataatacgataagatggaatcctgaagggcgattttaagaagatgtgttgaaaagctgtatcagcataaaaatggagaaacaaagaagtaatgttccagtatatttgcaagaggtgaaatattaacgccagttcgagcgcaccggcctcgatngcaaagaagaacactaccatcaagtgtagtgggtatagcaatactgtgagcaatcaagggaaacaaaaaacaagggagggttaattttcaacaaaatccgggtnactggcaatatttttcaaaaaagnatatgcatttggtnganttgaaccaatgaagaaaatncttttnccctcccctaanacttnnaaggnggtgttcctgcctccnaaaaaatgaccaangcaacccaaacngaagtngaggangcgcaaaccacatntttgaaganttntnaggccanctggnnagcccgatgcaaanttttgnnatg

SEQ ID NO: 79665 - DNA, 512 bp, Triticum aestivum
  unsure (1)..(512): unsure at all n locations
  Clone ID: PAT_TA_79665
ccgccgccgcctccgctcggttccttctccttcctccgagcttcagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaaagttcgagaccaccaagtactactgcaccgtcattggacgcccctgggtcaacgtggacttcatcaagaacatgattactgggtaactcccaaggctgantgtgctgttgcccaatcaatttgactctaacaactgggtgggnttttaaggctgggtatccccaaagggatgggccaagaaccgttgaagcaacgccctcccttgccttcaatccttggngtggaaca

SEQ ID NO: 79666 - DNA, 464 bp, Triticum aestivum
  unsure (1)..(464): unsure at all n locations
  Clone ID: PAT_TA_79666
gcctcgtgccgaattcggcacgagggagaaataaaccaacgaaaattgtcccaactctcctagtgtcatccacaactatcaatgctcaggttgaaaggtctaacaacgaaggcctgcttctcacgaaggagtgggaggcccggaagtagcaaccccgaggcaacaacagctcttcctctggcgggcggaacaaccgcctgaggggcagtgctcgtggggcggtgcccgcggaggtggatgcgagaacggccatgaccacaagagcggcggcgacaaagacaaatgccgctactgtggcataaagggccattgggcccgttgaatgcaagaaaaagaaaaaggaggaggcactccttgctcnaaccccacaangaagctgattccggacttgctgctggcccatntttttgagatntctnccancgggcccaattttccctnccanggnaaacnggtttcccant

SEQ ID NO: 79667 - DNA, 469 bp, Triticum aestivum
  unsure (1)..(469): unsure at all n locations
  Clone ID: PAT_TA_79667
cccgattcccatctcaggcggcagcggaggcgcaggtggtgcagcatgcacaacatcgccgagcgcctccggtctccactctccagcctttacgcacacggcgtacatcacctcatcgccgagtttcatcagccacgcgatctcgactaattcacgagcttctcaaagtcgaattattgaaaaactatttgagttcactaataattcaagagagtgattgatttggcaacgttacacatatagaagaaattattggataaggctgacattgatcataggtgaattaatatcaaggaatgctaagaagaatctttttaaagggccccgagttttagtttccccccgggnccccgaaatttcaggaccggccctgctcaanctcggtcaaaaagatncggnaatgttcngnngagggcaacccccaanggttgggggggggggtcccngacctaatcaaaaacattggttt

SEQ ID NO: 79668 - DNA, 468 bp, Triticum aestivum
  unsure (1)..(468): unsure at all n locations
  Clone ID: PAT_TA_79668
gattgatcagcgtcgaggtcgagatgtaccaggcgatcccgtacagcgccggccggctgccggcgtggccgcggcagttcgagcctgccgaggtcgacggcgcggccggtctggagagcaggcgggcaggcgacggcggggaggcggtgaggagggcggtggcggagagcccggtgctggtgatggggaggcgcgggtgctgcctcagccacgtggtgacgcggctgctgcangggctcgggggtgaaccccgcaagtgcacgangtcgcccgacgaggcaagagctcccccggggctgcccggcggcgaaggccgtcgtccccgctnccaaccggttttccgttgggcngggaaggctncctcnggcgggctccgattnggctcatnggccgttgcaaaatnctcccggcgaagctccntggcccaatnatcaanagggaccccccggcgcnctcctggctncttaa

SEQ ID NO: 79669 - DNA, 430 bp, Triticum aestivum
  unsure (1)..(430): unsure at all n locations
  Clone ID: PAT_TA_79669
ggcgaggtgtcaccgccgccctgtacaagttaaattttttgggttttcaagctgttcgcccgagacttgctcacgagcaggagtgttccagctcctgctgagggatccttgtttttgttcgtttttactccaatttacccgtaataagcaactgcagtgacattggttttagtctgcacaacagcaacactactcttggctttgggaaaaaaaacttgtgccctttgtaatgcagatcccgacagatcaatgaattgggtttaagtttantgttgttggcgaaagttgtccngtggttcaagattttttaaaaatgggncctggttttaanacgtccgtgtcccttggtttggggttcccctggccaaacaanagattngcaaaaaaatntaantccaacgccctntngggancgctgtncgtctanctt

SEQ ID NO: 79670 - DNA, 430 bp, Triticum aestivum
  unsure (1)..(430): unsure at all n locations
  Clone ID: PAT_TA_79670
tttctacatgccattgctattcctcatgttgcaaccttttcccgtagaatcaaaaggaattagatggaagaaattgcaggagagcaggaagggtattcctggtgtgacattcaaaggcagtcaaaacggcgaggtttagaacggaggagttctgtggaattatggataaaaaattatcaataacatgtctgtcattgctcatgtcgaccatgccctttgattctacaagcccgcaaagggagttgaaagtgtagaaaataagtccattggtccgttgaattggggggaatgtcaacaaagttaatgctgcaaattgtttccaatttaaaagcaaagaaagncaaatcaagtaattcaattggnaatccttgaaaaacttggttaatggcacntccaaaaccggtaaaaacnttttttcngggaaaaaaaa

SEQ ID NO: 79671 - DNA, 495 bp, Triticum aestivum
  unsure (1)..(495): unsure at all n locations
  Clone ID: PAT_TA_79671
acaatccaatccaatcccccaagagagagaagaggaggaagatgtcgggccgcggcaagggangcaaggggctcggcaagggcggcgcgaagcgccaccggaaggtgctccgcgacaacatccagggcatcaccaagccggcgatccggcggctggcgcgcaggggcggcgtgaagcgcatctcggggctcatctacgagganacccgcggcgtgctcaagattttcctccgagaacgtcatccgcgaacgccgttacctaaaccgagcacgcccgccgnaagaccgtcaaccgccatgggacgtcngtctaatccgctcaagcggcaagggcgcaacctcctaanggttccgnggtctaagccgaanggnccaaccgtncanctncgccaangcccnccgttcggnccggnaaagtnatagntgggcatcnaatctanagttcngnccaaaggnttcntnggtctcccnttttttcgcaantttttcgctgtgt

SEQ ID NO: 79672 - DNA, 437 bp, Triticum aestivum
  unsure (1)..(437): unsure at all n locations
  Clone ID: PAT_TA_79672
ccatggttgcctacctcatcaaggcagcaacttaggaacgcagcgatgcccggccgctccttgctgcaagctctcaccgcccggccgctcagcaacaacgatgttgcangaggaggcccctgtcgctactcgcccgagctgactgcacgctcctgccagcacgcgggcgtgccctctgcagggcaggggctcgactgctgctaacctgcatcaacaagcgttgcgatgaagttttgatnggccggcggggtgctgcnacggancacgccaangccgtgttggtgcttgcccctggagccgcggtggaaccctccgtnccgggggtcccgttttggtggttgctaangggacttgcaaccgggagcaacccttccccgtncttncgttggcttcnaattaanggttcaaattgngagcaatcccccggggggtccttc

SEQ ID NO: 79673 - DNA, 482 bp, Triticum aestivum
  unsure (1)..(482): unsure at all n locations
  Clone ID: PAT_TA_79673
gcagccgagatgcagatcttcgtcaagaccctgacgggcaagaccatcacgctcgaggtcgagagcagcgacaccatcgacaatgtcaaggccaagatccaggacaaggaggggatcccgccggaccagcagcggctgatcttcgcggggaagcagctggaggacgggcgcacgctggncgactacaacatccaagaaggagtcgacgctgcacctcgtgctccgcctgcgcgggggcatcatcgaagccctcgctccaagccctcgcccgcaangtacaaccaaggagaagatgatttgccggcaaagtgctacgccaaggcttgcatccaaaggggctgtcaactggcccgcaaagaaagaagttttggccaacagcaaccaanctgaggggccaagnaggaanatnaaagaacttagngctcntnaagactgtnaatccgccgcnttcntttgnctgggttaatcanttaacataaaat

SEQ ID NO: 79674 - DNA, 449 bp, Triticum aestivum
  unsure (1)..(449): unsure at all n locations
  Clone ID: PAT_TA_79674
gaaacaaacggcggaggaaacacaagggacaaagacgagagaggtggtggtgacggcgaggccgacggaggccggagggaggcgcctacaaaaagggcaacgcaccaccaccaccatcatttccctctctcgcttcagctcaggtcgtatgcctgcagccgcggcccgcctgttccccttggactaatcaatccagtgatccccgcccgcggttgtggtccgtccgtccgtcgggccctgccttcggttggttggttggtccgggccgccgtccctccctnccccgcccctcctcctcctcctccctcgtcgtcgtncgctaatggnnggtggagccaatcangcaacctgntcctncctngttnggctttctcccctcccctncccttnccccaanaagnnccgagncccggncgcccggnggggggncaataaggtncttttncccc

SEQ ID NO: 79675 - DNA, 479 bp, Triticum aestivum
  unsure (1)..(479): unsure at all n locations
  Clone ID: PAT_TA_79675
ccacacaccacgcctgcctcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagcccccctgccaagcaaaatgacaacaggcagctgtggttcgcgtccaagcaagtccctcacctacctggacggcacgctgcccggtgactttggcttcgaccccttggggctgtccgacccggagggcaccggcgggttcatcgagcccaagtggctgggcctacggngaaatcttcaacggccggacggcgatgatgggcgtggtgggcatgatcgccccggaggccctgggcaangtggggcctggtgcccccggagaacgggcgaatcccgtggtttcnaagccggcgnngattcccgccaa

SEQ ID NO: 79676 - DNA, 495 bp, Triticum aestivum
  unsure (1)..(495): unsure at all n locations
  Clone ID: PAT_TA_79676
gctcgatcgattctttcccttgcgtttgcgttcacgtttgttaggcaggttcaatggcgcctctcggtgatggtgttgctcccgtggctgccgcggcggcgcccggtctcgtcgtctccttcggtgagatgctaatcgacttcgtgccgaacgtggccggcgtctcgctcgccgagtccggaggcttcgtcaaggcgcccggaggcgcacccgtcaacgtcgcatgcgccgtctccaagcttggcggctcctccgccttcgtcggcaagtttggcgacgacgaagttcggccacatgctgggtggacatcctcaaagcaaaacggggttgaaaaagggagggctgcctcttcgaacgaagcangncgcgcaacgcccttgggccttccgtcaacctcaaantcaacnggggaaacgtgaagtcaatgttctaaccgcaaacccgtccggccgacaatgtcctcaangggggcgggagctcaacctccaactcaat

SEQ ID NO: 79677 - DNA, 386 bp, Triticum aestivum
  unsure (1)..(386): unsure at all n locations
  Clone ID: PAT_TA_79677
gcaccgaggaggaggagctcgtggccaagacgacgaccgccganttcgggcggngctacntgctgggaaaggagctgggccggggtgagttcggggtgacgcgccgctgcaaggacgccgccacgggcgaggcgctcgcgtgcaaaaccatccggaggcaccgccgccggggcggccgcggggcgaaccgcaaggccgcgggtggngggggcgcggaagccgccgcgaganccgccgccgccgccgcggcgcacgctggccgacgtgcggagggaggtggccatcatgcnacgcatgtctgcccgcggtggcacggccgttgttgcggctgcganaggcccgcnaggaccaaggaatgctccgtgcacctcgtcatggnactctgc

SEQ ID NO: 79678 - DNA, 461 bp, Triticum aestivum
  unsure (1)..(461): unsure at all n locations
  Clone ID: PAT_TA_79678
ccgctcttctttgccccaaccattgcagcggccgactcgccgtccatccgctcatggagaagatctccgtcgccgtccgcttccgcccgcccaagtcttcggtcgatgccgacgccgactcgccctccttctcgggcggcggcgctgtcgggaaccgcgagtggcgcatcgacgactccgggatctccctcctccaccgcgccgtccccgtccccggcacctccttcgtcttcgaccacgtgttcaacgagtctgtgaccaacgcgcggatctacggcctgctcgtccgctccctcatccgtggtggccgtagatggcttcaacggnactgccttcgcctaagggcanaccaacagtggnaaagacgtttaacatgaacggntccggtgctgaacctgggatnatcccgctccgctgttcgcgaacatcntttgacanaacgggccgaaggctgcaaaana

SEQ ID NO: 79679 - DNA, 231 bp, Triticum aestivum
  unsure (1)..(231): unsure at all n locations
  Clone ID: PAT_TA_79679
gatcacgggttaggaggtcgcgagattttttgtttgggattgattacgtagggttttattaggcggtggtgagcagcacgtagcgagaggatgaattagattggcggtgaatctggtcgttaggggataatataagctttggcagttttgtaaccatcgattgaataacaacgagatgatgggaaatgagatcttattaattttgtgaaaaanaaaaanaaannaaaaaan

SEQ ID NO: 79680 - DNA, 458 bp, Triticum aestivum
  unsure (1)..(458): unsure at all n locations
  Clone ID: PAT_TA_79680
gagttggcaagcgcagacagacagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccaagttcgttgacaagtacggcgccaacgtcgacggctacaagcccaatctacacgccaagaggaatggtctgaatctggtgaccgctacgccggcggaacgaccgggcttcttatctgggccgtcaacctcgccggcctcctcggcggcggcgtcctcctcgtctacaacaacancgctctcgccggctaagagagcatctacgtgtaacacaagg

SEQ ID NO: 79681 - DNA, 445 bp, Triticum aestivum
  unsure (1)..(445): unsure at all n locations
  Clone ID: PAT_TA_79681
gagatgcttgggattgggcggctgcttgtcaagaacaagtagaaggtgttcgatgtttatttgggcagcaggatggctcctgctcttgtcaaatgggacagacaactcacttcttatagcctgaccaacatggaaagattgaaatgcctctgcaaagttcttcacagcaacatatcggtatgtctcgtcactgtgtatccagtactgtctctgatctttccttgatgtaacctgcataccacatttcaattatagtcagtccacttcagcactgtagacaattgtgatcctagcattagaaaatctgactttgggacagaggtttgtacaaatatgttttttctatttctccgagcaaatcatgtacaaaatactaaaatatgttgatgatctgcctgttgcactcatcaacaaactttgcatcaaaacattgccaaatatctcn

SEQ ID NO: 79682 - DNA, 465 bp, Triticum aestivum
  unsure (1)..(465): unsure at all n locations
  Clone ID: PAT_TA_79682
ccaacgcacccgcaaatcccccactctcccgaaccagcgatggcccccaangcggagaagaagccggcggcgaanaancccgcggaggaggagcccgcggcggagaaggcggccgagaaggccccggcggcgaagaagcccaangcggagaagcggctgccggcgggcaagacggcgtccaaggaggccggcggcgaagcgaaaacgangggccggaagaagggcaacaaggcgaaaaaaaacgtggagacgtncaaagatntacatcttcaaggtgctgaagcangtgcaacccgacatcggcatctcctccaaaggcatgtccatcaagaactccttnatcaaagaaattttccaaaaactccccccgaaggcgccaaactccccccgctaaaaaaagaaagccaacatcaacttcccgggagaatnaaaacttcgttcggctncttctcccgggggangtcc

SEQ ID NO: 79683 - DNA, 440 bp, Triticum aestivum
  unsure (1)..(440): unsure at all n locations
  Clone ID: PAT_TA_79683
gcaaccatctttccagcgtcccttcattacgacgccatctctctccccatggaaagaaaatccacgattctaccgtcccttcctttctattctttcgctcatattgcaagaaaaaagtgatgcatcgatctggcatggtcgagggtttacgtagatcaggtttatttcttgcgctaattttctgctgaatttttctcttgctggtttaccattcaatcttttattttggattggaattgatttgttttctggaatcctttgatcgtgaggtgctcgaatctactcctacaaaccacaacgaacctaattttttggaaaatctccaatttctgattgagatgctacccgccaggcttcccttcaaatcttcggttgttcttgacnagcaaatnagtccanctanccaaggntcaagtcagcgggaaactgcatgggccaag

SEQ ID NO: 79684 - DNA, 502 bp, Triticum aestivum
  unsure (1)..(502): unsure at all n locations
  Clone ID: PAT_TA_79684
tgacganacccaatcttctcctcccccgagttcgacttcgacgttcgacccctccaacgaaaccatggcgatcgagacggagcccgccgcgccgccccgcctcctgggccctccggtagttcgcggcgtgcgcccgcccgccgactcagccgccgaccccgcgtcgcaccccttcctcgacctcctcgacgcggccttcaacgcgccgtcggacgcggagatcaaggcggcgctgacgcccgcggngcgcgctcaaccganaaactggtcgggcaacgttacgctnaactcccgggaaacccctgnctcgaattccttccttccaaaggtgggtggcccgacaacgccggccccgaagcggcgtggggcgggcctgntcngccggccgnctngggccaaagnagcggctcaaagggggtnaaaggtccgcctggaaacctccgcgggggccgggggaacggggaaantccggaaaagggaaggtttttangcngggcgngct

SEQ ID NO: 79685 - DNA, 385 bp, Triticum aestivum
  unsure (1)..(385): unsure at all n locations
  Clone ID: PAT_TA_79685
gagagaaagaatggcgtcgcgattgctgaccagatccaaagccctagcgctcgccgccgcccgcgccgacgcggncgcgccgtcgccgctcgccgccgcctgggggacccgcgcgctctccaccctcccccgcgatccggncgccgcatcccccgcctcgtcgccgcggnaaccggcggnggtctcgccgctcggcctctccaagattctanggatatgagcaaggcatctcgactccggtnnnacaaaacgtatttgcctccgctggttttctaatggnggctccaatnggatttcctgatcaacananctcaaaggacaatttgctggggaatngttacaaatccggatggaacttgaaaatnaaagggnggggaagnctcaa

SEQ ID NO: 79686 - DNA, 525 bp, Triticum aestivum
  unsure (1)..(525): unsure at all n locations
  Clone ID: PAT_TA_79686
gaatctgcagtcctgtcgtacgaatttctttgtaggcgatctcgatcgacgaccatggcttcgtgcggaaggctcttcgtcttcttcttggtggccgccgctctagccgcggcgccggcggcgtcgatggccaacgtagtgccgcttctcaccgggcgtcgccaccatgcagccccggccccaagccccggncatgccctcgcctgcgggctcgccttccanaccgccccgcccgcgtccccggctccgccaacgtcgcgangagtccgtcaatcgtccgcgttcggatgggtccggcanggtcttgtccgtccaaggtccggaaccgggtggcngttaagcgttatccaagggtgggngcgtgggnaacgcntccaancccccgtnngggtttggggccggcccccggcaaagggcaangnccctgggtttggaacgggaatnaanncccgtcntaanntcccgccngaaaggggcctcctnaaaggtnantggacaanngggccnaatangcaancctcccnt

SEQ ID NO: 79687 - DNA, 504 bp, Triticum aestivum
  unsure (1)..(504): unsure at all n locations
  Clone ID: PAT_TA_79687
ggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtncaaggacgcggtgccgcggacggtggagaacttccgcgcgctctgcaccggcgagaagggcgtcggcaagagcggcangccactgcactacaagggcagctcgttccaccgcgtgatccccgacttcatgtgccagggcggcgacttcaccaagggcaacggcaccggcggcgagtccatctacggcgagaagttcggccgacgagaagttcgtccacaangcacaccaancccgggntcctctccatggncaacggcgggccccancaacaaagggtcccagttcttcatctgnaacgtccctggaatttgggtccaagggcaagcacgtggtcctcggcgaggtcctcttgggcatt

SEQ ID NO: 79688 - DNA, 235 bp, Triticum aestivum
  unsure (1)..(235): unsure at all n locations
  Clone ID: PAT_TA_79688
gctcctacagtcctactaaaactcaaggcgcgcacgccgaacgcacggtcaccgccactgcccgagtctcctttcctcctctcccaccccacgccgcgcgcgcccgagcgacccccatggngtccctgcttgcggcgctcccggccggcggaggaggcgcggtcgctgccgctgccgcggtcgtcggcgggctggccgcggctgcggtgctcgcccgccanggccggcgtncgtc

SEQ ID NO: 79689 - DNA, 402 bp, Triticum aestivum
  unsure (1)..(402): unsure at all n locations
  Clone ID: PAT_TA_79689
ccagcctcctcactcctcacagtcgcagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagctccggcgggttcgagacggccggcggngagaccggnggttgcgactgnaccacctgcnaagtggnngcacgggntgcgggntgctcctgctggaagctgcanctgaagccgggtgcccaattagggccggncgggtgagggcgnagnaactntggatnagggagggacaacctgg

SEQ ID NO: 79690 - DNA, 509 bp, Triticum aestivum
  unsure (1)..(509): unsure at all n locations
  Clone ID: PAT_TA_79690
cgcaggctcgccaggggatccgcccggcgaatccatcgantcgcccctcctgcccgcgccggagaccaagatgccgccaccgggaccgggagcggcggnggcgcccatccagctgggggtgccgcccccgtacctccggacccacggggccaagatggcgcggcggcacatgtacgactggatcgtgctgctcctcctcgccgccatcgaggtcgtgctcaacctcatcacgcccttccatcgcttcgtcgccgagttnatgatgggncgacctccgctaccccatgaagcccaancaacatccccgtctggggccgtcccgatatncgcccgtcatccctgccgatgctcaacttcngccggcatntnttttaataagaagaatgcctncngaactgcaccaacgccaaaatagggctggctggttctncgtggctcaacaaacggggtnctcaacggncnccattaaaanggcnngggtccnggccngggcttcggccccaactttt

SEQ ID NO: 79691 - DNA, 598 bp, Triticum aestivum
  unsure (1)..(598): unsure at all n locations
  Clone ID: PAT_TA_79691
ntctagaggatccccgtccanttccttgatggcaatcgccggcatcttcacgccattgaaccagttcttcttgaccatggngtaaccggccgcatctnggaaggagatacggncgccgnctttcagctccttgtcgaagcggaaatcgccgaaaatatcgccggcgaggcaggacttgccgcagaccatgtaaggatgttcgccctcgttcggcgagaccttggnggtttcgcggtagatcagcagatcgagcatatgcgcttcgatggagctgtcgacgatggcgaggttcttgccgttgaacagcgtgtcgagaaccgtcacctccaagcgtcgtgcttttggtgatcgaggcttcgcccggatccagatagacctgcacgccatatttttcggagaaggcncgcanacggtcgcaanaactggtccagcggataatcngtcaacggtaaaagtggatggccaacaaccaaggctcaaccaattcnggaaagccaacaacaagcgnttccgaaatttnccccccgaatctgccgtcaaaaatnggggnccgaaaaaacgaagnaaaatcaaccgtttttcgcaattnattggnngg

SEQ ID NO: 79692 - DNA, 491 bp, Triticum aestivum
  unsure (1)..(491): unsure at all n locations
  Clone ID: PAT_TA_79692
gcaatcctcgatctgttctcaacctcccctccgtccgtcgcagctccagatttccttccccatggatccgatcaagatcggnatcaatggtttcggccggatcggcaggcttgtggncagggttgcnctccagagccccgatgtcgagctcgncgccgtcaacgaccccttcatcaccaccgactacatgacctacatgttcangtatgacactgtccatggacagtgngaagcaccatgaagttaaggtgaaggactccaagacccttctcttcgggcagaaggaggtagctgtgtttggctgcanggaacctgaggagatccatgggctgctgctgggtgctgaatnagttgtttgagtcaacggtgttttcaatgaaaaggganacggtgcaagctcaaaattaagggggggtgccaaggaaagncancanttctggccccangaaagatgcncccaaggtttggccgggggnggccatnngnaaagg

SEQ ID NO: 79693 - DNA, 492 bp, Triticum aestivum
  unsure (1)..(492): unsure at all n locations
  Clone ID: PAT_TA_79693
gcccaagtcggactcgccttcctcctccccaactactcctctcctctcctccgcgcatcgcaccggggtcacctgagatcacacacacaatggtgaaggctgtggctgtgcttaccggcagtgagggtgtcaagggcaccatcttcttcacccaagagggagagggcccgaccaccgtgacgggaagtgtcaccggactcaaggaagggctccacggcttccatgtgcacgctcttgggcgacaccaccaatggctgcatgtcaactggaccacacttcaaccctgctggtcatgtgcatggggcaaccgaagatgaaatccgccatgctggtgatctttggaaatgtgacagctggagtggatgggngttgctagcatcaatattactgnctggcaaatcccccttaactgggncaaattcaaattttgggccgtggttgttgtcntccaatgggggaagctgnatgntttttgnaaaaggggngganatt

SEQ ID NO: 79694 - DNA, 295 bp, Triticum aestivum
  Clone ID: PAT_TA_79694
cctcgtgccgaattcggcacgagggaaggaggaggatcagactgacgacgacgatggcgaccagactgacgatgacaatggcgaggacctcagctaactccaagttctgcttaagacagactagatggttctctggtaataagaagtcttatgcatcttctgggcagctgtattttctagacgaagccttgttgtgttagtatcggaaccctgcatgcacgtacccatgcttatttatgtatgtctgtgtaccactatgtttctgtctaaagtatgcgaagtgaaacgttcttaa

SEQ ID NO: 79695 - DNA, 460 bp, Triticum aestivum
  unsure (1)..(460): unsure at all n locations
  Clone ID: PAT_TA_79695
ccctggtcaaccacggcagcagcggtttttggccgcgatggatccgagtgcgaggcggcgtcttcctgcgaggccgcgcgtgggcggagctgatcggagacgtggacggctccggcgttggtgccgcgtgccgcccgtgcatccagcgcggaggtcgccgcgcggcggttcacgagggacgcccccacaacgtgccgtgtcagggtatcgcggagaggcggcttcaacgctaggcctgcgcacgcgtcatggtgaccacaagctgagcgcccgtgttgtcagatggactgtcgaagcgccgtgttgatgccttttcccttcctcggctcttctctgatttattcatgcatgggtgtgtctgatcctacaggaggaaaagacaaactcaattggtagacaatgtattggtaaagaaaactanattcgaatnggntaantccctgggcccnttttgtttgtt

SEQ ID NO: 79696 - DNA, 242 bp, Triticum aestivum
  unsure (1)..(242): unsure at all n locations
  Clone ID: PAT_TA_79696
gatcaccacacgtccacaccacagcagcancatggctaccaccagtcatgccctcctcatcgccctcgtcgtcctcgccggcctcgccgacctgcaggccgccgcggggcccgttcacgccgcggagcactccgcggtggtggcaatggcgacggcgtacccantggcggncgantgcggttccggntctgaacgggatgatgcaagtgcatggctcggggtgcttcaacgtctgnttatta

SEQ ID NO: 79697 - DNA, 171 bp, Triticum aestivum
  unsure (1)..(171): unsure at all n locations
  Clone ID: PAT_TA_79697
ggagagagagagagagagagaactagtcccgagttttttttttttttttttactcagcatatgacaggctttatcnttgtntnagcatgtatttataggtccattnaacaatatttntgctccattttnttnatnttcttcactctttttccantggttcttcanctccaa

SEQ ID NO: 79698 - DNA, 302 bp, Triticum aestivum
  unsure (1)..(302): unsure at all n locations
  Clone ID: PAT_TA_79698
tgatggtgcgcttcctccacctgccccgcgccgcccccaccctcacctaccgtcccctcctcncgctccctcccccgcgcctgcgagtgnccgcgtcggcctcggcacccctcgccgccatgtcgacggtggggcagcaggcngtcnctgancagaagcgcgcggtgnggtccgacnntgcgnagggcgctcaaggccctctccctcgatcaancgcaccagcgaanattctggntnttcaanataattantttgtantcttctttgggttcaaatgantnaaacggntggtgtgncctaaa

SEQ ID NO: 79699 - DNA, 353 bp, Triticum aestivum
  unsure (1)..(353): unsure at all n locations
  Clone ID: PAT_TA_79699
gctaggtttgcgccgccagctctcatcgtcgcctccggcggncggtcaccggagtgcgtctccgtcgcctcgccctagccactcctccccttcgttctagcgagcaccaacgccagccgtggcctgggcttgagccgtggtctcctccgtcggtcccgaccaagcgagcacgcctccttcagccatctcctcccctcccggcctcctcgcagcaccggtcgcaagcaatncttccacgcctcctctacancancaaagggcaagnaacaatgttaagggtcaaacttagacaatcaacgcaatctggaagtgtagggaagtggccctggaagttnacaatgggccgantaatg

SEQ ID NO: 79700 - DNA, 395 bp, Triticum aestivum
  unsure (1)..(395): unsure at all n locations
  Clone ID: PAT_TA_79700
ggcctggctcagaccctcctcatcctgtgtggctccctcgattgatcccaaatccccaattaatcccaccgccgcctagagcacaagagcgggcagcggcagcctgcgaacgccaagtacggcgtgaccagccaggtggncctnnaccaggagtgccgagattgttatccaggacgattggacgaagagggagcaaatctatgagtgaaaaggataagggaagggaaggaatgcaaaatgaaaggttagttacttaatttctcaattatgcgtttgagtgcttgatgattgaattgcacgaacacgttgcacctggattgtacgtgattctangttaatgtcatataatctactgtagttagtgtgtggccaattggaaacggnggngtccaaaa

SEQ ID NO: 79701 - DNA, 314 bp, Triticum aestivum
  unsure (1)..(314): unsure at all n locations
  Clone ID: PAT_TA_79701
ggagaactagtctcgagtttttttttttttttttttttgatctanaagcaatacaaacatggtacgatggtaacaacggacgagcaacgtccatggnggaatcgatnaacaccctctccactctgcctacatatacgagtttatcacagttgccaagctaaatcnagcctgtcataacgcgccggccgtccggccagccagccaccggagcgtccatcaccgtccccggaaccaggtcaatatcaggcgancggggccctggaaacgcngaccttgangccgttnccccatngtnaggatgtcatcatgccgtt

SEQ ID NO: 79702 - DNA, 565 bp, Triticum aestivum
  unsure (1)..(565): unsure at all n locations
  Clone ID: PAT_TA_79702
gagagagagagagagagaactagttcttctcatcttccctatctctaactctttctccatactgcgctgccgccgaccaagccntcacgacattttgccgtcaaagatccactcactactactggctcagagatcattccctctatttctatgtctctctaaccctgcgatccgcgccgtcgctggttaagatggcccaagacctactcccagtcctggacaacacgagctgtacatgccgccgccaagctctgatttgtgtgtggtcggaaatttcgtagaagggagctcttttccatccctagcgacctccttcgcggcaacaagttcggtcattatctctcccgcaaactccgttcttatttaactactattgacaaacatatgttngagatgccatggatcattgatgtttctccaatccnggtttgttttttaattgggaggctataaatggngaaaagttcccttccntcccttttgntgggcctttaattatttnangggattccngggaaanaaacaaanttagattgaaggaaagcttaccaatngtnccngtttn

SEQ ID NO: 79703 - DNA, 555 bp, Triticum aestivum
  unsure (1)..(555): unsure at all n locations
  Clone ID: PAT_TA_79703
gtccctaccaccggtagccagccagccctccaatcgctcgcgctcccgcgccctcacatgtcaatgtgctcgcccgccttgcaatttgcacaccccaaacctcaccaaccgcccatgaaccatacataattcgttagttagttgcccacaagccattgctcattttatcctcacgctccccgcgtgctcacagctcactccggctagccagccagcttaggtgctcggtccatttcagcgccatcgatccatcatcagtgcgtcggccactactgagctcggccatggcgggggcgcagctgcggcgcgtggtggccgtggtcctcctggcctgctgctgcggcatggcgccggcggcgacggcgagggggatgtcggcggggatngcgcacaacatcacgtccttcctcaacgggcaaccgggagtacaaagcagtacaaccagttcctgacggagacgcggggtgtgcgacgagattaacgcncgcgcgggggtcaacggtncttggtcctccgggacggggccaatntcacncctngtgttccgacgccngg

SEQ ID NO: 79704 - DNA, 478 bp, Triticum aestivum
  unsure (1)..(478): unsure at all n locations
  Clone ID: PAT_TA_79704
ggccgcctgccgcgccgactccgccgccatcatcggcgtctctccttctccgtgttgtcagtgagaggctggcatttgacaatactccgtgtgtgcgttgactgttgctgcaatcaacgcaatattgattctgttccgtcatccatcatccccgctgcattattgattcagttctgtctgctggcgagactttgaagttgacactatgcagaacatcaaccggatcttgatctccaacaccaccacgtcgatgctctgcgtcatgtttggaccccaaggttgggcagacttgccagatgtgctattgtgttccatcatggncctgttgggttcaagccgtgaccttcttgcattcatcgncacctgccccaanttgggcntgccggcgttcatgtcaatgaaanccctgccttagaanatgattntcccnncctgttattttccgggaattggtgcccnaaccaaaacnaagncccaa

SEQ ID NO: 79705 - DNA, 552 bp, Triticum aestivum
  unsure (1)..(552): unsure at all n locations
  Clone ID: PAT_TA_79705
cgccatcaatggggtggtgaggaccattcatagcttgatgcgttcggcgggggagagcagtggacggcccacggtcgccggttgcgggagaaggcgaggaagaggacctgaggtgagccgcctctggtccgatgtgcgaggcgcctaccgagtgcctccccagcttaacggtcccaaacccaagcgattagatacgaagtctactcagcaggaggagcatgaacagttgtgaaggaggaccccactgccttggaccaggttgctgaaacagaagcagaaggtgcgaggggcattgttcagggctttttttgtacagttgctcatacttatcaatgtggaagctacatatattagaggcacttattacatcgcgtcggatgcaagttgttgttctgctagctggtacctcttatgaaataccaagtgtttgatcagcacttgaggcatgtagctngcgcgctttattttcattgggattaatttgaaattgcttacaacaatatgttcatgtgggtaaccaaaggtgttcctccctancacaaatttgaattt

SEQ ID NO: 79706 - DNA, 471 bp, Triticum aestivum
  unsure (1)..(471): unsure at all n locations
  Clone ID: PAT_TA_79706
gcggggaggaggggcaggggcgcgcggatgcggccatggcggtggggcggcgccatacgatgcggatcaagaccgggatgatgagttcggaaaggcangaggtggataagagtggcggcaatcnacgatngacgacgattatntttgtgacgaaaaccacggcnatngcgaatatacgggctaccacagctcgattcggtgctcgggacggacgaagtccatagcggcggttctcctggacgtcttctcacnaagcgggtttggacggtggttgtggctaccaagaccggcatggagaccacnaactttggcgcctccaaatcaaccatntttagccaagaaaacaagaagnatgaagctagggntttttctaccggggttggagatggtcntaaccccccccaagtttcccttttgcnccaaacgtcattcaatcccaacccccaatggngcccatggattgttnccaac

SEQ ID NO: 79707 - DNA, 627 bp, Triticum aestivum
  unsure (1)..(627): unsure at all n locations
  Clone ID: PAT_TA_79707
tcgacgagccgacccgcaatgcctccagggggaggaggaggagcaacgggcgaacaaagattcggggagcaggacctcccaccggcgactggccacgggtgccgcgacgaggggcccccatcccgttcgccgtcgccgctgacgccgttgctgcctggcctggccgtcacccccgtcgcctctgagaacaaagatcaaggcgggaagggattgggcaancaagggggaangaaggaanacccgggcgagctttcccggggggacgtttctcatccgangatcctggtcgcggggttgcccctaacatctcgcctcnttccaatttcaaagttgcgttgtccaaaaacaaatgggctcgcccctcctggctctgccccccnacgttccgacaaagagggtcccccgcaanaaccttgtctngggctttctttcaacttcaatctccgggtngggcgttttcccaaaaaattttgtnccggggaaaanattctcccaatccgtngaactnccaaatctccgttttccttancgccgggaagctacaaattttttcaagtaatccaancaattgcaagcaacaagccntcctccttttgcaaaatntttggnaaatccntctanncctag

SEQ ID NO: 79708 - DNA, 547 bp, Triticum aestivum
  unsure (1)..(547): unsure at all n locations
  Clone ID: PAT_TA_79708
cgacgtgctccgggcgctctgcgccgaggcgggctacgtcgtcgacgacgaaggcaacgtcacgcgctgccccgagcgttccccgggcgtcggcgcaagcggcagctccgaccatctgcagccgtcctcacacagcggggcgacggaggcaacagcgggggacatccaccaggcgctgcttgagccggaggcggagccgaagcacaagatatccctcgagctgaccctctccttctcctacatgtagccaccttagatcgatcatcaccctctgcgtcacgaattaacacttaattaggttcgacagttgaaagttctataaaagaatgtatgttgtggaatgtggagccatccgttgttgcaaaagcaacccctgtctgagcggtgcgtgttcatctggtagcactgggaanaacttgttctcccgccgggcgtntgttttgttatcnggncaacccgtttntgttccccaantgngttttttttttttaaatttctggtccaaaaaaaaaaaaaaaaaaaaactccaggggggggcccggtnncc

SEQ ID NO: 79709 - DNA, 565 bp, Triticum aestivum
  unsure (1)..(565): unsure at all n locations
  Clone ID: PAT_TA_79709
gcagtctggctctctccatcccaatcccgacctaccgcccgctcccgcaagccatggacgccacggccaccggcgccaaggggaagaagggcgccgccgggcgcaaggccggcgggcccaggaagaagtcggtgacccggtccgtgaaggccgggctccagttccccgtcggtcgcatcgggcggtacctcaagaagggccgctacgcccagcgcgtcggcaccggcgcccccgtctacctcgccgccgtcctcgagtacctcgccgccgagctgctggagctcgccggcaacgccgccaaggacaacaagaagagccgcatcatcccgcgccacctgctgctcgccgtccggaacgacgaggagctcggcaagctgctggccggcgtcaccatcgcgcacggnggcgtcatccccaagatnaancccgtgctgctcccaanaagaacggcgganaaagagggccaaggcgncccaaagtcccccaaagaaaggccgccaagtcncccaaagaaaggccgccaaccccnaaagaaaacttnagaanaatgcgctctcttgtcgtc

SEQ ID NO: 79710 - DNA, 591 bp, Triticum aestivum
  unsure (1)..(591): unsure at all n locations
  Clone ID: PAT_TA_79710
gccgtcaaccacgtccacgccctcgccatcctcgtcgccaccttccactacgagaagcagccgcccgcgctcgaccaggacaccttcgcggactacacggcgcggacgtccttcgagcgcccgctgctgagcggggtggcgtacgcgcagcgggtgatgcacgccgacagggaggccttcgagcggcaacaaggctggatcatcaagaccatgaagcacgagccctccccgccgcaaggacaantacncgccggtcatctactcccanggagaagggttcctacatcgaagggctcnaaattattntcccgcgaaggaaggacccggaagaaaatccttgaaggttcaangggccancgnggaaaggccttcctcaacnagggcaattcagggtcaattttcaaaaccaccttgggggggtnggggcttnacgttttcccttgttctaacntttttnnaaccnttccccccggntggcnaaaaggnggggggggtttttttttncttctacccccgggnnaaaatttggngggggngctttttttttnantccacctttntgggnaaaatttttttggggnncgaacnttt

SEQ ID NO: 79711 - DNA, 480 bp, Triticum aestivum
  unsure (1)..(480): unsure at all n locations
  Clone ID: PAT_TA_79711
ggaactgtccagcaattgctggctatttcattgatttaaagcagggagaacatggtgataacagaaaagtgcgtggcggtcagggaccaaggagaaaactgaaaaagaaacaaaaaagagaaagagggtcactaataacctactatctcatggtggctccccgaaggggatctcaatgcagttggctcccgccaacctccataattccagtgagtttctcaagttctctcacaatggcagaggtggaggatatcttgttttgaaaagtgcatctattcctctcttgccaaatctcccaacatgttgcaaaggagcaatgtttttgctccnttccgctccgttggtgaacgtccctgttgaataattctctgaaaatcaccaaaaggcttccttctggtgccantcatccgtcggcgtgnaaggnggggcaaccgttgccaagatgccaacccgttgccaaaactttccaaaaactccaag

SEQ ID NO: 79712 - DNA, 586 bp, Triticum aestivum
  unsure (1)..(586): unsure at all n locations
  Clone ID: PAT_TA_79712
gataagagtgaccccaaaagattctaatggagctgctggaaagcatcatttgaggggcaccttgattttgtttggtgctttcagcagctatgcactttggtaccctatacaggtgaaagttttgaaggtgtatccatggaaacattggtcctctgtgctgacctgtgttctgggtggtgtgcaaactttcgccatcggaataattatgagcaggcacaaacttgcctggcaaataggatggaacattcaactactaaccattgtctactcagctgcacttggcacagcggccaagtattggctgaacttatatgctgttgaaaagcgggggccagtttttccagcccatgttcaacaaccttatcgacgatctcatcataanttctagggaacgctgtttcctaagganaaaagccccaacantttggggaanctttgatgggtaattgcncaagttanaagganggtccaatacaaaataacctctatggaaanggcaatgaacaaanacccgaaanncgggatccggttaaaagggatnccaanaangggggngggaacaaacgannttccaanccggtnctgg

SEQ ID NO: 79713 - DNA, 459 bp, Triticum aestivum
  unsure (1)..(459): unsure at all n locations
  Clone ID: PAT_TA_79713
ggagagaactagtctcgagttttttttttttttttttggtccaatataaccaaccatccattatccatcatctttggggggtgtacnatgtctcnaccaagcgttattcgtccgaccganacncgttattcttttttccaatctccatcaaattcaagctgggcaatcatcaaaaagaaaaggaaaaacgggtatagcgacaacgcgaatgcaaaatctctctcttctcactcancaacccgcggtgcggggcacanaccctgccctggatgagggtccggcacnacggggcactccttcatcccctgcttgtcnnggagggtccgtttgcactttggcgcaaaaccacctggttggggcgcangggggaaggaanaaccaaccggacattccccctncgcctcaangnaacatgaacgccaccnccccggtcccccccttggntttnctttccaaagt

SEQ ID NO: 79714 - DNA, 610 bp, Triticum aestivum
  unsure (1)..(610): unsure at all n locations
  Clone ID: PAT_TA_79714
gccaccccacaagagaaccaccacagcacctcgccgccgccgccgccgctgccgaggtcgacgacgacgatgtggcgttcgcgagctcgcgctctcctcctgctccgctcgtccgtccccagatcgccaccgccgcagcaaaatccacttcggagcctggcccgagccccacccccgccaccacgccttctctcccgcttcctctcttcctcctccccggaggccctgccggacgccccctcctcctctgcggaggccctcccggatgaccccttcgccttcccgcccggcgccatatccggatnggctgatccaccgaaggccgacgaaggacaacctggccgcgctctgggaagangattgcgggcgaacgcccangaaattntcgttctcaacngcctcctccgaaaacggccgatttccgaaagccaanggaacnagganggtcgccccggggttcgcnnccgttcttgggaantcaaaccccgggngggacaaaatttcccaacggccaatcngccgnaaattggnncgttgaacttnnaacgaagnccggctccttnaanggggcnantcccncctccccngcccganaaaattgntcttgnng

SEQ ID NO: 79715 - DNA, 329 bp, Triticum aestivum
  unsure (1)..(329): unsure at all n locations
  Clone ID: PAT_TA_79715
ctcngcgccatcctcctcctgctcccccgcccatccggcgatccnccanccacctgatcggccgcctcccccatcccctcctanacnacgcaaccccagcccaggccccgccgcgcgcctcnccgcaatgcctggcctcgccgccgccgagcaggacgncgtctcgctggtgcnccgcgtcgcccgggccctcaaccgccggatctccgacctcgtcnccttgctcttccgcnacaagancgtggggtccttcnagcgcngtcgtttggcttcgccatcgccgtcgttcttcgtttgganagtttccttgcgcgtcctcctcgnacgcc

SEQ ID NO: 79716 - DNA, 491 bp, Triticum aestivum
  unsure (1)..(491): unsure at all n locations
  Clone ID: PAT_TA_79716
ggaactgtgcagagcctgaggatgatgtaggccgctgcgccacctctcttgtcatcctggtcactgcctaactaatttctttgattcagaggcttgtgccactacaggcgttgcatggcaatccgcgcttctacgagcaacaacaaaaacagggcgaaacaaagcaagcacaaaagaagaattgagatgctacatacaaccaatggtatccttttaacgccgccgccgggggtccttcccctgagccaggatctcttctaccctgcaccgctgctgtgaactcatccatgctgatagtccggctccatgctacaactgctgcaagcctggaagacatgtncagggaccaaagcaaggaaaattagaaatgggttnagtgcgctatgcctttgaangangacccaaaaaagttangaaaagaggnngaatggttcaattancgttgaaanaccaacnaagggaancnactttccaatngacaaatntccnaa

SEQ ID NO: 79717 - DNA, 607 bp, Triticum aestivum
  unsure (1)..(607): unsure at all n locations
  Clone ID: PAT_TA_79717
cagctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaanacagtgaggagggtccgtgttcgcggaggtaacgtgaagtggagggctctccgtctggacactggtaacttctcatggggtanttgaggctgtgacccgcaagaccccgtctcctggatgttgtttacaattcgtcaaacaatgagcttgtgaggactcagacccttgtcaagaatgccattgttgcaagtttgatgctgcccccnttcaagcanttggtacctggactcaattaatgggagntggaaaatccngttagggaaaaaaanaaaacctgctgcangctgcccaaaaaaagggatgccnncctgaagggaaaaagaagtcctgaaggnttgctggctgccgnccacnancagggaacccaacanaaacagccnacaaatnttcaaaanggaaancttnaanaaacccccang

SEQ ID NO: 79718 - DNA, 549 bp, Triticum aestivum
  unsure (1)..(549): unsure at all n locations
  Clone ID: PAT_TA_79718
cccatccagcgcaaccgccgccaacaccactcctcgagagtcctcgccgccggagaagcagcaagcaagatggccggaaggaagggcggcgacaggaagaaggcggtgaccaggtccgtcaaggccgggctccagttcccggtcggccgcatcgggcgctacctcaagaagggccgctacgcgcagcgcgtcggctccggcgcccccgtctacctcgccgccgtcctcgagtacctcgccgccgaggtcctggagctcgccggcaacgcggccaaggacaacaaagaagacccgcatcatcccgcgccacctgctgctcgctnttccgcaaacgatnaggaactcgggaaaagcttgctcnccgggcgtcaccatcgcccacgggnggtgntgattccccaaacaatcaactcccgttgcttgcttccccaaanaaagttccccctggccgnccgccggannaaaggaggggccaaanttccccccaaaaaaanaaaanaaggggccggccaaaattcccccnaaananaaaanaacggnccgcccaac

SEQ ID NO: 79719 - DNA, 600 bp, Triticum aestivum
  unsure (1)..(600): unsure at all n locations
  Clone ID: PAT_TA_79719
tcctccaccgtcagccagggtgcaactgagagctgcatctcccagtgacgaagacatgctcttctcaaattttgccagatgttgttatactttgtgttgtcgaggtagctccgagtatatgaagcgtcacatctctttacaattttctgtcgatgccaattgacgacagccaaaactgctgcactgagacgtgctgactgcagaagacactatgtgatgctcgactacggggggaagtaagcaaagtaaactctgctcccctgcttcactctggttgaaaagtcatgcaaagcatggcaatcagtattaattaacgtttttgtctcaatgtaattgcttgggttgggactcagtttgggctcacatgggatgcctnctaaaggagtgctccntggtaagtagtngattcccaaagggggcanattcaacnttnccccaantccccaacntaaaggtanttccgggncaaaaanaaccccttaantccntgttaaatgttttggacaaanaaatctcnnttagccaaatccaaaactgggccccaaananaaagnattctgaaagttggggnnngggccccggttttttnaaaaaggnngg

SEQ ID NO: 79720 - DNA, 435 bp, Triticum aestivum
  unsure (1)..(435): unsure at all n locations
  Clone ID: PAT_TA_79720
nggacaacttgtcagctgtctactaaaaaaggtttgttcgtcttcaatgaggtaggggtgataaccgcggcatatgtcctcaactcgctctaatgcttatagtggacgctatgtggtctacaaaacagagaaggttcttgtaaggcggctaaggaccaattanagaanatttttccgtggcnttnaatgaatttttctcataagttcttgtanatangtaacnaaaaagatgaacttcgtcacagtttgaagataagtaggtttctccnttggccantccaaatgngacnttccantcnaggatccgagagttgttggggcacggggncgatttgaaccgggccataacttcccatcgtatcgtcgttanctagaaanccncccaanacctctctncccccctcttnngtggtcccnccnaaaaaggcncgcaaa

SEQ ID NO: 79721 - DNA, 185 bp, Triticum aestivum
  Clone ID: PAT_TA_79721
cgggatgcaactcgtcggggagcacgtacatggtgctgttcggcctaatgcagctgctgctctcccagcttcccagcctccacaacatcgcctggctctccgtcgtcgccgtcgccacctccttcggttactccttcatcagcctcggcctctgccgccgccaagtgggcctcccatggagacgt

SEQ ID NO: 79722 - DNA, 286 bp, Triticum aestivum
  unsure (1)..(286): unsure at all n locations
  Clone ID: PAT_TA_79722
cgcgagcctcacactctctgatcacagtaggactagcttcagctagcctgcagcgtctgccactccgggcattttcttgcatcaaccacggcaatggccaccgctgatgtccagaacccgacggccgcgctgacggaggaggcgcccgcggtggagacgcccgtcgccgccgaggaggttgctaagacagaggaggtccccncgccggtngangccgaagtcnaggcgcctgcccccgtcgaggttgnaggcgaacaaggaggacgcaccggccggccgcccgaaa

SEQ ID NO: 79723 - DNA, 516 bp, Triticum aestivum
  unsure (1)..(516): unsure at all n locations
  Clone ID: PAT_TA_79723
gatccagtccccctccgatctcaccgagaaatcgacgcgaaggctctctgcccgtcctcaagatgcagatctttgtgaagaccctcaccggcaagaccatcaccctcgaggtcgagtcgtcggacaccatcgacaatgtcaaggccaaaatccaggacaaggagggcatccctccggaccagcagcgtctcatcttcgctggcaagcagcttgaggatggccgcacccttgctgactacaacatccagaaggagtccaccctccacctggtgctcaggctccgtggtggcatgcanattttgtgaagaacctcaacgggcaaagacaatcaacccttgaggtcgagtcctccggacaactatcgacaaacgtcaanggctaagatcaagacaaaggaggggcatccctcccggacaacannntctcaatccttcgctngnaaacaactcnaaggattggccgcanccccttgctgacttanaanatncaaaaaggggtnccncccnccaacttggt

SEQ ID NO: 79724 - DNA, 633 bp, Triticum aestivum
  unsure (1)..(633): unsure at all n locations
  Clone ID: PAT_TA_79724
gcatagctatacccatcagcttccgcgccgggcgccggcctcgtaaccatgaagctcatgccgaccgtcttctgccttctcctcgtcgtccttgcattggatggggctcgtgtggaggcacgaggcacaccttcggctgatcaggggtcaaagaaccaatggtccagcatgttcgtcttcggcgatggcttcgtcgacaacggcaacctcccaaagaccgatacatggcgtcaatggagctatccctacggctcctatctcaactccccgtggatctgcgactcctgttccaactgggacgcctttccaactattgggattcaatcctgacttcaattgcaaaggatnttggggcctcaattgaaancccctncaatccgttacaaggctcaacgnccanaatctaatcttggtgaancccaatccggggaaagaanccttttggcttttcnggggggggcctnggngttctaanaaaaggtaacccgggnnaaaaaaagggggccgaancccnttgccaanaaaaaggtcaaatggcttttaaanaaaggntaaanncaaatggctngggggttnttccnaaaaaaaaaangttttaaaaacccnggtcccncccggtcccaaattccnggn

SEQ ID NO: 79725 - DNA, 301 bp, Triticum aestivum
  unsure (1)..(301): unsure at all n locations
  Clone ID: PAT_TA_79725
ggagctacaagcggcacgagacgacgagcgactacgcaacgacgagtgctacaaccgcgttgcgagatgttggggccaacactcaattgtgctactaccaacgttttggtttgatggaaccaacaattcaattttcttttttgctaccatcatattttagtttgctggaaccatcatcattatttgctcccaccggtgttttgggtttgtttggaatttggagcaactgcaaattttgtnatttttgcttccaccaagcggttctattttgctggaaaccagcttcattttttgccaaaac

SEQ ID NO: 79726 - DNA, 644 bp, Triticum aestivum
  unsure (1)..(644): unsure at all n locations
  Clone ID: PAT_TA_79726
tttgtttcttcaaaccattttttcttagcataagctgaaatactctaagcatatgatagttctaagttctctaatgtgcattctgatgagatctaggatgtgcctgaatgcatttgtctaatttgctgccttactgcggtccaatatgacaacctgaactacaaaatgaagttaatgccttctattagctttttgaaattgtaggtcatctgttaagtaaggaaccagtacttcccgacaaattgcttcttaagttttaagtgatggtccctccacaatgtnatttacaattttggttgcataaagaagctancccaagnctaaacaattggatcgaccgttnanggttttgagaaaaataaaaacctaataatgcccttaaaattangttaatnaaggtttgaagggctaaaaaagttnaaanggtnttttgnaaataaaantggggcnnccggtttttaagntttaaatggaangcccttggatttaaaggttttgggtttggcccctnaatnccnattttggtgggaaaattgggctaaaaaaaatttgaaagggctantgggcccttgcaattanccctttgggtaanggtttgaaatggggtttcnaattttggcaanccaaaaaaaanttttttgggn

SEQ ID NO: 79727 - DNA, 625 bp, Triticum aestivum
  unsure (1)..(625): unsure at all n locations
  Clone ID: PAT_TA_79727
ggtcncatccatgggttggcgttggcacnacgacggcgagggcgaccgtggccgcngcgggctcggcgacatccccgacctcgccggccgaggcggnggcgagggggcgcacntcggcacgcgccgggtggtgcagtcccgctgccacacggangaggtgnancccggtcgcttcgtccgcaagtgcgagaanaccgancancttcctccgcgactgcgtcggcaggccttctgaattgggtgggagtcgaaaactgagaacacccnaagaagatttcacagntttaaaatgacccgtggtgccctcgccgttcctncttgggcntccccaaacaaaaaagangcccttttgccatttccaaggaactttcccangtcgacnattaagaatccctattngataaaaggnctttcggntaagcctttcctgggaatnaaaagctttannccggatnaccaaaccaaaantcctncaaactctttttgggntttncnaacccaagtccatcnaancngggaatncccaaaacnaatttccntanggcanaccctgcatantagggtaaattggnggaaagggtncttnccanagaanccccaacttganaaatngattcctcaaaat

SEQ ID NO: 79728 - DNA, 467 bp, Triticum aestivum
  unsure (1)..(467): unsure at all n locations
  Clone ID: PAT_TA_79728
ggagcaggctangcgggggaggggggttcatctaaggcaagagcatgganagaacccaaatctgagcgggaggctggagtttctggtacaagaggaggcgccgggacgggcgggaatccancgccgggccgcaacgggcaccgcctctgtcatctcgcgccgcgggccattgtacggatctagcacaggccagattatgtccgcggacagctcngtcacngggaagggctgtgccatggcacaagtcnttatccaaggaagcgtggaaatccaaaagccgtcaaacccntcngcggtggcccccgtcattgcggggttgctctttggatctttgangggaaccaaagggcggcgtccnaagaacngcnttgcgggtgttggttanaaatgggagggaaaaacgaaccttggaagtttcnttgctaaaattttgggtgggacaaaattccccaaccttcnaaaaaaaa

SEQ ID NO: 79729 - DNA, 262 bp, Triticum aestivum
  unsure (1)..(262): unsure at all n locations
  Clone ID: PAT_TA_79729
gcatgggttggcttctcctccccactcantcctcggttcccggtccggttcggttccgttcggttcgttagggtttagtagcggggaagaggaaggcatggcngacgtcaantatcgctgcttcntgggcggcntcncctgngccaccgacgaccaagtncctccataacgccttctccaagtncggcgacgtcatcgncctccantatcaacaccgncnggnatacnggnccgttcccnccggttcgggttcntcaccttc

SEQ ID NO: 79730 - DNA, 492 bp, Triticum aestivum
  unsure (1)..(492): unsure at all n locations
  Clone ID: PAT_TA_79730
ggcctgatcaatgctgcggtcggcgcctggggggtggaagatctggaggttgtcgtcaggcaatcatccggttatgatcaaacgcggacatacaacttcccccacaactgcctcaacctcccgtcttgccttcgcagactgaccttgggcaagtattgtgcactgccaccgctgcacaactacaacacgcttaccaagcttgtactgcgtgacatgtcggcttccacgcccgtgaacatgtatgagagggtgttcagagactgcatcgggctgcaggtgcttcacctcacgtcctgctgctgtgcacttaccactctggggaacctcgtcatccgattttactgggcggagaanatgggatacaanccaanccctccgggaaanggaatttgcccgcaaccctgaaaaaggntcctaagtcccccgaacgttgnccttcaaaatttgggaataatctcaatggggacnaaattgggcctncctcaatgggcc

SEQ ID NO: 79731 - DNA, 634 bp, Triticum aestivum
  unsure (1)..(634): unsure at all n locations
  Clone ID: PAT_TA_79731
ggcgagaccaaaccaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcaaggggtagtgaggctgtgaccccgcaagaacccgtctcctgggatgtggtttacaattcgtcaaaacaaatgagctttgtgaaggactcaaaacccnttgtcaaanaatgccaattgttgcaaagtttgattgcttgcccccctttcaaagcaantggtaaccttgaactcaattatnggggttccnaaatccggttaggaaaaaaaaaaagcttgcttgcaaacttgccaaaaaaagggaanctngcttaanggggcaaaaaaggcttaanggtttcctgcctncctnccccaanagggaagccaaangaaaaagcaaccaattntccaaaanggaaactttgaaaaacccccac

SEQ ID NO: 79732 - DNA, 578 bp, Triticum aestivum
  unsure (1)..(578): unsure at all n locations
  Clone ID: PAT_TA_79732
gatctccctcccaaccaatccaccaaggaaaccccgatggcccgcacgaagcagacggcgaggaagtccaccggcggcaaggcgccgcggaagcagctggccaccaaggcggcgcgcaagtcggcgccggccaccggcggcgtcaagaagccgcaccgcttccgcccgggcaccgtggcgctccgggagatccgcaagtaccaaaagagcacggagctgctcatccgcaagctgcccttccaacgcctcgtgcgggagatcgcgcaggacttcaagaccgacctccgcttccagaagctccgccgtctccgcgctgcaagagggcgccgaaggctaactcgttggggctcttcngaggacacaaactctgcgccatccangccaagcgcgtcacatcatgccaaaggaaatcaactcgccccgcgcaatccggggaaananggcctaaaattntgtcnggtcctaactgcaaggnntaaaaattaaaattgtttccgtnggggaatttgatntgggaattgnggtaaggaaaattccccgttccgggcnatntttagggtngttttggaaggntacca

SEQ ID NO: 79733 - DNA, 585 bp, Triticum aestivum
  unsure (1)..(585): unsure at all n locations
  Clone ID: PAT_TA_79733
cgaacggaaccaacaaatccccagccaatctcgtctccgatcgaccccaggctcgtcgaatcctcctcccccaccgcctcaagatgcagatcttcgtgaagaccctcacaggcaagaccattacccttgaggttgagagctccgacaccattgacaatgtcaaggccaagatccaggacaaggagggcattcctccggaccagcagcgtctcatcttcgctggcaagcagctggaggatggtcgcaccctcgctgactacaacatccagaaggagtccacccttcaccttgtcctccgccttcggggaggcatgcagatcttcgtcaaagacctcaacgggnaaagaccatcacgctttgaggtggagtcatcngacaccatccgacaatgttaagggccaaagatncaaaggacaaagggaggggcatcccccccgggaccaagcaaacggcctttatccttttgcttgggcaaagcaagcctgggagggattgggtccgcanccccttgcntgaactaacaaanatcccaaaaaagggngtccancccctttaaccttnttccncccgttcttccgggggagg

SEQ ID NO: 79734 - DNA, 586 bp, Triticum aestivum
  unsure (1)..(586): unsure at all n locations
  Clone ID: PAT_TA_79734
aataaataaaaagctcatcgcgatctccgtccaactcctcccccaaatcacactcgccggagtgctccgccgtgtaatctagtcccccccttcccaatccctcgcctgattcgagcgcgcggacgggaggattgcttcgatgcaccggcgtcggcgcgagcggtcgggcaggcggtggccggagctttgcgccggcggccgcctgagatggggaggaagatggaggccaggcgtcggcgtgtgccccttcttcccgcgcggtgcaacaaacgatggccggaagggggtgggtggagcgggaggacggcggccagtcggaccatcatgaagcatgatcacacccatgaccctggtgtttcctccgtaagcattttttgcgaanggganatggatctctaaaagtaaaaagttgctgacatatgccgggatgaanggactactctcctatcanttggnatgtctcaatggctttgcctttcaaaaattttgcacanaattggaanaaaaaaattgctaattttttctggctgccgccctcgtttatggaccacntccaatgttntccaacctgcaatgaagtgttant

SEQ ID NO: 79735 - DNA, 320 bp, Triticum aestivum
  Clone ID: PAT_TA_79735
ccgccgccggaggaaagataggtagctgggggtcgaccctccgccgccggcgacccggggcggccgccccagctcgccccaatggtgggtccgccactggccaccaagtatcagctgcgcgagatggcggaggaagggcagggcctgcagatgctggaggataggaagaaggagcgccagatgcagcagttgcaagccgccgccgccggcgccgccgacgaccacaagacctagacatcgttaatttctttttctcaaccgtgttttttttttttacttttctggattctccgatcagctatgttttgtgaattgtggtt

SEQ ID NO: 79736 - DNA, 574 bp, Triticum aestivum
  unsure (1)..(574): unsure at all n locations
  Clone ID: PAT_TA_79736
accaacgctaactaaaccactccgatcgtgtcttcttcttcctgccgccaccttctccatcaatcaactctgaaccactccacctataaatcaatcacggatcgatcacaagaacaacaggcacaaaccaaggcaaccaccacctacagagagcagctatcatcctcttcaaggaagaaagaggagcaagaaatggcggcgagggcggtgacnatctggcagcggnggngctcgtcgtcgtngcggcggtcctgtcgncngcgcgtccgcgcantcnacgagcgggtgcacgcanactctcatccngcatgtccccctgcctcaactantcacggggaacgaaacngcgccatccaaatcgttctggctcgcanntcgccaaccgtggtgaagctccaaagcccggagttgcctctngcgtggcgctcaaagccgaancccgccgcgctncgggctccnggaacgtttaanaanaacccgcgccctnngcctccccgaacaagtggnggggtnatnatcccgccggntcaaaaaactnggccttcgcccccaanaaagtttgccgttctnccgg

SEQ ID NO: 79737 - DNA, 208 bp, Triticum aestivum
  unsure (1)..(208): unsure at all n locations
  Clone ID: PAT_TA_79737
gatggcgcagggtgtagcccaggatcattttactagcaacaccactgctacatgccatgactcttagaaaaattactccacacagaagcagaaacttccaaagtcaaattcaaaatgatgaacatttccttttataaaaaaaaaaaaaaaaaaaaaaaaaaaaaaaaaaaaaaaaaaaaaaaaaaaaaaaaaaaaaaaaaaaanaaaa

SEQ ID NO: 79738 - DNA, 277 bp, Triticum aestivum
  unsure (1)..(277): unsure at all n locations
  Clone ID: PAT_TA_79738
gcctcgtgccgaattcattgattaactgacaatgttaaatgagtggagatcttgttcgaaaaaaaatgagtggagatcaccttcagtctaaagggatctcaaggaagctgcgttgggcatttcgtcggttgacttgagtttgaggatatgcctacatcgtgcattgtttttttcttttttgcggggttacatcgtgcattgttgctagtcactaacaatgggttaattaagtcgagcggatctctcatcanaaaaaaaaaaaaaaaaaaaaaaaaaa

SEQ ID NO: 79739 - DNA, 634 bp, Triticum aestivum
  unsure (1)..(634): unsure at all n locations
  Clone ID: PAT_TA_79739
gccgagtgcgacccactgccgcttccactcccactccgttcccactcgcgcccgccctttccccactcgcgccagccagccagccatcgcccgccccgcccgcttgcttccccgacttgtctactcccaccaccatcagcgccatttccccctctgactcgatcctctatccctccctctgctttcgctttcgcctttgcgccggcgtgcgcacttatctgctggcggggtccggacggcgaaggggggtgcgagtcggggcgtccatccaaagccaagctcccgagcaagaaccggtcgtgtccctggctttgctancggtggtaagtgggtcgccgggganccgggngcaaaangctctgcttgttnctgaactcgccgccctcccacgcgaanggaaancggnanttggtgggggggtccaatgcctccttcctttttccgncggcctngggaaacgggnaagganccccccccgggtggccggttgctgggcctttctnccccnaanggggccttgcggggnttcttgcttccgccccgggggggggggggcncccccccccccccggccgggggccncggtcnaaagggggccatntnataaccccncnggggattanaaaactnaann

SEQ ID NO: 79740 - DNA, 496 bp, Triticum aestivum
  unsure (1)..(496): unsure at all n locations
  Clone ID: PAT_TA_79740
ggttatatatttcatgaccaggaacgtgtcattgtcggagcatgttctgagtttgacgaccgtttcctaacgtgccaacaagcacatgtaccattgttctttttttttgtcgcccaaatagctcttgcgtggctcgcagccggctttgtgctgatcatcatgatgccataccgccattcctctgttgtgagctcgggctcgcagttgagacatcgtagcagcaccttgacagccacatcccgcccattcgatcggccagcctctctggcaaggtttcatcacgaaatgacattcgtggaagacatggcagaaaaacaaaaatgatgcttcaaaagcttttggagcatcgtttttgtcaccacgtttttcacgaatgtcatccgatgtggaaactttgcaagcaatcaaaaatttgtcaatgtttgctaaaagaaaattcatatantttttggttgattttacgggttaacaaaagctcccaangagctccagntca

SEQ ID NO: 79741 - DNA, 550 bp, Triticum aestivum
  unsure (1)..(550): unsure at all n locations
  Clone ID: PAT_TA_79741
gatggcctccacntgcatgctcaagctccgtggtggcatgcanatcttcgtcaagaccctcacgggcaagaccatcacactggaggttgagtcctcggacaccatcgataacgtgaaggccaagatccaggacaaggagggcatccctccggaccagcagcgcctgatctttgctggcaagcagcttgaggatggccgtaccctggctgactacaacatccagaaggagtccacccttcacctggtgctgaggctccgtggtggcatgcagatatttgtgaagaccctcacccggcaagaccatcaccctggaggtggagtcatctgacaccatcgacaacgtcaaaggcgaagatcaagacaagganggcattcccccggaccancagcgtcttatctttgctgggaaacaactccgaaggatnggcgcacccttngcgggctacaacatccaagaaaagagtccaccctccaacttggtgctcaaggctccgttggnggtatgcanatttttntcaananccctgaccggggaaaaacnacancctgg

SEQ ID NO: 79742 - DNA, 582 bp, Triticum aestivum
  unsure (1)..(582): unsure at all n locations
  Clone ID: PAT_TA_79742
aaagtgttctgagaatccttttgcactactgactacattcaacgaagttgacatgaccaatttgtagtcagtccgcagcttggtgtcaaattgggtctgatgtcctgctttgttaaggctgctgtttctgcgcttcaaaatcagccaattgttaatgctgttattgatggcgatgacatcatctacagagactacattgatgttagtgttgctgttggcacttccaagggtcttgtggtgccagttatccgtgatacggaaggaatgaactttgctgacattgagaaggggataaacagccttgcaaagaaggcaactgagggggcattatcaattgatgagatggcaggggggaaccttcacaatctcaaaccggcggtgtcctatgggnagttcttatcagcacacctatcaatcaaacccctccanangtcagcaaattccttggaatgcaattcctattgtccaaacgcccctggtggttgttggatgggctccaatccnttgcnaaggccaattgatnttncttncactngacatatgaccaatanggctnaataaaatnggaaaaaaaacnttcct

SEQ ID NO: 79743 - DNA, 601 bp, Triticum aestivum
  unsure (1)..(601): unsure at all n locations
  Clone ID: PAT_TA_79743
ttctgacccagctccagagttccccacgaagcgagcgtgcgcgacctgaccgaattccccccgccccgccccaccccaaaccctagcccgcccgcccgtccgcccgccgggcccccggcgccgatgccgaggcggctcctggagggcgccatggcgctggcggtggcgccggacgccgccaactcgtcgggctccggngccgcccccgggtccgggtcggggcccctgtggtgggtgttcgactgccacggggcctggtaaancctggcgggtgatgctgccgtcgcctggcccttcgtcgggttcctnggcntgataagccccgtcngcannttccgccgcctcaanttaaggccgctcccaacgttcgtcgtcgttgccctaantancgcggctcntctngggccgtncgccccncctcaaacttccctctggtgcttcctccancccgttggnaattgntatgnccttaananggncctttcnncnattggaatngtgncttcactntttttacaaantttggnaatgttanttcttggggaatttnttcttaaataccaattttctacttncaaggnaaaatgatagccaagttgtt

SEQ ID NO: 79744 - DNA, 551 bp, Triticum aestivum
  unsure (1)..(551): unsure at all n locations
  Clone ID: PAT_TA_79744
gatggattctcgactcctacaacggtcagtacaatgcagtttttggtgatgccatcttctttgagtggagtccccacaacctcatggaaccagggcaactgtatgagtatgctcggcgccctgttacctacaggctcgaacaacctgatgttcctcagatacagccaccgacaggatttgttggtcttcccccaccactccaccctacggacgacgattggttctcaagagagtgtccgtggcaggaggaggtcacccgtcagtaccgtttcgaacctccgaatcaattaatctgagattggtgaccgtagcttctttgccataaggaaattttttgggaattttggcgttagagcanggacccgttagtttgttgcaagcttatgttgaagctttgcttggggctggaaggcctgttaactccggttgaaactattacttaattgcccaactgtgggtantttgtttcaaaaaaaaaaaaaaaaaaccgaagggggggcccggtaacccaaattcccccaatagtggagtccctattaacccccccncan

SEQ ID NO: 79745 - DNA, 608 bp, Triticum aestivum
  unsure (1)..(608): unsure at all n locations
  Clone ID: PAT_TA_79745
gaatctccctcccaaccaatccaccaaggaaaccccgatggcccgcacgaagcagacggcgaggaagtccaccggcggcaaggcgccgcggaagcagctggccaccaaggcggcgcgcaagtcggcgccggccaccggcggcgtcaagaagccgcaccgcttccgcccgggcaccgtggcgctccgggagatccgcaagtaccagaagagcacggagctgctcatccgcaagctgcccttccagcgcctcgtgcgggagatcgcgcaggacttcaagaccgacctccgcttccagagctccgccgtctccgcgctgcaggaggccgccgaggcctacctcgtggggctcttcgaggacaacaacctctgcgccatccacgccaagcgcgtcaacatcatgcccaanggacatccaactcgcccgccgcanccggggaaananggcctaaaatcgtgtcngtcttatctgaagttaaaaattaacaatttttgcgtggtgaatttgatttgggtatgtggtaagaaaattcctccgttcgtgctaaggttaggtgtttttgtgatngttccaatcctggttgtcatcaacnatcctgaannaaaagtgg

SEQ ID NO: 79746 - DNA, 560 bp, Triticum aestivum
  unsure (1)..(560): unsure at all n locations
  Clone ID: PAT_TA_79746
cccaatctcgtctccgatcgacccgaggctcgtcgaacccttcttccccaccgcctcaagatgcagatcttcgtgaagacactcacgggcaagaccatcacccttgaggtggagtcgtctgacaccatcgacaacgtgaaggccaagatccaggacaaggagggcattcccccggaccagcagcgccttatcttcgctggcaagcagctggaggacggtcgcacccttgccgactacaacatccagaaggaatccaccctccacctggtgctccgcctgcgtggtggcatgcaaatcttcgtgaagaccctcaccggcaagaacatcactctggaggtttgatagctccgacaccattgacaacgtcaagggtaaagatncaagaaaaaggagggnattccccccgggaccaacaacgcccttatcntccaaggcaaacaacttggaggatggtcgcaaccccttgccggactaacaaanatccaanaaggnggtccaccccttcancttggtggctccncccnccgttgnngggaagccaaaattttcntgnaaaaccc

SEQ ID NO: 79747 - DNA, 610 bp, Triticum aestivum
  unsure (1)..(610): unsure at all n locations
  Clone ID: PAT_TA_79747
ggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtgganaacttccgcgcgctctgcaccggnganaanggcgtcggcaagagcggcaagccactgcactacaagggcagctcgttccaccgcgtgatccccgacttcatgtgccagggcggcgacttcaccaagggcaacggcaccggcggcgagtccatctacgggcgagaagttccccgacgagaagttccgtccacaagcacaccaagcccgggatctctccatgggcaaacgcgggccccaaacaacaaacnggctccantttcttcatctgcaaccgttccccttgcaaattgggttccaaagggnaangcaacgttgttcttccggcgaaggttcctccnaagggcaatnggncttnctccaaaaaanantccaaaaaanggggggctcccccaaagnggggaaccntggttcnaaacnaanttttcatccccgaantg

SEQ ID NO: 79748 - DNA, 575 bp, Triticum aestivum
  unsure (1)..(575): unsure at all n locations
  Clone ID: PAT_TA_79748
gaaacaacagaagccagggagcggttgatcgatcaacccgccaagatgcagatcttcgtcaagaccctgaccgggaagaccatcacgctcgaggtcgagagcagcgacaccatcgacaacgtcaaggccaagattcaggacaaggaagggatccctccggaccagcagcggctcatcttcgcggggaagcagctggaggaggggcgcaccttggccgactacaacatccaagaaggagtcgacgctgcacctggtgctccgtctccgcgggggcaccaggggaggctacctaaacgtggaancaaatctcctgcagctcgcgctcaagtacaacgaagaagaaaatggtctgcccgcaaagtgctacgctcggcttcccctgaagtccaacaactgncgcaaagaanaaantgcgggccaacaagcaacgagctggaggccaaagaagaaggttcgtcaaacaagcctttcaactgaagaattgaaccaggacggtgaaaagaagcaaganggaaaggaccttcncncaatgaatgtttggnttgggttaacnagnttttttaagaatttttaaa

SEQ ID NO: 79749 - DNA, 573 bp, Triticum aestivum
  unsure (1)..(573): unsure at all n locations
  Clone ID: PAT_TA_79749
tcgatcgccccttgatagaaacaaatagcacgatacgagagaaggtgaaggccatcgggcgatgagagagatgggatcgctgtgagagagatggcatccaccaagccagccacgatgctgtccgccaccgccaggtcaatgatccgctcatcattcccttctccgcgccactacgacgggacgtcttcctctgtggtgcgatcgacccatcgccacgcgttggtgcaccccatcgcctgtacgacctaaaccactaagtggactatgccctaacatcgctatgctccctagacanaggagatgggtcgtgcgtaaaaattggatnagcgacagggggatncanccgtgctccatgcgggcgatttgtccaaccgacgcgcgtttggtttgggcgaatccaanccactcnagcaagatacngaccaaacacnccatgtnggtggatncggggaaattttggttggggaaagataaancttgtgttgtgcataaggtaaaaggagggacccncaaatgttaacaatgcccccaanaaaaaaccttaaaaatggngagctccttcctccttaaatn

SEQ ID NO: 79750 - DNA, 360 bp, Triticum aestivum
  unsure (1)..(360): unsure at all n locations
  Clone ID: PAT_TA_79750
cgcgacgcaaatcacacacatacacaacacgtcattttcattcntttctcaagccagcagcagcgcgcgcaccgagccggngatnaanatgatggcggtgacnacggnccatctgccncaaccgcgcgccctggcggccctcctcgtcctggtgctgatcacgctgggcggngcggccgaggcanagccgccgctcggnacctgtggcgcccaggtgagactnccntggcctccnacccctncgntgcggnttgcaccggngcccaaggaaannanatctccngagttgntgnnccaatctgccngnttccgcncttggggtcanttttccncnaatngcgccttgcnggggccaatcta

SEQ ID NO: 79751 - DNA, 616 bp, Triticum aestivum
  unsure (1)..(616): unsure at all n locations
  Clone ID: PAT_TA_79751
gcagaaaaggcagaaaagcctggtgaacaaggttttacccctcttcatgtggcagctggagcaggattgtgtgaaatgatagaagtcttgctctcaaaaggagctgatgttaattggttttcttaccgtgggacactactgcattctgctattatcggaaagcaggttgctgccgtgaagctcttgttggatcatcatgcggattgtaacaagccagtgtccctacattatacacctctgatcgctgctctccatgcccgctcgctgaaatgtgtgaagcttctgattgaggcgggtgctgatgcgaagggtgttcctccgctaacccccttaataattgctgcaaatgatggtttaactgatttctaacaaacctttacttcgggccggtgctgatcctgatgttcgtgatgatggaggtcaactgccaataanaaaattggctgcacgtaacaataagacnggaaagaatgttgaanacccntttttccaagtaacaacctcanaattccctatgtnncttaattggagtgttnatgggganaacttgcttaatgtcaaatcaattgccgaaaggagganggatgacccgttttacaaaaatggggccaacttn

SEQ ID NO: 79752 - DNA, 617 bp, Triticum aestivum
  unsure (1)..(617): unsure at all n locations
  Clone ID: PAT_TA_79752
ggttacgtttcaccaagcatatttatattataggcctcatggtatcttttcacgaaagatgcagcgtcgccatccacttctgtgcatccgtggccatatcagacgtcttctcctgcctgctaatgtaccgcatggtggaagaaggcaacgtggctttccacgtccctggggtgcccttccgctcaaacaccttcctgaactcaacagtcagtgcaatagcctctgagctcgtagcactcatgttcaaggggcaaggctcgtgaaacaacaagtcgtcgacgactccactagtcttgtatcagcagcggcgtcgtgtctcgcgggccattaatcactgagctagcgcaggcacgagggttggcctcgaacaacccgctctcactactcaacaaggtgcgaagaggggatcggaggtgcttcanatgagagatgttcaaatgcatgtacgtnaagaatttcatacacatcnattgtatacaggttgtgcctgttgccggcttttgcgtaatccaactcccggtgttnggagtccntaatncccccccctccaaaaaatnnttttaaaaaaaaaaaaaaaaaaaaaacnccangggggggcccggtnacccaattnnccn

SEQ ID NO: 79753 - DNA, 617 bp, Triticum aestivum
  unsure (1)..(617): unsure at all n locations
  Clone ID: PAT_TA_79753
ctcttcttccccgatccctcccccaaattcgtcgcctcccagttcccggtcttttgttcctcacaagttcgtggcgccaacaggacgcaacaagccagccccactggtaccgcactgccgtggatcgacccttcttctgccggtcctcctaattcactccggcgcgagatcgatnccctcanggcgcggcgcgcaagtgcgggagcggcttatttccaagaattttatcttggggtgctagcaagagacggataaaatgaagcgcaagcgcgggaagcacgccgggcaagaagagttcttcgaataacaccgggggagactcttcgtcggcatctccgttcaacccaaagcaaccgaagaaaacatccancgggagaaagcgccaatctccgaaggtccactcccgggcagttgcctngaaaccaatcctcctcctcctgaaaccggaanaaacccgaccgttccctggccccaanctccggggtcaatcccggccgcttnatattaccgttacgnccaagcccnaanggngggggggggtatacnggtcgtgttgaaacctaaantttaaaaacctccnaaggngtccggggctcaaaaaanannttggtcgggta

SEQ ID NO: 79754 - DNA, 631 bp, Triticum aestivum
  unsure (1)..(631): unsure at all n locations
  Clone ID: PAT_TA_79754
gcctcgacgtcgtcacctgttgttgcttcgacgccacgagctgacccgtctcaggccggcgtccctgcgccccgccgctgaccaggtttgggatctcatactacttacgttcggctcctctgcactctacagttcagtttctactgatgttgtagctcctaaatctatcgtccgcttaacgcggtggtgattttcactccctgcgatgaccaagcacgaagaagccagcacacaatggtgtcagcactgcggaggccgggagctcgcctgccttgaagatgatctgaaggactatagcacaatatcgtgaagagactgtaatttgtcgcacgttcaaaaagcccttgactcaaggattaaagagaaactaagttgtttaaataaaagtgganggaatatgtgtttcattcaaggattttgaggggccaattgatgttanccctgcaagctccccgggcggtcaaatggtgtttnttgccggtggcnggttnggtttcacaaatgccacgggctgaaaaaaangnaaactatgcctgaccggnaaaactnaantcanaaggaccccccgtcaangggtncttccgggaatcggggncggtattttttggnttaaaaaccttaaanaangggg

SEQ ID NO: 79755 - DNA, 456 bp, Triticum aestivum
  unsure (1)..(456): unsure at all n locations
  Clone ID: PAT_TA_79755
ggtcgatcgttgcataccagacccgatccgaaaaactagaaatcgaaactagctaggattaatagccatggcggcggcggcggcgctaaggctcggcggtcgcatgctgctccgacgaactcaacagcaagggcggcgcgtcttctcggatccgcaacggcggctcttcgcggacacgagcgccaccgcccctgagggaaagcaacctctcgcgatccgcttggcggagatgaaggagaagaaagaggagctttacaacatgggcttttccttggcaactgagtacgatctccctcgcggtgtccgccgagagaacaaagagctgttggagctgctctcggtgcaagtccaccccagacccaatgatgtctactggatgcggcggcttggatggagaagatgaancgatttgtgataatttggggggtaattactccgggttttgaanactgcaaa

SEQ ID NO: 79756 - DNA, 628 bp, Triticum aestivum
  unsure (1)..(628): unsure at all n locations
  Clone ID: PAT_TA_79756
gacgacgagcaaagccttcccccctcctgtccctgacggcgccgtcgagccacccaccggagcccccttcaaaccaaatgtacagcaccaggaggaggagcagcgcggcggcgccggcgccgacggaggacgagagggaaacggccggcgtggataggtcctggcccttcatgttcgaggggatgaccccattcacgacgacgagcaaagccttcccccctcctccgttgccgccgttcgccgtcaggacggcgaagcgattccgggctggccgatgttactcctgacctgagcagatacgagttcagagcgaccaattatttcagtgcaagtgcgtacccaagttgttcagactggacgccagagttcggtcactgcaaggacaccggccgaagcagagacgctggcttgctcaccctgagctcgcggnctccaacaactcatgaggcannctcnatgtgggtgccnatcaaatgcacaatccccgggagtacnggngacntcaattgccaancggccaatgccnatnccaagctcggggaagcggttttccgcttnccccgttaatccgtccggcctgcaantctanaaaattccctccccaattggccgggtcnaacgttganag

SEQ ID NO: 79757 - DNA, 599 bp, Triticum aestivum
  unsure (1)..(599): unsure at all n locations
  Clone ID: PAT_TA_79757
gcacccgcaaatcccccactctcccgaagcagcgagcgatggcccccaaggcggataanaagccggcggcgaanaancccgcggnggaggagccggcgacggagaaggccccggcggcgaataagcccaaggccgagaancggctgccggcgggcaanacggcgtccaaggagggggccggcggcgaggcgaattacnaggggccggaanaagggcagcaaggcgaaaaagggcgtccaagacgtacaaagatntacatcttcaaggtgctgaagcangtgcaccccgacgtcggcatctcctccaaggccatgtccatcatgaactccttcatcaacgacatcttcgaanaagctcgcccgccgagggccgccaaagctncgcgccgcttcaaacnaagaaggccaccatccacctccccggggangattcaagaccttccgttccgcctccgtcctccccccggggganctnctccaagcaaccccgntctcctaagggnaacaaagggccgtcnacaaaantntacctnccncctaaaattgcaattgcatnctgcatttgccttgtatcnaatctattatttagntggttntntg

SEQ ID NO: 79758 - DNA, 468 bp, Triticum aestivum
  unsure (1)..(468): unsure at all n locations
  Clone ID: PAT_TA_79758
gggaagtctttgaaggaaccttgatgatgacattgccagccagtctcgtcggcagggcagagctcaagactggtggcagtaaccagtggcagtcgcttcagacctatgtggccattgcacatcacttggtcttgagaggaactggcatcaggctccgcttggatgtcgctgactgcaacagcgcaatgcgccggctcttttaccaggtgtttcctcttttaccaagtaaacaccccgtcttcacgggactcttttggcgattcgttcttcancccatgatttaattctcttggttaactaagtgactgattgtcccgagagctataaatggaggtattgaaactagaaaaatatgaattttctcttgcagggtgggtccaaagccatgccacaagcttatccatcaaccgttaacgacctgggggaactaatggggtggctaccccanattgtttaaaaaataatgtc

SEQ ID NO: 79759 - DNA, 554 bp, Triticum aestivum
  unsure (1)..(554): unsure at all n locations
  Clone ID: PAT_TA_79759
ttcatatcttttgtatagccaattacaaagtattcagagcagtgtgtcatcagctcttattaatctcctgtcagcaacttggtgtacaaccggcttctttgagcactgattgtagagggaaaagggcatcaatgaaactctgtttaaccattgtgcttcgctcaacaccctgaactaattatttctcctaaaatgtgcgcgagaaaacaaacaactgtaatccgactctacatattgtgataattattaaataataatgccaatgtaatattgagttgtaatattcagttggggttcaagtgtgttgttatatccgtggtcgtttgttagttaacagctgctactgctagtgtaaggttcaaggtaaaactgtactatacttgcaactattggtaatatgacatttcttgcagatgaatttgcaaggagcatctggaggtcaacctgatcttattttaatccaattattgcttggctcctttgggttgcaagaactgaatttgtgatccccctgtaaacccgagactcaaaagtaatgaaattattccngcggt

SEQ ID NO: 79760 - DNA, 604 bp, Triticum aestivum
  unsure (1)..(604): unsure at all n locations
  Clone ID: PAT_TA_79760
gaaaccaaaccccagcccgccgcaccgtcagcacccatggcgcccaaggccgagaagaagccggcggcgaagaagcccgcggaggaggagcccgcggcggagaaggcggagaagacgcccgccgggaagaagcccaaggcggagaagcggctgccggcggggaagtccgccgccaaggagggcggcgacaagaagggcaagaagaaggccaagaagagcgtggagacgtacaagatctacatcttcaaggtgctgaagcaggttcaccccgacatcggcatctcctccaaggccatgtccatcatgaactccttcatcaacgacatcttcgagaagctcgccggcgaggccgccaaagctggcgcggtaaaacaagaagcccaacatcacgtccggggagattcanacctccgtccgcctcgtcctccccggggagctcgcaagcacncgtctccgaaggcaacaaaggcgtcaacaagtttcaacctccctcctaaaaattgctcctgcncctngtgtcccngtattnanctttcccggtnttntttgtnggcccttttaatcnttttaaaatcccaccgtnatgttcctggttncccnaaaa

SEQ ID NO: 79761 - DNA, 501 bp, Triticum aestivum
  unsure (1)..(501): unsure at all n locations
  Clone ID: PAT_TA_79761
catccccattcccttccccaaaaatttccccaccggcgacgacgccctccccaaatccgatccgccgccgcccgccgttgacgccagccatggccgccgccgcccgccgcgccctgctcctcctcctcgccgccgccgccgtggncctcctcgcggcgcccccggcggccgncgcccgcccctgcggccgcgcgcagacgctgctcatctncttctcntccttctcccgccccaaccggnaccccgcccgaccccgttcgcccgctcancnaccaccgttcgtcaccggtcctccggggtccgccggcctcgggcccngcaancgctttccaaggccncaacgaaccaannaanccgccttccaanattcngcccgnccccgggccgaagccccnttcccccngccggttnnggaancccccgangcncngaacgncngaattccgaangnccggcctccttccctttcaaggaangcgcgnccaaatgggacaatncctc

SEQ ID NO: 79762 - DNA, 636 bp, Triticum aestivum
  unsure (1)..(636): unsure at all n locations
  Clone ID: PAT_TA_79762
gcaaggtcgagcacctcttcttcgcgcagcagtaccacgaccggaagcagcaggaggcgcgcatgtctctgccccgcgcggagcgcgcccacgcgcctttcgtcgacttcctcaagcccatcatcgccgacggcgacactggcttcggcggcgccactgccactgtcaagctctgcaagctcttcgtcgagcgcggggcagccggggtccacctggaggaccaagtcgtcggtgaccaagaagtgcggccacatggcggggaaggtgctcgtcgccgtctccgagcacgtcaaccgcctcgtcgccgctcggctgcagttcgacatcatgggcgtcgagaccgtcctcgttgcccgcaaccgacgcccgtcgccgcgacgcttatcaagaacaacattcacgcgcgtgancaacaagttcatccttggcgcaacgaacccgcgcctcaaaaaaccgggngcctcaacgggcaatngctctnccggacgnccaatntcggcccggnaaagaaacggcnanggaancttcaaggcaatccaaggannaanttggacccnccaacggggcaaatnaaaaaaccttccccgagttgggtnaaagganncnatcgcaaagggtnnaanaaaaacnatnctg

SEQ ID NO: 79763 - DNA, 644 bp, Triticum aestivum
  unsure (1)..(644): unsure at all n locations
  Clone ID: PAT_TA_79763
gcagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcaagcggaaaacctcgacgagaagaggaacacggacaagtggaagggtcttgcgtacgatatctccgacgaacagcaggacatcaccaaagggaagggcatcgtggactcgctcttccangcgcccaagggcgacgggaaccacgaaggccgtcctcanctcctacaagtacgtcagccaagggactcaaagaanttccaactttcnacaacaacnatggggaanggntcctaacaatcncctccctgcntttaatnggcnaaaccttgtttttcanctcctcccaanaaatttcaataacccctgcccnaanatcaaanattccaacccancttnggttaccttggggaaggcaaagggtcaaagggaaaatcaattccaattgcnaacctntttttncccaaaaatgggccatcaaacccaattccttttanttccccggnaaantgggna

SEQ ID NO: 79764 - DNA, 455 bp, Triticum aestivum
  unsure (1)..(455): unsure at all n locations
  Clone ID: PAT_TA_79764
ggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcnaagcatggcattcagcctgatggccaanatgcccggtgacaagaccgttgggggaggtgatgatgctttcaacaccttcttcagcgagactggtgctgggaaacatgtcccccgtgctgtctttgtngatctcgagccccactgtgnttgatganggtgaggactggtgcttaccgccagctcttccaccctgaagcancttatnattggcaagggagggatncaagcccaacaaatttcgncccggtggntcattaaaaccatttggnaaaggg

SEQ ID NO: 79765 - DNA, 590 bp, Triticum aestivum
  unsure (1)..(590): unsure at all n locations
  Clone ID: PAT_TA_79765
caatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccaagcaagcgtctcatctttgctggcaagcagctcgaggatggccgcaccctttgcggactacaacatccaaaaggagtccaatctccacttggtgctcanggctccgtggtggtatgcagatntttgtcaagaacctcaccggcaagaccatcacccctggangttgagtcctcanacaccaatttacaaatgtnaanggcaagattcangacaaaggagggcatcccccccggaccancancgccttgatntttgccgggcaancanctcgaaggattggccgcaaccnttgcngntttanaacatccaanaanggagttccaaccctccaactttggggctcaanggtccnttggtgggaatgcaaattttttttgnaaaaaccncaaccgg

SEQ ID NO: 79766 - DNA, 668 bp, Triticum aestivum
  unsure (1)..(668): unsure at all n locations
  Clone ID: PAT_TA_79766
ggagttatcgtgccgccccgactctcctctccccctcccctcccctcccctcccatggcgacgcccgccctgccaaaccctagcccgctcctcgacgacccgctgccgcccgagcccaagccgcgccgggagcccaaggtgcgggacccggacgcgcgggagccgccggcggccgcgcaggatccggaggaagacgcgcccgaggagcccgagccccgancaggacnagggcccggagccgcccgcccctccccaccgacgcgattcgagcccacccccgtccggcggcggaggtgganggacggggacgacacctcgtccgtttcctccgntctcgtccggccgccgctgccaaccgaatgccncccggccgcaaannggggggggcaatgacnggagaaggcccctttcccgggggggggaaccgaacctngctccaanaattctncctancaanccanggactaacngggntngctttcgcccgcnggggaacaaagaacggggcttccggcatntaaaaattgccgaacccccttcccgcggaaatttttcgccgggnatttcgggncctncccccaaangncgtttcctgggggaaaaagnccnccaaagtccttcnacnaatcccgccntttttggggtgggggggggttggnggaattgtg

SEQ ID NO: 79767 - DNA, 555 bp, Triticum aestivum
  unsure (1)..(555): unsure at all n locations
  Clone ID: PAT_TA_79767
gttcccctcatccgaggtatgaaagaaaaaaaatacaccaactatctgcttaaaatatgtggattatcacttaaaaagggacattggtcaaaataacacttgaatatatatggaatcattttcagtcatgatgttattattccccatgttgtaccatgaaagatggcatatctgcaatccatcaggcattcattgtgttgctttacctgtggaatgattatttgtggatcccccactcaactcaccccttttcctaacaccaagtttcttctacaagctaagacgtgttgacaccttaagttgcctagaacaattaattatatagtgggatnatgttgtcctgtgtgaaaaaagaagattaagtcataaggacctaaagtaattaacttgtttaatnggaatcncatttcaatggacnagcttatcctaccaaaantccnaaggttnaatgctcccggtttggccaacctcanaatcctaaacctttaatggncnggncccttaaagggtggggaaattgttcctttccaatggaaaagcaagncccantgccgg

SEQ ID NO: 79768 - DNA, 526 bp, Triticum aestivum
  unsure (1)..(526): unsure at all n locations
  Clone ID: PAT_TA_79768
gcacaatctctcttcctacgcactgtacaatccaaccaacgcaagacaagagtagcaacaatggcagtgcatcagtggacagtggcgctctttgtggctgtcgccctcgtggcggggccagccatctcgtacgctgtcgaaaccagcaatgccctggccggggcacaaccaanggccaacgaccgaggagcagcagctaattgagaaggccaatatcgccttcaaggcggctgtggcggccgcagccgtggtcgctccagcggacaagtacaagacattccaggccaccttcagcctgaactttggctggtctatcgaagggatcaccggcacgttcaacttccaagccactttcaccaacaagatcgcctttgctcaattgtcaagcctancacttcnccaagggcgctaacctgganggcaaatacgaaaccttcgtgggcatcctnanccagtccctccgcatcaatcgncgggaatcctccaaggtcaacnccgtcnaaccccgcccgggaagggaantcaa

SEQ ID NO: 79769 - DNA, 472 bp, Triticum aestivum
  unsure (1)..(472): unsure at all n locations
  Clone ID: PAT_TA_79769
ccgaactccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagattctctggcgcaccatccgcggtatgattccgcacaanaccgcgaagggcgangcccccctcnccaaggctcaaaggcgttcgaaggggttgccgccccccgtnacgaaaaggaccaaacgcatggtcatccccgaacgcgctcaaagggttctgaaggctgnaaccctggggc

SEQ ID NO: 79770 - DNA, 606 bp, Triticum aestivum
  unsure (1)..(606): unsure at all n locations
  Clone ID: PAT_TA_79770
atagtgaaactggtcaagaatggacaagagttggatggataaagctagaaacacacaagcatatattgacggggatatcggcatgaagatggacatgaaggtggatgtggacatgaaggggaatatggtggtggatatgaagcatttggaaagtggacaagcccatggcgaaagcaggaatgcaaccacaagcaagctgaggagctatactggcagctcccttgctcttcctactctggcaatttttgcctggttgcgttgtttttcgtgtgacaaaacaaattctttatgatggggtaatgctgcctgcatttcctgaagtanttgggatttgacgtgtccccnccccctgcccaattgtacttcccaagtggtaccaatgtttaacaataagatgtttgaccggagaataaaggaaagatttttgaaacccacnggatnaattttggnaaaacctangaataaattgcccgaagtggattaaagttaanaagcctttggttggttgaaacctggacaaccttgcnccggcccaattttcccgggttaaacccacnnaaaggcccnattttgggtggggggaaccccaaaaaaaaattntttctt

SEQ ID NO: 79771 - DNA, 560 bp, Triticum aestivum
  unsure (1)..(560): unsure at all n locations
  Clone ID: PAT_TA_79771
gagcacaacaatggcgccgcccatggatcttagaactgtcgccgtcacgcccgcgcgtggaggcgctgggtgcggtcggtggtggcagacgcagcgaaagggtgttttttgtaaaaacaaaacgttttctcagattcatttaaaaaagaactgcgggttgaatatccaaaaacataagggcttttctgcaaaactgtcacgacgtaccaccaagaagcancccgtgcttttttattattattattattattattattatatataaggagaagatagataagatttccgtcccgtgcgtnccttatggctgatgaatgaaaaaacccaataatgtgcggtgtaaattaaaaatcctccgccttcctccccggcgggcgtnntgctgttcctgccccggtccccttaaaaagncnactgccccctttgcaaaaanaaaatgatngtanggctncnctgncttccttcccaaatttngngcaagcgancnangacatttcaanctttctggggggacccgaccccaaaagggaccnnttantctttttggggaataaaaaccg

SEQ ID NO: 79772 - DNA, 452 bp, Triticum aestivum
  unsure (1)..(452): unsure at all n locations
  Clone ID: PAT_TA_79772
cggtggcagtactacaagcgagtgacacaagttcttgcaccgatcagatccaacttctgcgcaagatgctggacaagctgtgggacgacgtggtggccgggcctcgcccggagacgggcctcgacaagctccgccgcggccgccgccacccaacccctcgccatcaacacaagctgcaggggaggcgattaagcagtcgccgtcgatgcccgacgaccccgaccacgccggtgacgccgtcgtcgtcgacgccgccgcgttggcggcagcgtgttggcgganccgtttttcaaccccgggaagcaaaccttggccaaccaaaaaagcctcggnggccaaacctcctttcgaacggccccgcaaagcccaaatccccccaaccgtttnacnaatnggnttttaaaagggaacgaagaacaaggancaaaggagnaaaccaacccgcttaaatt

SEQ ID NO: 79773 - DNA, 663 bp, Triticum aestivum
  unsure (1)..(663): unsure at all n locations
  Clone ID: PAT_TA_79773
tcaccctggaggttgagtcctcggacaccattgacaatgtgaaggccaagatccaggacaaggagggcatccccccggaccaagcagcgcctgatctttgccggcaagcagctcgaggatggtcgcacccttgcggattacaacatccagaaggagtccacccttcacttggtgctcangctccgtggtggcattcagatatttgtgaagaacctcaccggcaaagaacatcaacctggaggtggagtcatctgacaacatttacaacgttgaaaggcgaanattcaagacaagggagggcaatcccccgggaccancanccgtctcatctttgcccggttaagcaactttnagggatgggccgcaccttgggcgggactaacaacaatccaagaaggggagtncaaccctcaantttgggggctcccggtcnncccgttgggtgggcaattaaagctcctggnccaatgggagcttgcttcctgtcncctggggttcnaaaaatnccccggtgttcnccgggtntcccccnaatggggngtcctgggcccntgttctggtcgtttcccggaaatnttctttgntttccggttaccaaaancggttgatncnaattgttttncgtttggttncttcnaaaactnctggccngggngtggnggg

SEQ ID NO: 79774 - DNA, 463 bp, Triticum aestivum
  unsure (1)..(463): unsure at all n locations
  Clone ID: PAT_TA_79774
ggagccattagaccaacgtctttgatccttggtgacaaccaccgcttccgcagcgcgccgcccccggggagatcaatctcccctccccgggggcgctgcaactgatcatcaaacaagagattggttcattagatgaatttcattcaattgatcaaatatttaggtttccgaatttccattagatagatttctcttagccacaaaataaatctcaaccaccctcacatctggtgaaagaaatatcctctgtagaaaacggcgttnaaatcatcggtgaccatctacaccgccagatcccgtccgattgctccgaagcgccccctggccagcccgggcaaggttttncatcncccgtcctaancngccccgggcgcttgggacnggnngggaaacttggcgccgcaaccctggaatcgggcaantcccaatggngcggtcaatcaatcnnacgaaaccttgagtt

SEQ ID NO: 79775 - DNA, 643 bp, Triticum aestivum
  unsure (1)..(643): unsure at all n locations
  Clone ID: PAT_TA_79775
cccctccccccaatcccactcgcgcagcagctccaagaggatcgtcggcgaccatgtccggccgcggcaagggaggcaaggggctcggcaagggcggcgcgaagcgccacaggaaggtgctgcgcgacaacatccagggcatcaccaagccggccatccggcgcctggcgaggaggggcggcgtgaagcgcatctccggcctcatctactangagacccgcggcgtgctcaagatcttcctcgagaacgtcatccgcgacgccgtcacctacaccgagcangcacgcccggaagaacgtcaccgccatggacgtcgtgtacgccctcaagcgccangggcgcaacctctanngcttccggggctaaggcgcttgccccccgccaaaacggttcgtcanntcttccgtncnccaacctggaanattcccgatgtttttagtccnccccgnttcctaattanttgnttgcgcccnaaaaaaattctcaanattgggaaaccgccccttgtttccccaaattcccncccgttttgntttangcctaaatcaatnggaanttttttaatggaanattntttgcnatccaaaannttcnaaattgnaaaaaaaaaaaaaaaaaaaaaaacncnanggggggggcccct

SEQ ID NO: 79776 - DNA, 408 bp, Triticum aestivum
  unsure (1)..(408): unsure at all n locations
  Clone ID: PAT_TA_79776
ggccagccaaatcgaccccccgtaccccgaaaccagcggcagcaccaccacccacccatggcctccctggcggcgagatccggcctccgctccctggcggcgcgcgccagggccccggccccggcgccggtcggacgccgcatgtcctcctccgcccacgacgacgcctatgaagacggccangtggggagaanatcaacattatggggggccgtcaacttgnacctcctgggcggncttgnaaactctccaagggggcaaccccaacttcnaatangccgcccggncttaaccaatnncctggcacaatcccgcaaacaaagggagtttccccctngggggaacccaatggncctngtttngagggnaaagcaacaancaatttgngttnccggaanaagtnggaat

SEQ ID NO: 79777 - DNA, 458 bp, Triticum aestivum
  unsure (1)..(458): unsure at all n locations
  Clone ID: PAT_TA_79777
ggccgagcagcggcgcctgacacggagaacagggccgcggacccgcctcgccgcccaggtcgccggcgaccggagccctcgtcccccgccgccgcccctccggttaagttgtctcggagacttcttttgaatggagcgtagtgattccctgtccgagtcgccaaggaagcggaatggccttctgcgtgaccaggtccagctggtgaaaagtaaggacacaagccgctatgagatcgtcccctttccagagccactgtcttttgagaaaggcttcnttgtcatgatccgcgccatccaagctcctggtgcaaaaaaatgaangggaaatataatctgatgtttgangagtgggttgactgatnaatccctttatcaanatcaaccggaggattaactttttgaagtcangtgtanctcctccttngngggtttgaattggcgttngggatataaccaat

SEQ ID NO: 79778 - DNA, 418 bp, Triticum aestivum
  unsure (1)..(418): unsure at all n locations
  Clone ID: PAT_TA_79778
gtcatgagtttgatttcttaaaattgatgctcgggtgttcaccggcacttaaaaaaatgactttgaagctgtcacgtgatgtgtggtcgaggaaagatggatgcacaataataaacgacatcttcaaggcgtatccatccgtgcaatgctatgtttatctttcctatgggttcatccatggctaccaaaattatcactgacatgattctcatccatacctctgcaaattctttggtttcgcatcggcaagatcatcctttcccatgctgagaaactccatacattttgcatagtttcaggagtaatttttcttggttgctttaactgatgaacttaaatgaattgttgagtgggttgccatgccaatcaaatcaatggatgttgataatattggnatttnggccngacctaacccccc

SEQ ID NO: 79779 - DNA, 401 bp, Triticum aestivum
  unsure (1)..(401): unsure at all n locations
  Clone ID: PAT_TA_79779
ggcgcggcgaccagcaccggcggcgactccaccaccaacagcagcaccaggcgagcgagccaacccagcccatggcgccaccggcccgcgcgtccgcgaagcagccgaagccggggagggccctggggcggaggggcatgtcgcgcgcggaggcggcggcggcggcggacgcggcggcgaggcggtcggcggcggcgcgggagtggcncgtgtggggcgaagtgggcgatnggcgcggccaaggtggtggcgcactacggnttcatccccgctcgtcatcgccgtcggcgtcatcaangtccgaccccaagccctccctgtttccagctcctncgcccccgttnctgattcgttccgtcccgcgttgatnnccncttccctaaggggttccgttcnaaaaa

SEQ ID NO: 79780 - DNA, 361 bp, Triticum aestivum
  unsure (1)..(361): unsure at all n locations
  Clone ID: PAT_TA_79780
ccgccgccgccgccaaatcatctccgtccccctcccactccccctcccgctccccctcctttctccaacatggctctccagatcagcaagaagcgaaagttcgtcgccgacggcgttgtttcctggcgagctgaacganaatgcttaacccgcgagctcgggggaaggacgggtttcgccggggtccaaattcggggtaaccccaangccaaccgannttaataancgcgccaacccggnaaccaaaaanttctncgncaaaaaggcccgangaanaagggaacttancttcnggtgnggaaaaaacgcttnaaattttncgggaanggggggttttggancncttancccccnaaaaaag

SEQ ID NO: 79781 - DNA, 208 bp, Triticum aestivum
  unsure (1)..(208): unsure at all n locations
  Clone ID: PAT_TA_79781
aaatactccttccccagctagggttttgctgcctccgccgccgcctcccgccagcgtcgtccccccatggcgctgccgaaccagaacaccgtcnaattaccccagcctcaagnctcgtccatccgtcnggcgaatgggcgggaactgggcaaaaacaactttggnaaaaaggaanccaactgggnaatttngaaanaaaantgaaccc

SEQ ID NO: 79782 - DNA, 311 bp, Triticum aestivum
  unsure (1)..(311): unsure at all n locations
  Clone ID: PAT_TA_79782
gccaaacgaaccagcgccgcagcccgcagcgcacccatcccaccaaacaaacagctagcaggcgaggcgacccgctccgaccgagagccgatgccgacgccgtacatcgcggnggcgctgcagcancaccaccggctggtctcctcctcnggcggcctggcggtggcggcggcgacgggggcacacaggtgtgnctnagcacnacnggacggtgccnccggaggtggcgcggcaccactancacgcngcnccngggggccgctgctgctgctcgggcggtggtgcatcgcgtngcggcgcccgccgcggac

SEQ ID NO: 79783 - DNA, 595 bp, Triticum aestivum
  unsure (1)..(595): unsure at all n locations
  Clone ID: PAT_TA_79783
gcctcgtgccgaattcggcacgaggatttccagctatggcttaaaaaagccaatagtaagttatttatgtactaattcccctaatgatattagcatatgttgtttgaatttaactattgaagggcacatgaatagtactagcatctaggattgagggattaaaagtttacaaaaattcaaagaaattctatgttggtttcatctctttgttgttctgaaattgctgcccttgttgaattgttctctatcacatctaaagcaaaattttacagtgagcatatgtgatggactatatttttaattagggctcgagtataatggactgggaatcattctcttaatgatctggtactcttgaactgggtgcatgaaacgtgcttttgacatatatatttctcccgaggtttgtgggggaataagaaattttagattaancatatgatatnctacacatatagtntatcttaanagtatcaaaggtttagtcctttcactggtcccctttggaaccttcttccccaaacctttgnnggntgtacaataagcaacccntgcaagaagaaaaaccttttttaaaantttgnaanagcacctt

SEQ ID NO: 79784 - DNA, 250 bp, Triticum aestivum
  unsure (1)..(250): unsure at all n locations
  Clone ID: PAT_TA_79784
ggcaaaatctcacctgggttcgtcttcctcggccgcctctcgctcgccggccggctttgggttcttcgccgcttcggagctcgaatccggcccgcgggtccctgattccgtgccgcctcaagtcctcggcgggagattcgtgccggcatttcccggaacgctcgctcgtcgccgctctctctctctctctctctctctctctctctctctctctctctctatatatatatatatatatntntatatntat

SEQ ID NO: 79785 - DNA, 402 bp, Triticum aestivum
  unsure (1)..(402): unsure at all n locations
  Clone ID: PAT_TA_79785
gcctcacttaaaccccacgccgcagccctcgccgccggccgccgccacgccctcaccatggctcacctccgcctcctcctttcccactcgcgctgccacccgcatccccatcgcctcctcccgctcttccgcttctccacctccaactccggcgaccccccaccgccgaccatcaagcccgtctcctacgccccgaagccgcagcccccacccgaggaggccccccggccggatgcgccgaagcgctggccccgatttggnaaggacaagccgaccanggagatttgagcaancagcccgcccgaatccgcccgcgggaattttacncgggaaagaagggttgccggttccctccaaaggaacgccggggccccgcnaatttcccccggttttcntttaccc

SEQ ID NO: 79786 - DNA, 315 bp, Triticum aestivum
  Clone ID: PAT_TA_79786
ctagctcacactcctcactgagctaagcaccaacctcgactgcccaaggaagccacctgccaatcacccagcactctgccggtagccatggacatgggccttgaggtctcgagctcctccccatcctcctcgtcgctggccaagcgccccgcggggcgcaccaagttccgcgagacgcggcaccctgtgtatcgtggcgtgcggcgccggggcaacgcccaacggtgggtctgcgaggtgcgcgtccctggcaagcgcggcgctcggctctggctcgggacttacgccacggccgagattgcagcgcgcgccaac

SEQ ID NO: 79787 - DNA, 437 bp, Triticum aestivum
  unsure (1)..(437): unsure at all n locations
  Clone ID: PAT_TA_79787
acacaccaactaagcccacggagcaagcacactagctagtttctgccatggcagctcgccgtgcccacgccgccgcgaccttggacctgctggtggcggcgcttgtgctgtctgcggcaccggcgccggcggagggtgcggttgcgaactgcggcaagttgtgagctacctggcccgttcatcaatttacccatggcaaggttnagtcccctggcngtngctgctgnaaccgcnttcgtnggcttaaagccngngggtggcaaccccgncgaacgcaagaacanctggaaactgcctcaaacaacaagcgganccgnatanggggnatcaaagccaaacctccttccctntggaaaccccgggaaatnngnggggttnaaaattccctttancccatcanccaaagggaaccggtttggcnccnaaggngcgtttta

SEQ ID NO: 79788 - DNA, 322 bp, Triticum aestivum
  unsure (1)..(322): unsure at all n locations
  Clone ID: PAT_TA_79788
ggagagcaatccgatccagcgccgccgccgccgccgccaaaccctcctgcccacgtcgccggagagaanaagaaggggaagatggccaggtggaagggccagaggaagaaggccgtgacgcgatccgtcaagggcgggctccagttcccggtcggncgcatcgggcgctacctcaagcaagggcgctatgcgcaacgcatcgggtcgggcgccccccgtttaactccccgccgtcctccgaagtatctccgccncccaagtcctggagctgggccgggcaacgccggccnttggcaaacaanaanaacncgcatcatccctc

SEQ ID NO: 79789 - DNA, 601 bp, Triticum aestivum
  unsure (1)..(601): unsure at all n locations
  Clone ID: PAT_TA_79789
ctgcgcgccgccacacgaacccccacccaacccgagcgagcgccggccgaggaggaagagaaggtgagatggctcgcggcgcggcggcggcggcagcggccgcgaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaacctcggcgactccgtcaacgtcacgcgcgacaagagcaaggtcaaccgtcacctccgaangggccttctccaagaggtanctcaaagtactttgaccaagaagtactttaagaaacacaacgttgcgggactggcttcgttgtgatngcaaccaacaaaggagcgcaacgtgtacgagctcccggtacttcaacaatcccttaaaaattaagggccaaggangaaggattaaaagtggcattgttanaatgtaaanngcttgttgagtttttganaccttgattctgangtaccncccnanttttccaacctaancttatgtttttgccccgtttgaacctggaatggnttaaatttgaaaaa

SEQ ID NO: 79790 - DNA, 432 bp, Triticum aestivum
  unsure (1)..(432): unsure at all n locations
  Clone ID: PAT_TA_79790
ggataggttgaaacattgtgtctggaattctgaaacacctactgaatttgaggatagatggaagtcttttatacagagtttaagttggaggaccatgagtggttcgccaaaaggtttcagcttcgtgcgacatggataccagcatatttcatggatattcccttagctggtcttcttaggacaacttcaatttcagagagtgcaaattcgttctttaagcgtttcatatgtcggaagctcacttttgttgagttttggctaaggtttgacactgcgttgaaatgtcagaggcagaatnagttgattgccgataacacaangcgaagtacacaacaaagttgaattgttgacatcatggggaagatagagaaacaangcaagggaagtnttcaacacatgaacaattttttgaaattgtttcaanggctccaa

SEQ ID NO: 79791 - DNA, 459 bp, Triticum aestivum
  unsure (1)..(459): unsure at all n locations
  Clone ID: PAT_TA_79791
gagatgccgccccaagtgatggtccaagtatgctgccccaagtgatggttcaagtgatgctgccccaagtgatggtccaagaggtgctgccccaagtgatggttcaagagatgctacacaaagaggtggtgctgctacttcaagcaacaagcatgtgaaggaatcaaagaagggtaagaagcgtgatgatcctatggtggaagtgatggcacaatatgtggagatcaaacgaaagcaagcggaagagtctgctctattggtcggggcaaaaaatgcccaagaattctccatcagcaagtgcattgctgttttgcacaagatggaaagcatccgccgcgatgaacgagccactgcctacaaagtgttcaaaagtgttgagaaaccgtgagatctttcctaantctgccgccnaaaatgaaaaaaattgctgcattgtttccttcngagcgaaaatgggaa

SEQ ID NO: 79792 - DNA, 508 bp, Triticum aestivum
  unsure (1)..(508): unsure at all n locations
  Clone ID: PAT_TA_79792
ggccaaaggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatggtgccagggcggcgacttcaccaagggcaacggcaccggcggcgaatccatctacggcgagaagttcgccgacgagaagttcgtccacaagcacaccaagcccggggatcctctccatggccnaagcgggcccaatacaaaagggtcccanttcttcatctggaaccggtcccttggcaattggttcccaacggaaatcnacttggtnttcggggnaaggttcttc

SEQ ID NO: 79793 - DNA, 486 bp, Triticum aestivum
  unsure (1)..(486): unsure at all n locations
  Clone ID: PAT_TA_79793
gcttcttcttccacctccgcctccctccacctcttcaccgccggccgcctccttccgcttcctaaaccccttcgcgggagcccctttccccgcgccatgcggtcccttgcgcggccaccgaggccgcccaagcccctgccctcgctcgccgccttcgtccagtccatggggtacgtggaggtgaagatgcggtggaagaaggacgcgtccttcgacgccgtcccggtgctcgcgcacgcgcgggacctccgcccgctcgcttccctcgcgcgcctcctctccccgtcgccgacccccgtctccgcggtctccaagctccgccgctcgctcgagacctccgaccgccgcgtcgcctccttcctggcgccgcttccccgcgggtctttcgtcgaagtccgtcggggccccgaagcaaaaaccaaccccttgggttnccgttctcttcgggcctccggncgcggcggccttccaaagggggaaggaagg

SEQ ID NO: 79794 - DNA, 440 bp, Triticum aestivum
  unsure (1)..(440): unsure at all n locations
  Clone ID: PAT_TA_79794
cctcgtgccnaattcggcacgaggcccaccttccttcctcccccgtcgtcgcggctccagcttagggtttctcgcccccgccctcccgcctcaccgccggccccgtacgccatgtcnaancatggagggaaggccaagccgctcaagcaggccaaggtcgccgagaaggactatgacnagaatgacctggcatacctccanaagaagaanggttgattacaaggncctgaatganctgaangccaaagcaggccaaaanggtgcnctggnaggatcnggtctcaaaaanattgggaaagaaatgagtctgcccatccctacaaaatgcccaaaaaattgataatctanctatctaactaacctgtgtcccccctcancaatcngtgggttgtanaaaantactttcaanttttgtttgaanattaaaacaaccctcccaa

SEQ ID NO: 79795 - DNA, 604 bp, Triticum aestivum
  unsure (1)..(604): unsure at all n locations
  Clone ID: PAT_TA_79795
cctcgtgccgaattcggcacgaggaatccccaaatcccctctcttcccaagctactcggagcaggcagccatgtcggggcgcggcaagggcggcaaggggctcggcaagggcggcgcgaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccaaggccgcaccctgtacggnttcggcgggctgaaganccgcggcgcttgctgggccctggcgcacaaagccctgggcntcgccggttaaagaaatccaaaggagggaanaaaaaagctgttantttaatttggggttccgtttccctnccaaagccttatnnacaaagtantnncccaagccttaannaattttgcttcccgtgttcctgaacctgaatngggcaaatactgttttcgccnanttanatgaatt

SEQ ID NO: 79796 - DNA, 177 bp, Triticum aestivum
  unsure (1)..(177): unsure at all n locations
  Clone ID: PAT_TA_79796
ggagagagagagagagagagaactagtctcgagttttttttttttttttttttttttttttcacaaaagtttcccttgacctgcattctaattaaaccttcttccttcagttaagacaacnctnaaaggntcaacnntaatgaggccagnttngggcatngnaccgcttnctangaa

SEQ ID NO: 79797 - DNA, 606 bp, Triticum aestivum
  unsure (1)..(606): unsure at all n locations
  Clone ID: PAT_TA_79797
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcaagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaaagctgcctatgttcgggtgcactggacccacancaggttattcaacgaaggtggagggaggtcaaaaaaggagttaccctggacgcgttatttcgcaatcaanccggattccaacaacattncgtccanggtgcantgcgttcaagttcatncccccttcaagccaaccggcntccnanggaagtccgggcaagggcctnaaananctcantcacaacanggccaatattt

SEQ ID NO: 79798 - DNA, 315 bp, Triticum aestivum
  Clone ID: PAT_TA_79798
gcccccgaccccgaggcttgcaccgcagttgccctcgcccagcgtgccgccgctcgttggacgcagcagcccaccctacggcctgggcatccctctcatctacgtctttcctttcatcccaatcattggcatcccctaaaatgaacgtagccgccttctccttgcggtactcgcctgagtattttgttattttctttcagccaagtttgcagtaatccctagccatccatgtcagtgaggtcaccttatgtatgaacaacgaccaataatgtgactgtgagtcaacatgttgcgaccaaaaaaaaaaaaaaaaaa

SEQ ID NO: 79799 - DNA, 595 bp, Triticum aestivum
  unsure (1)..(595): unsure at all n locations
  Clone ID: PAT_TA_79799
gcacgcacaggtccatttcttccagaatttcagactttgagcagcaccagatcgagtaccccctcccactctcagcagcgggcaaggtagcatagcacagcagctggtggaagcatctcatctcatctcatcatcgatcgatccccttctccccctccctccctcgcctttcacactccccaacgcctgtaaagcagcagagcaccaagctgcaagcagagactgtcacagacaggatagccactcatcttccctcttgctttgcttctctcatctccctcgccagtcgccacaattcgtcggcccagaaactcatgcagatcctctcggttctagaagcttggcaangctcagcatggcctgacgggagcaaagatttgctcctctcggtctcctgttcccgttattcctccccatcttcttgggtcttccaatggnccgcaattgttnaatcctccttccgggntcccgatggtccttggggcggnanaccngacttggatnncccctaacancccgaacangggattgntccccagggnccttgttgnaccatnttatnggcccggcangnggggntactttnaccttcccg

SEQ ID NO: 79800 - DNA, 570 bp, Triticum aestivum
  unsure (1)..(570): unsure at all n locations
  Clone ID: PAT_TA_79800
cgcccgcgctgcatccagggggcggctcgggcaaaccctagccgccgccgcccccgactctcctctcctctgctctccccgccgccgccggaggaggccggcgagcgaagctcgcttggctgacggcggtggcgggctcgcctccgttcctcgcgaggaggcctccggctgcggcgcgacggtgcccctgggcgtccgacggcgcggcggatgcgggatgctggggcggcggccccaggggactccggcggtggctgtgccgccacggctgcaggggcagcatgggggcggccttggcggctggtggcgacggatctcgggcatccggcccanattcggtttcctccgggtggtgttggctcgggcgccggccggcggccccgaacggtggtggtttcccccctgggttgctcccttctccggcgtngtttaagaatggttgtggtggttgcnttggttcccgcnaatctcaaaggtttggttctntccnaanggtcggcccnccccggnnggtnggaattcccggtaaggcaaccccgnccctcctttgnattccggattccaaaaccg

SEQ ID NO: 79801 - DNA, 391 bp, Triticum aestivum
  Clone ID: PAT_TA_79801
gtgatattgaccagattggaaattgggagcttttcatatagcaattcagatagatgttcttgctaactatatatgaattgctataagtggggtgggggtgaagatgttcttgctgtctatatatgaaatgaaaaacctgatgaagatccttccgaggcgtctcagatgtacctcttctcgcactgaacagggccatcaatggagcagtcaaagaagcaacactgcagtagcaaaaacaaatcatacgtggcactctcccagtatgcgtgcccagtatatttcaaaatggtagtagcttcttgttcttcagaaagtaaatgtaaacatctgttgtaaagattccaagtacatgtaaagatttttatatgagatagtagctgtgttatattta

SEQ ID NO: 79802 - DNA, 413 bp, Triticum aestivum
  unsure (1)..(413): unsure at all n locations
  Clone ID: PAT_TA_79802
ggccaaacctagcattccaaaccgatcgacgatgncgcgcacgctccccgccggtaaacctccggngcgagcaacccagccgcnggagcccgcgangccgtcacccaagancaggatggcngacgcncagctgccggagcgcaaaangaangtctcgccatcggccggtccgccnaacaaaangaacanngaagaccagatcgccgccgggcgagcccganaagaaacttctggcctcnccctctcccgttcgagcatgcncggatacccggccgacgangcccccggtncgggccaaacccanaccggccgggacccccncnaaagaagcaaanantccggccgtnangctcaaataatcangggaaggcccgattnccccaancttncntggagtcgncaagagggnaaga

SEQ ID NO: 79803 - DNA, 485 bp, Triticum aestivum
  unsure (1)..(485): unsure at all n locations
  Clone ID: PAT_TA_79803
gggagcttaagttcagcagccaaatagggcaggcatgttgtgtatagagtttgcaagatatgctgttcatttcttacacttaaaaagcttagtcagaacaactatttcatattccaatacataaagaaagcacttatcttatctttcttccatgcttttcattacgtgattcgataaccatgatgacagataacttgactattttgtaactgtatttcaggtttgcacctaatcatttactttctaaagaacacctatgaagtttcattttacaggaagtgagtcactatcgctatcatgggaaattcgagtatttagcattttcaagtatgttttgtcccccctttttttgcgagttaactgacataaggttgcttcaaatgggaaatatgtactaataagttgcatcacattatgcatttgcctcattttaaaacctgacacttgtggtgtccgtcatgatantggnggcgatttattttccc

SEQ ID NO: 79804 - DNA, 616 bp, Triticum aestivum
  unsure (1)..(616): unsure at all n locations
  Clone ID: PAT_TA_79804
ctcaccacactacagcagctctcaacctcaagtcaccgccaccaccaagaacaccacaagaacacaagagcacgcagagaccgacacgcatgaccttcagcgtctcggcggcgatggaggggggccacgagtacatgatccgcttcgacggccacttcgacgacccgtcgcccagcactgccaccgccgagccgccgccagcgccgccgcagccgttcgcgggcagggcgatctcgccggagcaggagcacaagcgccatggtcgccgcgctgctgcacgtcatctccgggtacaccacgccgccgccggacttcttcccggcggccgcgaacaangaggtgtgccgggcgtgcaaggtggacggctgcctcggcttgcgaattcttcggaaccggangcaaggaacaagggccggtcgccggcggnaattggaccgcgccgaaaggtnaacttgcgggcaacggnggggcngggccncaaaaggcgggggaaagggaaaaagaaanaaaaaanttnccgggggcgtcaagggaaacnccccgttgggggaaatttgggcaaccggaaantccgccaacccncnccccccccccttggngggtgttggnncgggac

SEQ ID NO: 79805 - DNA, 628 bp, Triticum aestivum
  unsure (1)..(628): unsure at all n locations
  Clone ID: PAT_TA_79805
ggcaagtcaaccacgactggccacctcatctacaagcttggaggcattgacaagcgtgtgatcgagaggttcgagaaggaagccgctgagatgaacaagaggtctttcaagtatgcctgggtgcttgacaagctcaaggctgagcgtgagaggggtatcaccattgatattgctctctggaagttcgagaccaccaagtactcctgcactgtcattgatgctcctggtcaccgtgatttcatcaagaacatgatcactgggacctcccaggctgattgtgctgtgcttatcattgactccaccactggtggttttgaggctggtatctccaaggatggccagaccccgtgagcacccctcctccctttgcgtttcaactcttgggtgttgaaagcaaaattgattctgctggctgcaancaaagatggattgccaaccaactcctnaagttactccaaanggccccgttatgnaaaaaaatttgtcaagggaagtccccttcatanccttgaangaaaggncggttannaaaccttgaaaaagggttccccttccgnttccaatnctcgggggttccaggggtgtcaaacnatgaattgannagggtccaacnaanccttgannggng

SEQ ID NO: 79806 - DNA, 598 bp, Triticum aestivum
  unsure (1)..(598): unsure at all n locations
  Clone ID: PAT_TA_79806
cgtgatcgatctccagcaaatccgcgcgatcgacatggaagcccgaacggatcgccaaccaccatccggcgatcctccgccggggcaacctcgctgggtgttgctccagggcaacatgatctgcgaggatcccgccgccagagcaacaacacccatcgccagcgacgatctcgacgccgagaccgtggcggatgctctgacctccggaggccgtaacgtccgcgtctccttccacctcgcggcgccaccggcggtgtcacgcctgcgcgtcgacatccccggcctgccggacggcacccagctcctcgcggagatcatcgcggccaacgcggactcggtccttaaaagaggtcgaagaccagcagacccggcaggtttgatactgacaaacgcgactcgtttggactacttcgtctataatggccngggccgccgccgccgaacccctcccgcccgcccgttcgctgtcgtttgctgcccccttacaaaaagggggcacccaaggtggaagccaacttatgnctgcaanaaaacaactggccnnccggcgccgcggngaacaaggaacctgcnccgtggngccggntgaaccctcaan

SEQ ID NO: 79807 - DNA, 548 bp, Triticum aestivum
  unsure (1)..(548): unsure at all n locations
  Clone ID: PAT_TA_79807
ggagagagagagagagagagaactagtctcgagttttttttttttttttttaaccatgtcaccagaagacttattgacagtgaaaacatctcctagaaagcagctgtttgatacaatctgatgttactacttgaacacatctgtctctcttagctttctccacaacctcctaaatgttcattgcagatttgatcagcccttccatagcttcagctccaagtcgatttccccttccgacacgtcggccctccgctcgctcggggctctctcccggtggaccggcccgatngggaggaagttgtagaatggcagggacgacgatgatgacgaaagctgaaacncctccccaagctggggtggcaatcgcgctgggactggaagtccctgtactccggggatgtgcatttgatgggaacaacaatgaaggntngcttcnatgaaggtgtggganggcccgggaagctcaangttgaagcaaagccnggnggttccctngcnacggccnggnatcccttgcngttgaccgaaggggggggccccggtnnccn

SEQ ID NO: 79808 - DNA, 539 bp, Triticum aestivum
  unsure (1)..(539): unsure at all n locations
  Clone ID: PAT_TA_79808
tacggggagagccacgcacgcgccgtccatccatggatctccccggcgcctccctccgtgctcctccccctcgcggcctcggcgcgctcgccgtctcggcggacgccgtcaggcttagcaccatcaccgccatcctccgcgaccgagaccactatgaagtgacggtttgcactgatccggcggcggccatggcggtgctccgcgcggggaacaagttcgaggtcctgctggtcgacatgcactccctangctgcggcgcgccggccttaanagctcttggagtgtgccgtcggcgaaatgcacgttcacacacatgttatttcgaaaaatggcgatngctatggacccctaaagatgaaggatntcggtattatcaagaatgccatctacaaatgaaacaaccaatnggtttaaagtcnaccgggaggccaatgccgaacaattcaatgcaacaactcaaccggtgnggacaacanccaacaacaacaaccttaattaatttcaaggaanggggggnaacaanaaaggaggatngggaa

SEQ ID NO: 79809 - DNA, 525 bp, Triticum aestivum
  unsure (1)..(525): unsure at all n locations
  Clone ID: PAT_TA_79809
ggctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcaacaaggttgggttcatcttccgtgaagcacaacgcatcccctgggtactacgatggccggtactggacaatgtggaaactgcctaagttcggatgcaccgacgccacgcaagtgatnaacgaagtggaggangtcaaagaaaggagtacctgacnccatttccgcaacatccggattcaacaaaatgcgttaaggtgaagtgggtcacntccatccccttcaagcn

SEQ ID NO: 79810 - DNA, 577 bp, Triticum aestivum
  unsure (1)..(577): unsure at all n locations
  Clone ID: PAT_TA_79810
ccagggagcggttgatcgatcaacccgccaagatgcagatcttcgtcaagaccctgaccgggaagaccatcacgctcgaggtcgagagcagcgacaccatcgacaacgtcaaggccaagattcaggacaaggaagggatccctccggaccagcagcggctcatcttcggcggggaagcagctggaggaggggcgcaccttgggcgactacaacatccaaaaggagtcgacgctgcacctggtgctccgtctccgcggcggcaccaggggaggctaacctaaacntngaaacaaatctctggcagctcgccgctcaagttcaacganaaaaaagatngtctgccgcaaagttctaacgctncggcnttcccctgaaggtccaacaaactnnccgcnaagaaaaaattncgggcancaagcaacgaancttgagggcccaagaaagagggtcgtccaaacaangcttttccaactngaagaattgaaaccaaggaacnggttgaagaanaanccaagaaggggaaangganccgttcccnccaaatgaaattgttttgggttttgggtttancaaagtt

SEQ ID NO: 79811 - DNA, 605 bp, Triticum aestivum
  unsure (1)..(605): unsure at all n locations
  Clone ID: PAT_TA_79811
gcttaattattctagtattatttcaagtcggatctcatcctgtcttgccttttccagatgtgtgtgcttggcagctcttctcttcagccaggagagtatctgccacaagtatttgtgtgtttgtgtctgctcagcttttatttgaaaagaaagggatcgctcgtcagctctggtttgaaaatatatgtagcatgtgcttggcagctcttgggaatgccaggaagttgttcctacatttttacatatatttaaaaaaaaatgtanatcgtttgcatggtaaagaagttaaattgaatcaaatgtacatnccttttgaggntttgactaaaacaaaccctcatncggaaagtgtcccgttgccgggtnaanaaatgaatatcaattgttaacaatgacctgaaattantggatnttagggagntttggaatgggaaaaanaacgggaacaatnaagggttgctggntngnctgtcccaaatgggggangtnattttgtaagtngggttcaaaattganccaaagaaaganntccatccatncctaaccaaccannctanttttttccgtttccgggaaaattccnggtcctggggcnggaaannatc

SEQ ID NO: 79812 - DNA, 603 bp, Triticum aestivum
  unsure (1)..(603): unsure at all n locations
  Clone ID: PAT_TA_79812
ggctcctcctttacaaaacccccctccatttcgctcaccgcaagaatccaaaatcatcacagcagagggagagaaagaaagagagggaaggaagagagagagagagaagagagagaccatggcttccgccgtcgcttgcaagggcaaggttcccgtgccggccagcctcctcaagtccggtgctcccgtggccttctgcgcgctccagtcccccgccgtcaccgccgcccgccgcccgtacaacacccagttcaaggtcaaggaggtcagccgctacgatnacgacgacgacgactacaagcgggccgcgacctcgtcatccccagcttcttctcgcaaggacgttgctcgacccgctcggngcgccgaaccagcaatggaacgtctgctgtctctgatggagggacgtcccaatctcaaaaccgggcctctcctcccgctgctggggggcgtcnccgggtccggacgcttggggtgggccaaaggagggacgaacnancgcgggtctaacttaaaggtgcccgattnccgggggcttgaccaaanggaacnactttggaggttgccccccggganaanaaaaattcttgggtggatttaaag

SEQ ID NO: 79813 - DNA, 185 bp, Triticum aestivum
  unsure (1)..(185): unsure at all n locations
  Clone ID: PAT_TA_79813
gagagagagagagagagaactagtctcgagttttttttttttttttttgacagcttgaaatgcaattgcanangcacacangtcaggatnctacaaaaggtganccggccacactccccattgcaaacaaaacatttcgcccaatgagatananttancctcactattccaganagaatgccctg

SEQ ID NO: 79814 - DNA, 531 bp, Triticum aestivum
  unsure (1)..(531): unsure at all n locations
  Clone ID: PAT_TA_79814
gacggacttctcttttttttttttttgaaataatacacggacttctcattgattgactgtgccatccgcaggctcgtctcgcaccgcgtacccctggcgccatgcaatccctcgggcatcccacctctgcgtcggaactgagggcgctcgcctggacgacgctccttgttccgatgtgcgcggtctacgcgcgctccgcctgccgccgcctccgtccgggctggccccgcctcgccgcaatcctcccgacgctccccgtcttcatctacctgccgtgcttgttcaactcctaccacctccgcctcttctcaaccttcttccacacctggctcgcccgccaaaaaactcgncctnctcncgttcgaactcnggcccgnttaaancaancccngccccnctccaatttcnctcncaaccgggnctggccaatcaaggttccgcgaangnccanaagccaccaaccatttctggcgttccccgggaaccgtccgttccccaatttcctttttcccctggggggccgnaangttt

SEQ ID NO: 79815 - DNA, 573 bp, Triticum aestivum
  unsure (1)..(573): unsure at all n locations
  Clone ID: PAT_TA_79815
ggttagggtttcactgagcttccatggagctgagatctcggcgctgcccgtccgagcagcctagcggcggaccagactgcatcagcgtccttcccgacgacctgctcctcctcatcctcgcccgactcggatgcgccggcgccgccgcgcgcaccggcgtcctctcccgccggtggcgcggcctctggccccgcctccgccagatcgtcttccgcgacgtcccctacgcttcgctcgaagcggcgctcgggggcgtctctcgcccccctcccccggtttccctcctcgaattccgcgtccccgacaagcgtctccctgggcatcgcaagcccgactcccgccgggnatcaactcgctgcttgctngcccgcaacgggggctcgaagccggaggctctcgtcgtggctctccctcncacttaataagntgtacctcgtcctccaacctgccttaanttcaacggggccggcctccaatcggngtaaaaaatttgtttcaatcctcaancgtggcctgccngggttcnannttccccccgccccaaaacncttttcnttggtcgggcntccctcc

SEQ ID NO: 79816 - DNA, 381 bp, Triticum aestivum
  unsure (1)..(381): unsure at all n locations
  Clone ID: PAT_TA_79816
gcttcccatcgccaggagacactcccttcagcgcttcctggagaagcgccgtgacagggtggtgagcatcttctgggatggaagcggtcgcggagggcaaggcccantaaccctgaaagaagaaagacggccctgcccctgatgtttggaaggaaaggggcgtgtgttagctgatgtgatgttacaccgtanaatcatcatcgttcgtgacgataataatgatccgacnagaacctctattgtcattgttcctgttgtcaattgtgtagtttaactctgtatcctgaactccggtttagtnctgcgggaaccgntactgctatgaatgaaatgttgtcgaatgttaaatccgtnggctggtccgtncccgggtctgactgg

SEQ ID NO: 79817 - DNA, 604 bp, Triticum aestivum
  unsure (1)..(604): unsure at all n locations
  Clone ID: PAT_TA_79817
ggtcacttcactgatcaagtagctggcaagagctttgagcgcgttgcaactttgcatcccggtcgatcgatggcgtccaaggtcgagctggtggtggaggtgaagtcgccggcggagaagctgtggacggcgattcgcgagtcgacggagctgttccccaagatcttccccgagcagtacaagagcatcgagaccgtggagggcgacggcaagtccgccggcaccgtccgcctcatcaagtacacccganggggttcccgatggtgtccgtaaaagcgtggtggacngcgaagctggtcaacttctacaaagaacttcaaggtgacngtgcaagttaccgacaaagggcgccaacngggggccggcccgttggtnaactgggccatggaccttcgacnaagggcaancgaacaaggtggcccgaagccggaccttcatcaaanggagaaccggccncccnaagaaccctcccangnaccntttaacgaacaaccttcctcaaaaaaactnaanagtancnttttaacnaacttgcccccgtccccttgggccggccgnggtncgttcntccgttcaaancnaaccaanccatgtncaacgggcn

SEQ ID NO: 79818 - DNA, 607 bp, Triticum aestivum
  unsure (1)..(607): unsure at all n locations
  Clone ID: PAT_TA_79818
gcaccaaaccccgctccaaaatccccaaatcccctctcttccgaagctactcagccatgtcggggcgcggcaagggcggcaaggggctcggcaagggcggcgccaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccggaagaccgtcaccgccatggacgtcgttctacgcgctcaaagcgccaaggaagcaaccttgttacggatttcggcgggctgaaganccccggcgctttgctggcccggccggtgggcgcaanaaancccttggctccgccggtcaaagaaaagttggagggaaaaaggaaaaaagcttgtaattttaatntnggggttccaaatgnccttctaatgaattaagtaattaaataatcctgttnttaacaattancttgggttgttcaaatnggttgcctcaattgttcctgaattttcgattgggcaaaanactng

SEQ ID NO: 79819 - DNA, 538 bp, Triticum aestivum
  unsure (1)..(538): unsure at all n locations
  Clone ID: PAT_TA_79819
gcctcgtgccgaattagagagagaggatctcatatcgcccggatcccaggccatggactgcccactttgcaaaaacccgcctgccgtatgtggagatctcgacggaccgccctgccacatttcagttccaatgacaaccttctattgggttgaagcttttgtcccatgctgcaacaggcgtgtgatcgggtcatgcattgagcatatgcggtccattgctgccaaagagaataagcccatgtgcagtacgatctttgtaaccagagaactactggagtatgaagtgttgattgatcatggagctaagaagactaggattcaaggggatggctggcataagtttccttgatgagtatgtcgtgcaacctggcgacatgaatatatatctgcctcccccgaagcaatgggnagggtttttgtgggatgtccgtttanagatggggttganggnaanaaanccgcttccttaanctggcctccgaaanggcctgtcanctcaatgaaagcgtgaagccncatccaacaaattgcgntttan

SEQ ID NO: 79820 - DNA, 612 bp, Triticum aestivum
  unsure (1)..(612): unsure at all n locations
  Clone ID: PAT_TA_79820
gggcgtcttcgtactcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaaccgcccagctcttccaaccctgangcaacttaatcaagtggcaaaggganggattgaagccaaacaaacttcgccccgttggncaattaaaaccaanttgggcaaagggagaatttgtttgattcccctgccctngattgttnacaaggaaagcttttaanaacaanctggcactnggtnttggcaggggaattccctttncttcaancgctntttgggagggtggnaactgggctcnngggcctttgggtcnncttcccct

SEQ ID NO: 79821 - DNA, 504 bp, Triticum aestivum
  unsure (1)..(504): unsure at all n locations
  Clone ID: PAT_TA_79821
ggagaactagtctcgagtttttttggcatgcatatgcccgatttggaattagacgcacgtgaggttttgtatatgtgacggtggtgctctagtatgtgattacgtctggacgtgtcacacaaaatagaatatatattgccgtgtgatcttgtgtagtttatcttaggcgtacgttgtccagactattctctttttccgtgtggacgattcctgcttgcactcattaattacatgtagatgattgactcctttccgtacatgtacaatatatgcatatgcatagacgtgacaacgtgctaagttcaaataagttaagttaatacatggttaagcatngttacgttaaaaaaccttttaaacctcaagccattaattaattttgaaatcctaaccgggtgcaaaataatattaacataaggtgggataaatggtggggangcctaatttggnctccaattttaaggtanacaaanaanaagatntttccccngtnccgttttgccc

SEQ ID NO: 79822 - DNA, 354 bp, Triticum aestivum
  unsure (1)..(354): unsure at all n locations
  Clone ID: PAT_TA_79822
gccctacccgcctcggccatctccggccatctcctctcctccaccaatcctcctccgatccaatccccgagtctcgacgccgccgcatgccgccgttgctgccgccgtttgcctaggcctctgccgcccccatcgccggcgcgatggggaacanctgcgccnggncccatcgccgggccccagcgcnacggcggaccgccaacgggatttcttangcaccgttctcccggtcgccgtactgtgggcgcccccgnggcgcncccggcgcccgagcccgggtggntccaancggcccgatttccntggccccctccaanttncntcctccaaacttccgtcctgcgggggccnccg

SEQ ID NO: 79823 - DNA, 538 bp, Triticum aestivum
  unsure (1)..(538): unsure at all n locations
  Clone ID: PAT_TA_79823
ggaggactgctgtgctactgctgctgcgtgctatcatcactccgtcaatgcttcgtcccgccgtcgatgagatacgcggctgaaagatcgcccgccggcgtccagaagcccaacacagggaggttcaatgtgttggtgcatgtcggcggggccatctatgtcgtgtacaagcacatatacatgggcggcggtgacagggccttgcttccatcatccatcaccattctcgccgtcggtgttgccaagtatgtggagagggtactggcgctttggcaaggcaacctgggcaacatccggagctcaagcaagaagaagaagaagaagaagaggcaacgaaggagatacaccgatggctcgggctccgcaaagcggaacggtgctggacaaatgagcaaaccctgatggtttgcccacgacatgtttcccgttctngcaagcgtgcaattgaccgattcctcctgtaaacaatggattcaatctgacccttgaagcaaacnaaagtcatgttctccttttggggtggggaaaantatgttca

SEQ ID NO: 79824 - DNA, 339 bp, Triticum aestivum
  unsure (1)..(339): unsure at all n locations
  Clone ID: PAT_TA_79824
ggcggaaggagaacatccgtcaagccgtccgtcgcctgaggcggctacaccagaggtccgtgggttactactcctttgctcttgctggcgaccggcctccagagtagcacttgcttgagatctgatctagaactgaattgtgccctgctttgctgtggtccgtatgctctatgtccaccgatgagtttcaagatacaagattaggaccaaaattggagtaggttcaagtcgcgcaaatgttgtatcactttgtcatgggtattgtgctgttgaattgcttgttggactgttcaaactaaagtcgtccaatcaagtttgctacaanatcaaaaacctttt

SEQ ID NO: 79825 - DNA, 651 bp, Triticum aestivum
  unsure (1)..(651): unsure at all n locations
  Clone ID: PAT_TA_79825
cccgccgccgcctcctctcggttccttctccttcctcggagctccagccatgggtaaggagaagactcacatcaacatcgtggtcattggccatgtcgactctggcaantcgacaaccactggccatctgatctacnagcttggaggtattgacaagcgtgtgatcgagaggtttgagaaggaagccgctgagatgaacaagaggtctttcaagtacgcctgggtgcttgacaagcttgaaaggccgagcgtgagaggggtatcaacattgatatttgccctgtgggaaattcnaagaacaacaanttactaactggcaccggtcaatttgatgcccctggtcaaccggtgactttcatcaaagaaacaatganttactgggtaacctcccaaagcctggantggngctngtgnctcaatcaattngnnctcccaaccaaccngggtggggnttttganggntgggtatnctcccnaanggttngggcaaaannccgtngagcnacccccctncccttgnctttcanccctttggnggttgaanccaaanttattnttgttgntgnaaanaaanaagnggccccaaccactncccaaattattccaaaagggcccgttttttaaggaaaatnntcnaagggaaatnccntc

SEQ ID NO: 79826 - DNA, 536 bp, Triticum aestivum
  unsure (1)..(536): unsure at all n locations
  Clone ID: PAT_TA_79826
ggccaagcggcggcgccgccgcctcccgtcttctcgtcgttctcggaggatgagggcacgaaggatgtggctgtaccgtcgtgccctccacctgcgccggcttatcaacgggaccttgcgcggctccctcttatttcagctccgcccgcgcccgcgccaccgtcgacggcgcggcttcggcgtccccggtggctcctgtccgacgcctacagcgcttcctcgcgcggatgcagcgggctcctggccggtagaggaggagttggatgcagattgttcctcggcgtggtcctgctcgccgccgacgaggccctgcgaggggcgaggagacggctccactgctccgagctcctccgacgtactgctgctggtgccatggaggtccaaccccactctcgccccctgtcctctctttcaaggtactggcactgcaacaacgaacttantaacaaatctaaaacaaannattactgaaanttaanccggggcnaataaaaataccctccgtncaattaacaattttattaanattgcgaatg

SEQ ID NO: 79827 - DNA, 543 bp, Triticum aestivum
  unsure (1)..(543): unsure at all n locations
  Clone ID: PAT_TA_79827
gcaaaacaatccaatccaatcccccaagagagagaagaggaggaagatgtcgggccgcggcaagggaggcaaggggctcggcaagggcggcgcgaagcgccaccggaaggtgctccgcgacaacatccagggcatcaccaagccggcgatccggcggctggcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccaaggccgcaacctctacgggttccggcggctaagccgagggcccaaccgttcaactcgccaagccgcccgtccgaaccganaattattagtgggtatcctaatctaagtttcctgtctaagggttcgtggctcncccttgtttccncaattttttcccttggtgtgttttctncncccgttcttgttaaccttggtgttttnactggnaaaaaattc

SEQ ID NO: 79828 - DNA, 587 bp, Triticum aestivum
  unsure (1)..(587): unsure at all n locations
  Clone ID: PAT_TA_79828
agagagagagaactagtcncggnttttttttttttttttttttttttaccatgaaaaaaaaaagtactgcagtagtagtgtgtggctatagtgtggcatagcttgttgtgcgttcgtctgaaattgcatgagacgagatagcttgggtggggctcgactaatgcttgagcacgtcggggacgtcgatggggtaccgatggacgcaggtggcccagggcccgtcggccgccacgggcgccgggtgtatgcactcccaggcggcgctgttgcacttgaacccgggagccgatncccgatnatccaaacgcggtcgcccttgcgcatgcgcccctttgcctcgaatgtaggcgagctcctancaaaacgaactgctccacgtgttgccgnaaccggtgcaacgttatcctcgangncctccaanctgctcgtccgaaaancctnaaggctgcgctngagctccctcgattaacggggcggcccgcccgcgttggattttaaaanntgctncaaaccccctngcgggaantccnggaattttccggcttgattctgctgctgccgacnaactttggccccnacaaaaggaa

SEQ ID NO: 79829 - DNA, 484 bp, Triticum aestivum
  unsure (1)..(484): unsure at all n locations
  Clone ID: PAT_TA_79829
gatgggcattaaacacccatagtgatgccttgttctccggcggagaacaaggcgtctaatatgacggaaggtaccttcaggaagatcagagaggagcttatgcgtggttatgttttgaccaaggacctagggagccatgattttgagtgggcatggatttttgaacccttcccatattcgacaacatatgaacaatttcttcgcattgctctatgtgctccaacttctgaagaactgcatgattggactggatgggttaaatcccgcttcccttaccttattctcaagctggaagataacggcattgagtgtgaccccaattcatcacaggaagttgatcatacagtcatcaaacccaacattggttatcactgggggcctccatccctcaaatcaaatnctccttcttggattccnagctctctgaannggaaanatttcattnaaatatgttcatncnaaatnattttctnatgggaaaagg

SEQ ID NO: 79830 - DNA, 181 bp, Triticum aestivum
  unsure (1)..(181): unsure at all n locations
  Clone ID: PAT_TA_79830
gcctcgtgncnaattctnatacgcttggnntggatgtggattgcttgagacttgttntctcactatcctcacttcactcctcttcatatgccaagctagtaatcacnnctctgaatantgccatcccgtgccctcagcaanattcaagttctcgtgccttggtgggaagatgtgcccgccg

SEQ ID NO: 79831 - DNA, 210 bp, Triticum aestivum
  Clone ID: PAT_TA_79831
aaatgggtgtggaggataatagtcagattggaccaatggcgccctcctgctacacattgtcccccagatgtatcgtgggttcaggggctacagcctaaccctgttaaaatgttttattgttgaagttaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 79832 - DNA, 462 bp, Triticum aestivum
  unsure (1)..(462): unsure at all n locations
  Clone ID: PAT_TA_79832
cagaaaaataaaaagaaaaaaccccatccccaacctcccgatccccacctaccgcgtgctttgcgccaccgccccaggcctccgccacccaccggccgtgtgcaccgcgctgccgtcaccagccccgacgacctccggccctacgcgccgcgccacccccacaagccccggctacctctggcccttcgcgccgcgccgccgccacatggctccgacgacccccggccctgcgcgtcgagccgccgccacgccacctccccgtgccaccatggtacccacgcgcccaccaccgtcccggcggcgccatctccggcgtgcctccgcccgcgcacgtctcaggtcggggcccctgcacctcgattctcttgcgcgccgtttcctacgggctggggatcttgcgcccctggaaaccgnctttctncanccaacaagcttgnnacganacgncnaacaacgggggaa

SEQ ID NO: 79833 - DNA, 181 bp, Triticum aestivum
  unsure (1)..(181): unsure at all n locations
  Clone ID: PAT_TA_79833
gcaggggttggtttctcctccccactcagtcctcggttcccggtccggttcggttctnttcggttcgttanggtttattaacgnggaagatgaatgcatggcnntacgtcgagtancgctgcttcgtgggcggcctcgcctgggccaccnantaccagtccctccannacgccttctccaa

SEQ ID NO: 79834 - DNA, 585 bp, Triticum aestivum
  unsure (1)..(585): unsure at all n locations
  Clone ID: PAT_TA_79834
gagagagagagaaggagagacagacgacgacnacnacnaggaggaggcgctaaacccaccgggccggtgccgaggagacccgaggccaagccgcatcccgggcgggcggccgcgcgcgcgcgatggcgagcaggacggcggggcggggcgggaggccgctgctgggcggcagcgccgggggcgggaggcgcgggaagccatccaaggcgatcatggccgcgctgctgctggcgtcggtggcgctgctgctcctcctggcgctcggcgcgctgtcgctgccggccggctccggccgcggcgcggtcctctcgctcccgcgcccgcgcttccgcaagatncgcgttcgagtcgaggctgganaancgcgggggaagaaaggggaaccgtggacggaggttctgtcnttgggagccacnggcgtttatctaacanaacttcctctccaaggaangaatgtcaatatttaatttcattgggcaaaacctcacatgaanaaantccaccgttggttnatttcttgcaactggtgggagtaaaaatatcaaggtgnnaaacaaatttaaggaaaantttcttaananangg

SEQ ID NO: 79835 - DNA, 476 bp, Triticum aestivum
  unsure (1)..(476): unsure at all n locations
  Clone ID: PAT_TA_79835
gggctagcgatcagccagaacctttatttattcgtccttcagcatggcggtattccaatgcctatgctcaaaaccggaaacccagcctaacagaagctgagcaggatggtaatgtatggcgtgtttgtttctccaatcactccnccgngtaatgaattagagcaggcactgcaacttctacagcctcagtgggtcatttcaaccactcccccaaattttgcgagtgaactgagttatgtaaggagacgctatttatcgcacaccacacagggacatgcgcaatcaagcatctgtttccgcacaacatccagagggaaggaagactatgaatattttattcgaggaataccgtcccgaggggcagagaagccctagagttgtgcagatagaagaaacatgggtggacataagacattttggactatcaatngggtggtgaacgggttatnctaatatnaaaacntngttttcaaaaa

SEQ ID NO: 79836 - DNA, 251 bp, Triticum aestivum
  unsure (1)..(251): unsure at all n locations
  Clone ID: PAT_TA_79836
aaaaaaaaggaanaccgtctcaaaggaanaggagcacgcgaaccgaaccgatcctcgcgccatggnggnagtancgtccctcaacnccgtgtccctgttcncgccgtcgccccangncccgggggcgaccgccgcccgcngccgcctcctcgtcccggaggcccgtcacttcccgtcgntgcnaggccgcgcggcgcgtcttcgcggcgcgggcggnncccgtggacnccaangacgaagtgggggaagga

SEQ ID NO: 79837 - DNA, 623 bp, Triticum aestivum
  unsure (1)..(623): unsure at all n locations
  Clone ID: PAT_TA_79837
gttcgatagctagcttcctgatcgagcgagctagcgagccccatgcatgcaacttcttcgcagcctccctccaccccggcccctgccgatcagctccaccatccgagagctttgtaggtgacttactcgcctggtgattagcaggcaggaagtagctggtttttaacccggcgcaccgcccacctactcgccatctcctccggttctacaccgcagcaacatcgatcgtttaccctcctgtacgtacctagcccgtacnttgacgaacgggtgacctccctccttgggcgncaatgggggaactcgtngcgtgaacctctcccgccgccgtcgccgccgcnaaggcgccccggggcttcgcccggccgggntccggnnggccaacgggaaggagcgtnnggtgcaattgtcngttcggtccctccctcggttgaaggaaggtgcaactggccgccggaacggcgggctttntncgtgncgggcatccgccaaatcggggtancctggggcgggctccctccggggtngggtcgccgggncggccttcccttttgcccgggtgcaacgggaaaaaaatctnccggggcccngttntccaaattntgannttattcttnacttnt

SEQ ID NO: 79838 - DNA, 595 bp, Triticum aestivum
  unsure (1)..(595): unsure at all n locations
  Clone ID: PAT_TA_79838
gcaacgcccccccaccccctgtcctgcggcgagagcgcggcgcgggcgggctaggcacccagatctggtgcggcggtcgccggagatggcgtgcatcaagagcgcgcagcgcgcggcgctgacggcgctcgcgccggaggcgccctacctcgccgccggcaccatgagcggcgccgtcgacatgcaattctccgcgtcggccaacatcgagatcttcagcctcgacttccagtccgactcccccgacctgcccctcctcgccgcggtcccctcccccgaccgcttcaaccgcctctgctggtcccgcccgggcgccgccgacggcgactccttctccctcggcctcctcgccggcgggctcagcgacggctccgtcgccgtctggaacccgctcagcatgattcagctccgagggggcaagcgggaggactcatggtcnncgcaagcttgaanaancacaaatggggccggtcacctgggatttggagtttngcganctcaanaccgaaancggggntccgcttcaaggtggttaaccgaggggggganattttccatcnggggatcncaaaaaacccctggcgnngccaaaact

SEQ ID NO: 79839 - DNA, 586 bp, Triticum aestivum
  unsure (1)..(586): unsure at all n locations
  Clone ID: PAT_TA_79839
gttgtcgtcgcctcctcctaaaccactctccctatccccgtttccanaagctaaccccggctccaatggcggagaaggaaccgatgcgcgtgctcgtcaccggcgccgcaggacaaatcggatatgctcttgttcccatgattgccangggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccangaangaaggaatggaaanggaggatgttntgacgaaaaatgtttcaatctacaaagctcaagcatctgctcttgangnccaatgcaaccccccaatttcaanggttctgggttnttgccaaacccaagcaaacaacaantggctccncaancctgnaangaggtttgcnccaancctatccctganaaaanaaaanaaattnntttggaccccncctnaaaananaaaaanggnaattng

SEQ ID NO: 79840 - DNA, 498 bp, Triticum aestivum
  unsure (1)..(498): unsure at all n locations
  Clone ID: PAT_TA_79840
gctccaaaccctagcctcctcctcctctcgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcaaccccttatgcagctatgcttgcatctcaaggatgttnctgtaagatgttaggagctttgggatttactggctctgcaaaattaaactcccgttgctaactgggtgggaaacaaagacaaaaaactccaaggtcctggtggctcaaagcctgcgccttaagaagctccttgcaacgnttctggggaatngaaaaatttgggaccgcaattgganggaatntttnaccccnggtccccaacttaa

SEQ ID NO: 79841 - DNA, 470 bp, Triticum aestivum
  unsure (1)..(470): unsure at all n locations
  Clone ID: PAT_TA_79841
ggttggcttctcctccccactcagtcctcggttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctgnacggccgcaacatcaccgtcaacgaggcccagtccccgccgctcccggtggaggcggcggcggcttcngcnggcngcggcgggcggcggcngctaccgccggccaaacntcnttaaagaaggangcggncgggcngctaccnaagctggggggcggttgtt

SEQ ID NO: 79842 - DNA, 479 bp, Triticum aestivum
  unsure (1)..(479): unsure at all n locations
  Clone ID: PAT_TA_79842
gcctcgtgccgaattcggcacgagggctcccagttcttcatctgcaccgtcccctgcaattggctcgacggcaagcacgtggtcttcggcgaggtcgtcgagggcatggacgtcgtcaagaacatcgagaagggtgggctcccgcagcggcacctgctccaagcaggtggtcatcgccgactgcggccagctctagatccgcccgcgcgcgggtcgcctttcgccgtcgtcgtcgccgccccgtgtgtcccgtgtcgtgtcgtccatntaaataaaanaatcgtgtgtcgtgtcgtgtcctcccctgggtcccgtccgaattaagatttcccgtggtttggnttaaagaggggtttaaggtggactccttttgggctgctggatntctgttccggccgcccttgggtnancctccctggngtctgcngctaacttaacgtttggaataaaaatnaactcccnccttttnaatttccaaa

SEQ ID NO: 79843 - DNA, 172 bp, Triticum aestivum
  unsure (1)..(172): unsure at all n locations
  Clone ID: PAT_TA_79843
aataancaatcccagctttgccaataatcccntgtgcttcctcatctcnctctttngagtttctcaggtcatggagatgaaaaaaattgcctgcnccgtcctcatcgccgcatcggngaccgttgccctcgctgcngatggnccggcncttgcnncgatgngatctncttca

SEQ ID NO: 79844 - DNA, 513 bp, Triticum aestivum
  unsure (1)..(513): unsure at all n locations
  Clone ID: PAT_TA_79844
ggctttcttggtcaactttgataagcatcagtcaccaacagtagtattccgtaatatgtctttccaactggcacccaaatccatcagtattctatcagagtgcaggacagtggtatttgaaacagccaaggtaactgctcagtatgggtcaagaacagccaaagcagtanagtctactaacgatattcatagatggaaggcatttaaagaaccaattcctgaagatataagcaaggctgcatacactggaaaccaactctttgaacatctctcaatgactaaagatgagacaagattatctctggtacattgtcagctacnaatatagaccaagcgatgatggcagcttgtgcttcttaaatgttgagtccacgancacatgtatgcaatgccttttgtcaacaactgaatacgtaagggagtggtgcatgggagtcaanaatgganctggcaacataattctcaacacngaatatttcnctaaaggggggggnaanaacacaatatcaattg

SEQ ID NO: 79845 - DNA, 560 bp, Triticum aestivum
  unsure (1)..(560): unsure at all n locations
  Clone ID: PAT_TA_79845
gcaccttgcaagagcccaaactagttccattccatggcgccatccgagtcccagcatctcgccttgttcctcgccatcgtcatcaccgccgccacgctgttcccctcggcggccgccgtccctgccaaggcccctgctccctccgccagcaacgatgcagtagcaaaaccattggcatggtgtatgattccttgccttccgatcctgccacccatattgtgtgtaccaccgatattctgtcccccaacgcctagcgctccaccaccgccatcccctttcaagccgcacccgaaggagtgcctaccgtcactgatgggactgatgccatgtaagggatttcctcancaaanagcaccgcgcccaagcctccacgccaaggcaagtgctgtgacgggcgtcccggtcactcttccaaaaaattttcccaatctgcctttttgcaacggtgtttaaacggggggggnaccttgaaaaaaatnaatgtngggnaanccaatcgaattggggggccnaattcctttgggcctctccgtnctngnctgttaaanacaaantcccan

SEQ ID NO: 79846 - DNA, 303 bp, Triticum aestivum
  unsure (1)..(303): unsure at all n locations
  Clone ID: PAT_TA_79846
gcccccacaccgcacacacgagacaagacaagaagcagagaccctacgcacgcacgcacgcacgcagacgcgaggatggcacgcaccggcgccacgaccacnacgggcagctgctgcggcnttgctcctgctggcgctggtggccaccgggcccccccgcggtcnacccggncgcttggcgggcattaanntaattgttnccgggggntcccccgcggcttccggggcccaaccgggnggggnctngaccncatttanatgggggcgggttgcgganacaaaggntcacatcntccncccttt

SEQ ID NO: 79847 - DNA, 597 bp, Triticum aestivum
  unsure (1)..(597): unsure at all n locations
  Clone ID: PAT_TA_79847
gcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaaggatnaggaggacaancaagcaagcaacatcaccaaccagttcacaaccaacccagcgtntcatcaacagcccgccgcaatgcgctccgcgccgcgcgcggcgctgnataaaaatnaaaaccaaccgtttcnggttccgttntttctgttttgcccctntnccggggtgttccaacaanttatgttccttccccaaggcctccancttntaaangaanaaattggggcccncaaattttg

SEQ ID NO: 79848 - DNA, 349 bp, Triticum aestivum
  unsure (1)..(349): unsure at all n locations
  Clone ID: PAT_TA_79848
gcgagttcctgcagctggacaagaggaagggatgcttcaatttatgccttccagttcacttgcgtgggtaacttgatactgaggatcaggcatgccagtgcagctgggtgtccaaacgacttgttatctttcgattggaaaaatgtattctgcacattctaccttcatttctcgagcagctctgtttctacaaaaaggttacctttattgctttatttattaattgctcgttctcggattttatcaggacatcacaatactattagttacctacagaacttccaccctgatgatgatggtccttttggtatacctgccaaagcttggaaacttctatgcngngcacaac

SEQ ID NO: 79849 - DNA, 549 bp, Triticum aestivum
  unsure (1)..(549): unsure at all n locations
  Clone ID: PAT_TA_79849
gctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcaactgcaactgagccggcgcccaggaggccggccggcaaaggcgagcacgangatnaagaaggacaaagcaagcaaagcacatcaaccancagtttcancancaacccaagcgttatcatcaccaagccgccgcaatgngctcgcggcgcgcgcgcgncttaataaaatnaaaacaaccgttcgggttcccgttattncntttngcccccctttccccgnttttttcaaacnatttattnttctttcc

SEQ ID NO: 79850 - DNA, 583 bp, Triticum aestivum
  unsure (1)..(583): unsure at all n locations
  Clone ID: PAT_TA_79850
ggagagagagagagagagaactacggctgtatgttgatgataagcttcatgagagctgtccgtttgagttcccccgtgtcttgaaaccgctggcattctgctgcatcgggacaaacccgccaccaactattactggtctgcaacggcaatgcccattatttgcagaaatggggcctatctatattttcatggagccgattggcccagagagaatggcccggctagcttctaggggaggagatgcacttcccagcttcagcagcggtgctggtttgccttgggaaagctagctgtgatcacattagggaaatgtcagaagatagttatacacttgacattgagattggaggaagcttacatcttctttatcatcctagccctacttaacgggccgattttgccccgatgcttcaaccttctgggttcaacaagtactcaaccgaaggcctgcgggaatttattgggatgggtcaaaatatncttgtcccgtgcgaacctgcaaaaatcaattaatngggcaattaaccttgttggagggtccaaatgggntttactaacaaattgactggttgagcaaatattg

SEQ ID NO: 79851 - DNA, 338 bp, Triticum aestivum
  unsure (1)..(338): unsure at all n locations
  Clone ID: PAT_TA_79851
ttctcctctacaaatacccacgtacgtgccccgggttcttcagccacgtccacagtcgcacaagcactcttctagttctagccaacccgtacgtgcaagcacctctgcaccatcgggttttcagcagccatggcgccgaaggcctccctcctcgtggggctcagcctggtcctcgtcttcaccgtggccaacgcggtgcggcgacagctgcccgacgccgactccggcgacnccgacgccgacgccgtcccacagcaagtgccccaagaacgcgctgaagctcgctgcgtgcgccgaacgtcctgggnctcgttcaggcgcncgangggtccgggcca

SEQ ID NO: 79852 - DNA, 462 bp, Triticum aestivum
  unsure (1)..(462): unsure at all n locations
  Clone ID: PAT_TA_79852
gtccttctcaaaagttgaaccgcctctgccattccctaaagcgaagagaagcatctcatcctcctcctgcaccgccccttcccttccccttcctccactgattagcatcgtggattgatcgccgcggcgggcggccatgtgggtcgagatactgtgcggcctggtggcctacaagctcatccgcgccgtcttcttctccgacgatggcctcgaccaagctcgccggcctcgactcctcccactccgatctctgcttcgccgtcgcagccaaggctcgagaggctctacggngggcgctgcttcgtcggcctccgcatccccgaccccgaagccggggcgcgccancatgtcgaacgtngttttcgtcaacaaagagggaagtcatggggggtnggaattaaaaaatgtctctggnttttgttgaaggttgaaaaaggatggnaaactgggtttaccgnaaaa

SEQ ID NO: 79853 - DNA, 578 bp, Triticum aestivum
  unsure (1)..(578): unsure at all n locations
  Clone ID: PAT_TA_79853
ccccgatccacctccaccaaaccccgcgctcctcaccagaccagggcgcttcagtcgtggaggggatgctgctgatggccgcgcccgccgccgccgaccagcaccagaggcgccgccggggacggccgccgtgcgccgatctgctcctcaactgcgacctgccccctccctccaagctcttcggcccgttcccggccctgcacccgcagagggaaaggctggagagcgcgggcgggaccgacgagaagggcggcggcggcggcaaggacgtcctgctgcaggcgctgcgcctgtcgcaatccgcgggcgcgggaaggcggaggaaaagctggccgccgcggccgccaacaagcggaggcctcgcgggcgctnctcgtgcggggactccgttggcgctctcggggcaaccgccggttgggtgattaatnccttggagggccnaaaaactcccgcngctcaanggcnaaggaaggaaggaaggaangaangnacccccccggcaccgnngccccaacaaagaaaggattgggcccggggggcccccccgggaacccggntngncccccccctngtttggt

SEQ ID NO: 79854 - DNA, 384 bp, Triticum aestivum
  unsure (1)..(384): unsure at all n locations
  Clone ID: PAT_TA_79854
gctccgcctcttcttctcccccctgctccgaccttccatttccgacaatcactccccgggatcccgccgcaccaatccccaaaccctcgaccgcggnggcgacgactgagcgagctcgccgcanngattctctcgacgccgccatgggctgcttcctctcgtgcttccgcggccgccccgacccggccagccgggccctccacgatccgctcgtgcgcaagacccggctcggggacgccttcctggacgaccaccacgacgacggcacggcgaagcttgaggagaagccggacgcccgaaggaggggtctcgggaacgacgggaagggtcgncgganacnttcangcggagagngaaattancnnattcgtgngggggaaatat

SEQ ID NO: 79855 - DNA, 496 bp, Triticum aestivum
  unsure (1)..(496): unsure at all n locations
  Clone ID: PAT_TA_79855
gcaccgccgccgcctcctcctctccgctccttctccttccttcgagtttcagccatgggtaaggagaagactcacatcaacatcgtggtcattggccatgtcgactctggcaagtcgaccaccactggccatctgatctacaagcttggaggtattgacaagcgtgtgatcganaggttcganaaggaagccgctgagatgaacaagaggtctttcaagtacgcctgggtgcttgacaagctgaaggccgagcgtgagaggggtatcaccattgatattgccctgtggaagttcgagaccaccaaagtactactgcaccgtcnttgatgcccctggtcanccgttgacttcatcaagaaacaatgattacctgggtacctcccaaggctgactgtgctggtgcctcatcatttgactccaacanctgggtgggttttggagggctgggtatctcccaaagggatnggcaanacccntttnngaacncccccccctt

SEQ ID NO: 79856 - DNA, 600 bp, Triticum aestivum
  unsure (1)..(600): unsure at all n locations
  Clone ID: PAT_TA_79856
cctcgtgccgaattcggcacgagggagagagttggcaagcaagcgcagacagacagagcttgagagagcgcgcgcgagatggcagcctccatgatcacctcgccgattgtggcgccgacgancctgccgtccctctcccgccggggctcctccttcgccgtcgtctgcaacggtggcaagaaaatnaaggtcgacaagcccctcggactcggaggnggnttgacagtcgacatcgacgccaaagggaagaangtcngcaaagaaaggcgtttaacaatttgttnaaaaagtacggggccaaagtccnacgggtaaaagccaatctaaaaccccggagaaagggctgaatntggtgaacgctaccccggngggaacaaccgggcnttcttatctngggcgttaacctcnccnggctcctccgggggggggggtnctcctcntctaaaaaaacaaacggctntccnccgggtnaanaaaacaaactaacnttttaaaaaaangggccnggtntcctgcttncaatgnaccttncntttaaaccaangntaactanccncccnttgaatgttttccancaacnaattccaaanttaatttttt

SEQ ID NO: 79857 - DNA, 501 bp, Triticum aestivum
  unsure (1)..(501): unsure at all n locations
  Clone ID: PAT_TA_79857
tgccagtagtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgattattcatgataactcgacggatcgcacggncttcgtgccggngacccancattcaaatttctgccccatcaactttcnatgggangataagggcctaacatggtggttaccgggtgacggganaaatangggtccgattcccggagangggagcctgagaaaacggctaacannatccaaaggaangnaacaaggcgcnccaaaattacccaatcctgaanacggggaaggtgttgacaataaatnaaaaaaaccgggcgcattaat

SEQ ID NO: 79858 - DNA, 574 bp, Triticum aestivum
  unsure (1)..(574): unsure at all n locations
  Clone ID: PAT_TA_79858
ggagaatcggaggaagctgcgacgtccgcgatcgatgggcgacatcgggagccggcggtcggactactttatactagcggcgctcgcgctcgtgccgatcgccgcaatggctctgctcgtgtgcctcgccctactaggcgacagagggccgctctactccgccgccatcgacgccgccaccggcctcgacgccgccgacctcggccgccacgatctgagcccgctcttcaacctcaccctccgcgtcgcctcgcggagcctcttcagcggcgactgcaccgcgcccggcgccgtcgtggaggtgagctacgccggcgtcccgctcgccgcggggcccgtcccgcggttctgcaccaagccaagggaggccagggagctgcgggccgtctggcgtggggggaagccgtnaaagtcctgggttcgttgctccaacggctcnccgggggacccccggcnaaggaaccccgtttttcaacttgggggtcaacaatcccggggaanccactggagcggganaaaaaggnaacaatggtntttctttaaaagccccctgggcctttcggggaaaaaggnc

SEQ ID NO: 79859 - DNA, 502 bp, Triticum aestivum
  unsure (1)..(502): unsure at all n locations
  Clone ID: PAT_TA_79859
cacactctctcatcagatcagccacagagtcacacaagcactagcttcagctagccagcctcagccactccgggcattttcttgcatccacgacggcaatggccaccgctgatgtccagaacccgacggccgcgctgacggaggaggcgcccgcggtggagacgccggtggccgccgaggaggccccgaagacggaggaggtccccgcgccggcggaggccgaggtcgaggcgtctgcccccgtcgaggttgaggcgaccaaggaggaggcgccgggcgccgctgagacggaggaggccaaggagaccgagccagcagctgcggccgagccggaggccgaggcgcccaaagagccagaggcgccagccgtggtcgagacagagaccaaggaggccgtggcagaggccgagccggcggtggtcgaggaggtgaaggaggaggccgcgcctgctgccgagnnnnnagcaccggccgtcgccgaggaagcaccggctgcagcgnn

SEQ ID NO: 79860 - DNA, 393 bp, Triticum aestivum
  unsure (1)..(393): unsure at all n locations
  Clone ID: PAT_TA_79860
ttttcgtcggcccgcgcgcccgcccgcnnngggatgctctcctccatgccgagatccgggtccttcgaggcggggctcagggcgtcctcctcctcgtccgttacgctctcctccacccccaaccccaagccctcccctcggttccaccgcagccgctccaccgccggcgcctccaaggcgcccccctcccnnngagaaacgtcgcggcatcaccggcggcggaggcgcgatgccgacgcccacgccggcgcagcagcgggtggcgcagctggaggaggagctcaagaaagagcggggtgacaaggatcgggtggtgcagctcgaggaggagctgaggagcgagcgggaggacaaggcgcgggcggtggaggagctcgannnnntnnnnaggag

SEQ ID NO: 79861 - DNA, 510 bp, Triticum aestivum
  unsure (1)..(510): unsure at all n locations
  Clone ID: PAT_TA_79861
gcacgaggccnnngaaacaaggggagcacacagcgtcaagctaacggcccctcggctcccgctatctatccatctataagtgcgacatcccgaaccaacctccaggatcctgatctcccacggaatagaaagttgagattttcccggttcagaatacgagcctacagcaggaaggtgcgtgcatgatcatgaggccgcgtgggcttccggcggcggcggccaggctccggccgcacctcccgcgcgtcaccgccttcctcatcgtcttctccgtcgggtactcgctcggcatcgtctcgtcgtccgcccgcccgtccacgcccaagccgtcgcagaccgtcatacggccgcacgccgcgcacctcaccgaggacgtggtgaagacgcttcttgacaagctgttcgacggcgagagcccgtacgcgagcttcccgccggcgcacacggccgcgctgctccaccctgcggcggcgcggccgcgcgggtgggggtcgacgggggcggtgttcg

SEQ ID NO: 79862 - DNA, 334 bp, Triticum aestivum
  unsure (1)..(334): unsure at all n locations
  Clone ID: PAT_TA_79862
gggaaacatttcaaagttttaggaattatttggggcggggccatcaaaggttgttcaggggggaccccccaacctagttccagcccgaggggaataaantcggggggcattttttcccgacttaccgggatccgccagggggggaaaacccggggtttcnncccattttttgtccccagggggccaaaaaaacccaagggccagggggattaaatttttccaaatccccagggggtccgccacccccccctnaaggggggggtaggctctgttctgatgtgttcggaacccccccgggggtctttttgggtttcggggnacccctaaaaaaaan

SEQ ID NO: 79863 - DNA, 468 bp, Triticum aestivum
  unsure (1)..(468): unsure at all n locations
  Clone ID: PAT_TA_79863
annnncaatgaaagtcctccgtaggttcttccaaacagcaagtacaaggtcaaacaatatgaataacatcatcgttcaattgtatatgggttcatccacttcaggcttgagcagtggaaaattggcatttccagatagaggtactctcttcgaattttttctccttctttgctttccttacacccctctggaagtgttaggcagtaaagaaaaggaaaataaccttgaatggtgaagagcaaggttgcctaaaccgtatctcaaaattgtcacacaacaatcatcgaacaaggttctaacattatgaaatcctaggaaagtatccaatcccgcgtgaagcatcacctgaaaatggaggaatcaagacatcataaagtgcaaatcatgaatacaagtctaccgagatcatgtagaatttggttctgtaatctgcaacgatgtaatattagcaaaagtcaatattttaaa

SEQ ID NO: 79864 - DNA, 524 bp, Triticum aestivum
  Clone ID: PAT_TA_79864
gcacgaggctcccttcgccctgctctggattgagtgattagcttctcgattcgatcagcaccggggccagccgatcgatggacgtggactcggcgccggcgctgaagaggaagggcgcggacgcgccggagctgtggctggacgacgacgtcggccctgggttcccggtcgcctcccgcgccaccaagatccgccgcctggacccggacatgatgcccgtcgtgcccggcgcgttcgtgccgccaccgccaccgggaacgcagctgcctgtggcaggcttcggggtggtggaggaggcgccgatgtgcggcgacgtggcggtggtgccggtggacatggcgacggcgccgccgctgccggcgaacgaggagcgggcgatcgtcttgtaccggcccgccgaggccgagcgcaggctgctgctcggcccgctccggccgggcggccatctccgcgtcagccccgagtggatccaagcgctcaacggcacgacgctgcaggaggcgagcagccgccgcgcgctgttc

SEQ ID NO: 79865 - DNA, 530 bp, Triticum aestivum
  unsure (1)..(530): unsure at all n locations
  Clone ID: PAT_TA_79865
gcctagataagtaccnnnntatcagcacctttaattagcttattctcagtcttggctatttggactactgtagaacgactcggtttttcaaagttagtaggcttatagacatgtttttattttaatttcttcagttttgtattttttcagctttaggttgctgctgcaaggtttcatgtaggttatagcaatacaacgataatattatgagcatatagctatacaagtgacaattacaagagtagtaaatgaatgaatgcttgatcatgtgggttataatttaatcgagtgcagtcagtttatttatcattctaaaacagtaccacttacaccaaacatcagtatagtatcatgttcacgtcagaatataagagatttaggaacagaggaagtagatggtaattatggacatcagagaggaatatatttgatcacatatagtatatagggacttttgtagatgcatgctacctgcacaagcacatccctatatggataaaattcactttattagagtactgacatgaata

SEQ ID NO: 79866 - DNA, 269 bp, Triticum aestivum
  unsure (1)..(269): unsure at all n locations
  Clone ID: PAT_TA_79866
gcacgagggcgcccgtaaacggaagccgacgccaccnnngagcggccagccgaacccgatgccgccgcccaactcctccctcccgctcgccgccgcccccatgtccgacccctccccatacccctccccgccccccaaccccctcgccgccgcctcctccttcctccaccaccacctctccagtctcgcctcgcgcttcgnnnnnncgcgccccgcgctcgccgcngnnngcccgccggggccccacggnnccgctgcccnnnncctcg

SEQ ID NO: 79867 - DNA, 520 bp, Triticum aestivum
  unsure (1)..(520): unsure at all n locations
  Clone ID: PAT_TA_79867
gcacgagggtgcattattcgcatcgtaatttgctatacttcgtacacagtggtcaacttctcatcttatatttctgtttttcaggtttcttgtctacgagtacatggaaaatggaagcctaaaggatcacctgcactcttctggaacaaaggcattaagctggcagacaaggctacagatcgcaatggacgtagccaatgctctggagtacctccatttcttctgtaaccctccactctgccacagagacatcaagtcgagcaacattcttttggacgaaaactttgttgccaaggttgctgatttcggccttgcgcacgcatcgagaactggtgctatcagctttgaagctgtcaacacagatatacgcggaactccagggtacatggacccagagtacgtggtgacccaggagctgacggagaagagcgacatctacagctacggcgtggtgctgctggagttggtcaccgggcggcgggcgatnnnngacaagaagaacctggtggagtgggcgcnn

SEQ ID NO: 79868 - DNA, 456 bp, Triticum aestivum
  unsure (1)..(456): unsure at all n locations
  Clone ID: PAT_TA_79868
ccccaacgctcagcagacgcagcgacaagtccgcggcacgcgcgcgcgacccgccnnnagaaagagggagggagagagatgatgggcggngccgacgccctcctccggcaggagccatggttcgtctccctggccatcctcggggcactgtacacagcgnncgtcgtgctacgcctcctctcaaacctcgccctcctcctgcgccgggcgagggacctccgccgccgctacgggncgtgggccgtcgtgaccgggccgacgtccggcatcgngcaatccatggccctggagctcgcgcgcttgggcctcaacctcgtcctcgtcgggcgcgaccccgccaagctcaagnacatctccgagaccatctccaagactcgcgccgtgcagaccannaccgtcgtcttcgacctcgcgctcgtcgccacccctcaaggggacnnngcggtgcggcggctn

SEQ ID NO: 79869 - DNA, 527 bp, Triticum aestivum
  unsure (1)..(527): unsure at all n locations
  Clone ID: PAT_TA_79869
ggcaggccgagcttctctttgagcgcaacggcgtgccgatcggaagacaggcgttctcgaagtggctgtacgtggtgccctgggggttctacaaggcggtgatgcacgtgaagaacaagttcagggaccccttgatcctcatcggcgagaacgggatcgaccagtcgggcagcgacacgctgcctcacgcgctctacgacaccttcaggatcgactacttcgaccagtacctccacgagctgaagcgcgcaatcgccgacggcgccagggtgacgggctacttcgcatggtcgctgctggacaacttcgagtggcggatgggcttcacctccaagttcggcctcgtctacgtcgaccgcaagaccttcacccggtaccccaaggactccacgcgctggttccggaaggtgatcaagagcgaggagtactgaagagtcgggcggatcgttcgttcattcatcctagcctcctaggtagcaganntgtttttttcttctttataaaaagaatggtgccagatgggtgan

SEQ ID NO: 79870 - DNA, 404 bp, Triticum aestivum
  unsure (1)..(404): unsure at all n locations
  Clone ID: PAT_TA_79870
caccagatttgcaggcagggattggattacaagcagattgattacatggaggggatcgatttaccgagcaagagaacagcacgcggacaggcaagagctagctagtagtattggtagtacatggcgcatctatggggtatggggtgtcagtctagccggcgtaaatgtggatgtggagggcgagggtgaggacggtgatgagggcgatgagtattaagcctgcctcctggtgctttcccaaggcttgctactgctatcctatgatctgcccgagtggctttatctgttatctgtctgtttgaacgtttgctttgtggtgtttgttttacaacctgttgtgttgtaagaaccttgtatctttgaacctgctttgcaccttggttaatatgcatgctatctggtnn

SEQ ID NO: 79871 - DNA, 528 bp, Triticum aestivum
  Clone ID: PAT_TA_79871
caggagttcaatataatagtgaacatgctcatgatctctatttgaatgcatgttcttcgagtactcgcaacctgcatcttgaatgggatcttctttcatgttgaaatcacaatttcggtcatcatgacttcctccaggaatgcaggatcagctgctgctgcttgctgcaggatctggttatcaacctgagatgtcactgctcaagtcatggcgacgaccggggatgtagctgatccaacttgggatgatgttgatgatctgctgctcaacaaggtcatgctgcttcgtttagcctctacgaaaatttacaagagctctagcctggaagtgaagaagtcaggagtatatttgtagtatatatgatagtatgttggtgaaatgaacgatgtaaagattgtgctattacaagagctctaaccaaggacaacctgaaaagtatatttgtagtattttggctaattggcatgtgttttgataattttcatctgtttactgttctcattgaaataattgtttcaaattgtggaa

SEQ ID NO: 79872 - DNA, 524 bp, Triticum aestivum
  Clone ID: PAT_TA_79872
cgcagcgcaagtcgaggaggaaccgaccaaggagagatggcgcgtacgaagcagaccgctcgcaagtccaccggcggcaaggccccccgcaagcagctcgccaccaccatcgcggcgaggaagtcggccccgaccaccggcggcgtgaagaagccccaccgctacaggcccggcacggtggcgctaagggagatccgcaagtaccagaagagcacggatctcctcatccgcaagctgcccttccagcgcttggtgcgggagatcgcccaggacttcaagaccgatctgcgcttccagagccacgccgtgctcgcgctccaggaggccgccgaggcgtacctcgtcgggctgttcgaggacaccaacctctgcgccatccacgccaagcgcgtcaccatcatgcccaaggacatccagctcgcccgccgcatccgtggcgaacgcgcctaaaaccctagatgggagatcatcgtgccgttcgtcgtaagctatgtattagttgatttgcttcttgttcttagccg

SEQ ID NO: 79873 - DNA, 318 bp, Triticum aestivum
  unsure (1)..(318): unsure at all n locations
  Clone ID: PAT_TA_79873
cacccgaatataaggatcggattgcatcatcggttctgagaccagcaacaaacactcatttaactaatgacgacgtgacacacattctgttctgcaaggggcaactaagatagatgtccatttaactaatngnnnngtggcactaagattnnnttttgccaggggtaactaagatagatgtcgcagaggtgatcgattaaaaccaccagaaactcaactgacagactcgtggtcaaagcctagctaaatttattgatttctgcctaaggcaaccggctgatgcgcaatgaatgggccnnnntgggggcgaagaagatc

SEQ ID NO: 79874 - DNA, 517 bp, Triticum aestivum
  Clone ID: PAT_TA_79874
tgagcaacttctatcctattataagataaacaaggattcaaaaatcataattaatccaagactcagaggtggctgtgctggtcacaactgggattatgtaatcagtgatctggatccataccagcgtgtgcctttgccaggggacctacttctcccggaacaggccatcatacagccacaaatggaagttaaatatctggcacgtctcctccaagttcgatgtaaaaaagtgctaatctacctgtgccggaagcactttagtggccattccttcggaggtaacttcagttcccagcaaattatgtttgacaccgatggaaatgtccgtatcgatgctgccccagaagaatatagtcggccttctgccttgttggactacaatgctgtttctgtaatctttgaccgggccttaggagacgcagctgacaaatatccaatggattttcatcatctgattgcgttcttgtcagctaaaggtccaaatgttgactgtcaaagtaaggcagtgattgctttt

SEQ ID NO: 79875 - DNA, 531 bp, Triticum aestivum
  unsure (1)..(531): unsure at all n locations
  Clone ID: PAT_TA_79875
gccctcctcgccgcggcccgccgggcctcctccctacccagcctccgtcgggcctccacgcttctccgccccacgtcctcgtcggcgatggcgagcaggtggagctcgtcctcctccctcgacgctgcagtctcctcctttgagtcctccggcgcctccctcatcgccgcactggactcttaccgtcagagcaccgtgaccgaggagtccgcccgtaccgtgttgggccccatccgtgccttcttaaccgagaccgaatccctgagcgccaccatgttcgaccttgagctcctcggcgccatcgactccgcgatcaagtcccgcaacaacgacggccaggcccccaccgagctccagtgtctcctcgctaagatagaggagactggggattactttccctttgaaatatctgaaaataagtgtcgttccagcattacacttacaagaactttaaagggcgagaagnngannnngtggcatcaaagccctgctngnacgacgacgacgacgagaacactcctcatgcacnnn

SEQ ID NO: 79876 - DNA, 527 bp, Triticum aestivum
  Clone ID: PAT_TA_79876
gcacgagggatgttaccgtgtcatgtgactgatcgatctgaaatagcaatgatctggtgcatgttttgtgaagcctctgttctgaactagttactcgtttgatgcatctcccaactatctgactgttctctgttatatgatggtagttgatgttatgtttttgttaccatatgattttgctttcggagacttggagaatcatatgccaatttggctgaagaaaccagtttggttccatttattggacattttttgagagccagctgcattgcagggatcaatcagcgatcagattttctgaaaaacatcaaccaatttgactgatcggtactctttgtgacataaagataccaaatctctaagaaaatactggtgttgcaggctatgtacacgggcaacgatggctaaacatctagtatagcttctgaaactgtctttcatcatcatgctctgcagacactgcagcaattcagagatagttgaactgcacgattgcctggtgagtgcttcatcttttccctttcaag

SEQ ID NO: 79877 - DNA, 530 bp, Triticum aestivum
  unsure (1)..(530): unsure at all n locations
  Clone ID: PAT_TA_79877
cctcgtgccgaattcggcacgagggtggcttcggtttgatcgatccccgaccatctaccatgggtggattcggcggcaactttggctggtgctgtggtgttctctgcggttccatgccacatttgtgtggtggtactggtggcttcgaattcgatcaatccccgacgtaccccatgggtggattcggcggcaactgcaggctgggggccatgctcttcttcttccgcccgaatcacgctcacggccctcaacaggatggtgcggccagcgccctacaggtactagatgacctacatgtacccgaactacatccctatccccgctcccaacaatgtctcctcccacaggtacgggctgttcctataccatgaagggtgaaagaagatcgactttgaggagcaaatcaggaagctaccatcatccgctgcaacttctcaacgagaggtgagtgatcagatctctcttcagcctttcccaattcatctaatctaacgttttgtcgggtttttattttgtcatattcagtcgcn

SEQ ID NO: 79878 - DNA, 520 bp, Triticum aestivum
  Clone ID: PAT_TA_79878
cttatttttggcatggcaacttttatactttattgccatggcattattacttatgcatgcatggcaatttttacttatcattcatgacaaatttttacttctcattctccatggcaaatataccttaattttttgccatggcaattttcagttagtggaaaagaatgcataatttttccatgttttttgtgcaccgaatatgcataaatttgccatctcctggaatacataaatttggccatgtgacaagtctgaaaatttcatagttttgccatgtggccaggcatggaacttgccatgctatgaacaaattccataaacttgcttttttgtgactagtactccaaaaaatacattctacattttccattattcatattgtagcatggcattttctagtttattggcacggcaatttttacttttcttttttgtcatgagaattattttttgccattgttttttgtttgaattttttgccatggcaactatcccatgcttttgttaggaatcaaatatg

SEQ ID NO: 79879 - DNA, 419 bp, Triticum aestivum
  unsure (1)..(419): unsure at all n locations
  Clone ID: PAT_TA_79879
ggaagatgtgatcctacctcgtgatttcggatcagtgaagcccttacagccaacagagtgtgatcgcttaaggccagtggagagcgatcacttatgaaacgaagaacactccaagattcagctgtggcggatatatttcaaggaagcaatcgactgattcgttgatggcatgcagaagttgcagaagttgatggcaagcagaagttgcagaagatcgtgtatgctcggggagagcactatgtccctagcgctcgttagctaatgtgtgcgataatttcgaagctactactactgatttagtagtcatgatattcggcagtgggaagtgccgaagtgcactctgcacttcattttaactatttgaacgctttttacatgtcagctggccctggtaaactactgcttcatttatggttcnn

SEQ ID NO: 79880 - DNA, 484 bp, Triticum aestivum
  unsure (1)..(484): unsure at all n locations
  Clone ID: PAT_TA_79880
gcacgagggaaactcgatcaaactcatccctactactccggccgcaccaccaaccgcgcaaggcagcgagcagagtcggagatggaccgagccatggcgcccagnnngagacaccgtggccaacgtccacagcggcaccgacagcaccaacaagacgctgctcaagagcgacgccctgtacacctacatcctcgacaccacggtgttcccccgcgagcacgagtgcatgcgcgacctgcgccttatcacagacaggcaccccaagggtttcatgcagtcgtcttccgatgaggcgcagctactagggatgctggtcaagatggcgggggccaagaagacgatcgaggtgggcgtgttcacggggtactctctgctggccacggcgctggcgctcccggaggacggcaaggtgttggccatcgacaccgaccgggactgctacganntgggacnnccttcatcgagnnnnngacgtggcgcacnn

SEQ ID NO: 79881 - DNA, 397 bp, Triticum aestivum
  unsure (1)..(397): unsure at all n locations
  Clone ID: PAT_TA_79881
nnnnngggagtgtatctctctcatatgtcggggaaagaagaaaagaaaaatgcgggcgtgccagtgtaccgtagtatatcaaaagaaattagtcagcggggtcatcctctcgtcgggtgcctgcttgccgtgggcgcgtgaagcgcgtccaacgttggatcattggcaacgtgctcccgctgccgtcgtccccgcggacgcgttcttcttcttctccgcagccacgacgcctgcggcacgacgccgctgcgaggggaagcgcacacgcagtgcgccgtcggcccgttaccgagctcgggacgtagccagcgcaacctccagcgtagcgcgtgcgtccgcccatccccataaaaatcaggggagaatggttattatgtttggaaggagtctgtaaann

SEQ ID NO: 79882 - DNA, 529 bp, Triticum aestivum
  unsure (1)..(529): unsure at all n locations
  Clone ID: PAT_TA_79882
gcacgaggcccatctgtattttgggatgaggaaattgacacatttgggtgtttgaataaggagtcgagcaagcgtggggaattctttctcttctacagctaccatactgtctctggcggcgcagtacttgttgcacttgtggcgggagaggctgctttggagtttgaaaagattgatcctgttgttacacttcatcgagtacttggtattcttcgaggtatctatggcccaaaaggcgttactgtgcctgaccccattcaatctgcttgtacaagatggggtagtgatcctctctgttgcggttcatactctcacatcagagttgggtcttctggaacggactatgacattcttgctgagagtgtcagtgaagaccggctcttctttgctggagaagcgacgaaccgtgcataccctgcaacgatgcatggtgccttattgagcggactaagagnncnnccagaattctccgggcttcacaaagcagagtggattccgatcataaaaagtatgctctgcagaaaagctt

SEQ ID NO: 79883 - DNA, 530 bp, Triticum aestivum
  unsure (1)..(530): unsure at all n locations
  Clone ID: PAT_TA_79883
gcacgaggtagcataaagattttgctctcaaatgttgttctttagttatactacttaataacacattttgtgccctgtggcgtgtttgtgagatactgagaagtcttgcttctttcattgcgtagctagccttttctcctaaaatttacatgtgggtgaacaaattgaccagaatactatgtgccataaattcaccttttttcctaacagacttatacttagcactgtgatctttgtagacaaaaccttgatgggtcgaaagctgtccagatgcatcgtgaatgatggttgagatgtggtgcaaaaaggaatggaaagaaacttgtgcttgcagggagcggaagcggatgtgattgggggtcaccatcaagagagtgcttccgtggctcgctacgaaaggaaatatatggaacaccccgggtagttagcgcatgttttgctcatgctcctggcaaatccttttgggtcagaannnnctgcgttctggtctgctcttgcacccacaagtttttagctgtgtgttttgcgaa

SEQ ID NO: 79884 - DNA, 517 bp, Triticum aestivum
  unsure (1)..(517): unsure at all n locations
  Clone ID: PAT_TA_79884
gggttttgggactttagcctcctgcgccgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcccgaacgctgcccgctggtacgacaccgtcgccgcggctgttgcttcaaggttccctggccagtcctctggggtgagtgcatcatcggctcctgctgcagctgctcctgccgcttccaaggatgaagatgacgatgatgacatggatctgtttggcgatgagaccgaggaggacaagaaagctgcagctgagcgtgaggctgccaagcctgcaaagaagaaagaaagtggcaaatcctccgtcctcatggacatcaagccatgggacgatgagactgacatgan

SEQ ID NO: 79885 - DNA, 511 bp, Triticum aestivum
  unsure (1)..(511): unsure at all n locations
  Clone ID: PAT_TA_79885
tttgagagcgcgtttgtactggaggaggtagtggttctgttggccgctgatccgacggatgagatgatacgcaaggtggtgtttctgaagtacatggaacgggccagtgaagcctccatactgtcggtcggccattctggtcctcaaggcttcgctcagagcgccagaagaggatctgatttctccctcggtgacccttttgccaactattgccgcagcgacttgtatcgtatgtcatcaccccaccccttgtacctgtgctagcctgattagcttcagcgtcgaagttggcagtatcattgttgcagccgttgttctactggttggcaattacggaccaccgcgtatgtgtttcatgcgatttcgttagctaggctgtgatcttgatgacagctgtgttgcattgcatggttttggctaaaaatatgtttattgagnttgtgacaatggtgttgcgttgcacggttttggctaaganngtttgttatgacattatctcaaaaaaaaaaaa

SEQ ID NO: 79886 - DNA, 532 bp, Triticum aestivum
  Clone ID: PAT_TA_79886
gtccggggaggcggtggctgcgctcaaggccgcggccgccgacgcgtgccgcgcgctcgtcgacaacttcggcgacatccgctctctcaagaccgtctacgacgtcgaggactaccacatcggcatgccattcggtgtgctcattgcatgcattggttgctatcaactgtggaagctagatccctcgacattcctagatgttgtactaggctacgcattctacaggctcagtgtcttgggttcacacatccggagacagggattctcgaatgacctgtttgggcgcctcaagtttgttattgtcataatcatggccgtgaaagattcaggaaaatctcgctcccattgattttatcaggacaccagtttatgccctctatttcatatccttccttcatgacataattggtctgaagaagtatggcaaatattatttcgctgtgaccatcgaactactaaaaactcaggagggcagatgcaagctagcgagttatttctaaacgtttattctgctagtggagtggccattttc

SEQ ID NO: 79887 - DNA, 482 bp, Triticum aestivum
  unsure (1)..(482): unsure at all n locations
  Clone ID: PAT_TA_79887
gcacgagggagcccagctaataaactcggtctcgctcgctgctcggtcggagaggaataaaccggccgctcccctgctcgcccggccgacctccgccgcgccggccgtacgtacccaatcgatggagatgaagaaggtgttcttcgccgctcttgttgtcgccgcctcggcgaccgcggtgctcgcctccgaggcgcccaccggtgcccccggcgcccccggcggcgcccctggccccgccgccagcggcgcctctgcctccaccgccgtgaccgccccagtcgcgctcgtcgtctccttcctcgcctactacctccaccactgattgacgcggcgtcgtctgtctctgttcgttcggtctaggttgctgctgctgtgatgatggnnnngagggggaggagggggcagcgnnncattggtggcacgnnngcgcttgcatgcatgcatgggcgtgaacgatgcggcgctgttttttttttnna

SEQ ID NO: 79888 - DNA, 532 bp, Triticum aestivum
  unsure (1)..(532): unsure at all n locations
  Clone ID: PAT_TA_79888
gaagaagaagaaaaagaggcacggacggccaccgcgcggccgccgtcgacacataaaacccacccgccggagccggaccgaccgcccgcggcgcacacaccaagacgacagtcggcagcggcgctcccccccttcaacaatctacttcctcgtttccgtccaggtcatacccgagttgctgctgctgaaatgggtagcacggaagccccaacgcccgtgcaggcacctgtgtgctccattgtgaacgaaggcccaccagctccagctgcttgctccattgtgaacgaagccccagctcctgccactgactccaagcccaagaagaagatatgctgcgcttgccccgacaccaagaggctgagagacgagtgcatcgtcgagtacggggagtctgcgtgcaccaagtggatcgaggctcacaagcaatgcctccgtgccgagggcttcaaagtctgattcttctcttgtaccctgatcatggatgttgcagaacatgctatttgagnnnccgtcagaggagttgtcttgttnn

SEQ ID NO: 79889 - DNA, 456 bp, Triticum aestivum
  Clone ID: PAT_TA_79889
gcacgagggacgactactgttgccacaaattccagcaacgccggtgacctcctctagcccaacgacctccacgtccccatcctccgtctcttgttccaagccccacggcggccgctcatccatcagcgcgaccatgcggcaaccagcgctcgtcgccatggccgaccgcagctggttgcgctcctgtccatggccgccgccgcaggatttgctacaagcatgctttgttttttcaggaaccagcccatgtatttgctatcacccacccatccaaaatctgctaccacgttagtttttgctggaaccggtgaaccattttgctacaaccgttttggtttttgttactaccggtgttttgtgcatttatgctacatccatctccatgatatcgctgtttttccagtcgttttttgctacaaccatgttatgattttgttggaaccgaaaaaaaaaaaa

SEQ ID NO: 79890 - DNA, 376 bp, Triticum aestivum
  unsure (1)..(376): unsure at all n locations
  Clone ID: PAT_TA_79890
cggaattttggaaaacaaataaacagcgaatccattgccctagcctacacggttacacgtacggtggatagcaagatcgaggaggcatgaaaagagtgggaaccaacaccgctgccgtgaaggcgaccgccggcgccggtgaccgaggagagcagcacaaggcgacgtccaagacacaggcgcagaaggtggcccggcagcaggctctgcttgcgttcctcaaggcggggttcgaggattacaagctgtacagggacagggaggacgaggaggaggtggaggagtaccgtcgcgcgggtaagctccacacgtacgacccggacaaggagcccaagaagcgctnnnnnagggtcgccaaactnnnnncgccgctcga

SEQ ID NO: 79891 - DNA, 283 bp, Triticum aestivum
  unsure (1)..(283): unsure at all n locations
  Clone ID: PAT_TA_79891
gccaggttgaagtnnntcaatatgcaatttgaagagcttcgtgcaaagcaatctctatggaccatacctgannnagaactgagagaaactctgannntttctatagctgaagtnctcttgccagcctatatgtccttcgttaaacgttttgggaatcttgttgaaaatgaaaagaagcctcgtaaatacttgaaataccagccagatgaattggaccagttgctgggtcagttctttgaaggacaacaatctgtnnnncagaagaagtaagcnnnnngagnnn

SEQ ID NO: 79892 - DNA, 205 bp, Triticum aestivum
  unsure (1)..(205): unsure at all n locations
  Clone ID: PAT_TA_79892
gcacgaggcccaagctagcacatcacgaggcggacgctgagnnngagaacaaccgcacaagataacccgggaccggagaaggggatcgctctggcgaatgnnncaatccgttcctcgtaacttcangagcatgattggcggttcgacgatggnntctttactgctgatggatttgaatcnnnaacctcaatgcagtnnnagcntc

SEQ ID NO: 79893 - DNA, 303 bp, Triticum aestivum
  unsure (1)..(303): unsure at all n locations
  Clone ID: PAT_TA_79893
cgcacatggacggcacaccggcgcgaacgcggcggcggcggcgacggcgacaaggtatctctcctagtgcaagactaatggaagacgactatgcagcaccacatcttcctatggacatcatgtacaagatcccgacacacatctctgatccagcctcccttgcccgcctcgcttcatccagcaagttctggcgcagtctcatcaaggacccgaccttccttgactnnnttaggaggaggcaccgcgaccacggtttcaccccttnnntccttcnnnnctnnnnnnnnnaggacaagtctccct

SEQ ID NO: 79894 - DNA, 322 bp, Triticum aestivum
  unsure (1)..(322): unsure at all n locations
  Clone ID: PAT_TA_79894
ggctgcttaagacgaggcagtattgtatccaggttgctgccttgtaacatgtggtattccatgagctgtcgatcagttgcagaaaattgtcttccatgttctgagaaaatgattatctctgtagatcctgccgagttagacatgctgcacacgttttaacgacatatcagatttccattcttgaagatcacaggtgcattgtgtcttatattttttnnaacaattaaaaatatgtagtagatgcaactgcagacctaggatttnnttcatgtcctttgtgggtacgcccnnnatangntggtactggtcaagatgnntgttg

SEQ ID NO: 79895 - DNA, 307 bp, Triticum aestivum
  unsure (1)..(307): unsure at all n locations
  Clone ID: PAT_TA_79895
gagagaactacgactgaaatgatgacaactgaaactgagacatactgatggatggccacagaggttatacatcactcttttctgcactagatactgatgatgtgatgttgcatacctaaaatatatcaaaatattttttgtgatttgaataatcaacattgaatcttgttgtacttcttttatgaggtctgatgnnaaactgcaatgggctacaacgcatataagtgaatgaaacaaataattnngaacatcaggtcgaagcggttgttgcccatagctncacacatgtgcatttgtttnncaaatn

SEQ ID NO: 79896 - DNA, 180 bp, Triticum aestivum
  unsure (1)..(180): unsure at all n locations
  Clone ID: PAT_TA_79896
cgaaagcgatcctctccaggggccaggggattccgatccgtgccttccgtctcctcgcgctagacccgccgcgcatcctcgtcgaccagtggattgtcaccgtcgccagcttgggcgtcgaggaganngacgtcacgctgcggtactcgcacatctaccgcagcaagctctgcccctncn

SEQ ID NO: 79897 - DNA, 384 bp, Triticum aestivum
  unsure (1)..(384): unsure at all n locations
  Clone ID: PAT_TA_79897
gaacactcagagataaggctaggtaattatacaagactgtcatagcagccatccgtagattagactgtaatctaaaggtggtccacaagaaggtgaagctgatcctcttgtgatggtatctcgtcagtctaacggatcattcatttaaaggtgttgatgcttttttggtggtatttcatcaaccaaacagatcattcattcagatatgcctccagcattcaatttttattttcactgaaaagttttgctggcatcaaaatatttcatttgtaatcattttcctaatgggaccaaattatctcttcattgcaacttcatgacatgnnnattnntcgtcttgaagtgtgacacttgaatttatctactcattttnnntcaatctnc

SEQ ID NO: 79898 - DNA, 177 bp, Triticum aestivum
  unsure (1)..(177): unsure at all n locations
  Clone ID: PAT_TA_79898
gcacgaggaatatgcgtgcttgaaccaatgattttctctattttaganncaagctatttcagttgatcatttctaacatgctactgtgtcatttgttcatcnncttcgtctcttccatttgnnnccttttcccccaaaattgtactacttnnngatacatctttgannntcctngnn

SEQ ID NO: 79899 - DNA, 294 bp, Triticum aestivum
  unsure (1)..(294): unsure at all n locations
  Clone ID: PAT_TA_79899
gcacgaggcctcgtgccgaattcggcacgaggagcagctgctgggtggtgctcggcctcgacggcctggcctccgccgttcttgccgtcggcctcgtcctcggtgccgattcttccccatccatggcgccaagccaagcgtgtgttcctgctcctctttattcctgtggcgtcgatttccgccagcgctttggtcaaagccgagacaaatgaagatggaggtgtnnnggaggtgctggtgctggccgcatggctcatactggccgttgggcgacgtnnngtggcgnggctggag

SEQ ID NO: 79900 - DNA, 215 bp, Triticum aestivum
  unsure (1)..(215): unsure at all n locations
  Clone ID: PAT_TA_79900
tgcatcagtttacagggcattttcccttctctctttcttcggtgcattatgccatagtttcctgttggtcttgcagaagcaattaaatttgaacagtatactcgctcggtctggaatnnnttgatgctcaaacgnntgcctctagctnnatacatgcgnnnnttgacagtatcatctgtttcngntatatatctgtgctgtgttannnccgtcnn

SEQ ID NO: 79901 - DNA, 249 bp, Triticum aestivum
  unsure (1)..(249): unsure at all n locations
  Clone ID: PAT_TA_79901
ttttttttaaacatcagaaggaagtaacagcagcagcagcaaagagagttctctacaactcggccaacagactaataacagcagtctccgcgaacaaacccgaccacccccgaccacaacacaaagtaagtagagcaccaattatccatgtctcctcccccctactaacccannacaaaaatngnnnnccctttnnnaccatctacagctcatcatnntcctcgtcgtcgacgccgnngtnnnnnccct

SEQ ID NO: 79902 - DNA, 219 bp, Triticum aestivum
  unsure (1)..(219): unsure at all n locations
  Clone ID: PAT_TA_79902
cacacaagctaatcaaggtctcagctccttccgagctccacgatttccagcaagcaagccgaagcactagatcctcgatggctcgcatggcactgctcgccgtgttcgccgtgctcgcggcactggctgtggcggagatggcgtctggggcggtgacctgcggcgacgtgacgtccgccatcgcgccgtgcatgtcctacgcgacggggannnnntngg

SEQ ID NO: 79903 - DNA, 269 bp, Triticum aestivum
  unsure (1)..(269): unsure at all n locations
  Clone ID: PAT_TA_79903
gcacgaggcggcccctcctccgcggccggtgctctcctagtccgtggtcgacacccatcctcctccgcggccagcgccctcgctccccgcggccggcgcgctccttccccatggccgatgggcctccagctccatggccggcgcggtccctccttgctgcagcttgcccctcctccatggatggcctgcaccggctgccggaactcgttgaggtggtacccttcatcctcgacctnnnntnnnaggttaccaacgacgctacaaagaga

SEQ ID NO: 79904 - DNA, 185 bp, Triticum aestivum
  unsure (1)..(185): unsure at all n locations
  Clone ID: PAT_TA_79904
gatggaactaactgcaaacatttcngccagtgctcctgccactgtcaacatctcttacactgactgcaaaagaggcagtgttctcttctctgctcgtacaacaatttttcngaacaagctgaactaataagctacaaaccgaccacgacatcatnnntacnacaaannnnnccaacatacaatgn

SEQ ID NO: 79905 - DNA, 307 bp, Triticum aestivum
  unsure (1)..(307): unsure at all n locations
  Clone ID: PAT_TA_79905
gcacgaggctcaattgaagttttgtttatctaatcataatttttgtactaagacacaatttatatttgcaaggctgttcacgtcaacctggttcttgtttggccaaattaatttcattcattggtccagtgctctgtaaatttatttttggaagtgactgatatgttttcaacatgtcacttctacatttnnntgtgaatagtaaatatggtgccgattttattcacaatatgcaatatatgttgttagntcacttnnttgtcgacaccgagtnctccatgccgaatatnntatnnctgatgcaaac

SEQ ID NO: 79906 - DNA, 223 bp, Triticum aestivum
  unsure (1)..(223): unsure at all n locations
  Clone ID: PAT_TA_79906
gcacgaggcccatcatcgccaagatgtaccagggcgttggcgccgacatgggaggcatgggtggcgaggatgcgccggccggtggaagcggtgctgggcccaagatcgaggaggtcgattaagctgggagaggtggtgattctggcagcgggagtctgaggtctctgaactctgaagtgtgatggattgtagtgtttggctgttcccanngcnnntttttnnn

SEQ ID NO: 79907 - DNA, 383 bp, Triticum aestivum
  unsure (1)..(383): unsure at all n locations
  Clone ID: PAT_TA_79907
gcacgaggatttgatttatgcaaatttctgcttactactttgtaaatgtcctttagtttatatataacttctctacaagaaaaataagatcgctattttttcaagccggagataattaaataagaatctcacaacaagtttattaagtacaggacggcaaggctggattaaaactgcaacaagggtattccaagcccttaggattgcagttaatgatgagctccaaactttagaagacgcacttcattcgtgttttgactgcctagcaccagatgnncgtcttgctgtaatctcattccacagcttagaggacagaattgtgaagcagacattcctggagctnattcgtggggatgaagcagacgatgacnnnnaagacnnnn

SEQ ID NO: 79908 - DNA, 379 bp, Triticum aestivum
  unsure (1)..(379): unsure at all n locations
  Clone ID: PAT_TA_79908
gcacgaggcctcgtgccgaattcggcacgaggctccctacccccagttcctccaccattccattccccaaaccgtggccaggatcgtcgtcgtccttctcctcctcgccaagatgacggaaccaccatttttgccacgtgagaggctttttaagcagcagcagtatttccagagcttgagcaagcacactcacctgaaagggcgttacgatgcgatcacctccgtcggcatcccccttgcgcttgctgcatcgagcctattcatgattggccgtggtgtctacaacatgtctcacggaattgggaaaaaggagtgaccgtctgtggcnnngctgctgggtcagtactnngacatgggagcnnntcttaatttgnnnnnn

SEQ ID NO: 79909 - DNA, 215 bp, Triticum aestivum
  unsure (1)..(215): unsure at all n locations
  Clone ID: PAT_TA_79909
gtcgcgctgcgcagaggtgaccaaggcgctgcgggcgaggaaggacgacaagatgcggcggtgcgaggccatcaagcagcagcacgaccagctccggcgcggcgacggggcggagnnnngcgcctcggacaaggacgcgaacgcgaacgcgaagcagcgggtggagaaggaccggcaccggggctccggcggcgcgcagccggnnnnnnnnnnnn

SEQ ID NO: 79910 - DNA, 189 bp, Triticum aestivum
  unsure (1)..(189): unsure at all n locations
  Clone ID: PAT_TA_79910
tggcacgaggcctctctagtagaggatgtgctcgggatgctaggtttcagtttctagattgattaggaacatatacgtacaatgcattgagcttttgatcttccattcattcatgtttttgtcttcgatggtttctgactcctccggcccggcgatgcgtgggaggtnnncgacgagannatccgcctc

SEQ ID NO: 79911 - DNA, 308 bp, Triticum aestivum
  unsure (1)..(308): unsure at all n locations
  Clone ID: PAT_TA_79911
gcacgaggcacagccccactcctagagagcacgcacatcggacacgcacgaagtctcctcgaccagcgagcaatggcgaccaccgcgatgnngctctccccctcctccttcgccgggaaggcggtgaaggacctgccgtcgtcggcgctcttcggggaggcgcgcgtcaccatgcgcaagaccgcgnnnaagnnnaagccggtgtcgtcgggcagcccgtgntacnnntccgaccgcgtgctctacntcnnnncgctatccggcgaccccccgagctacctcacngnnnngnnncccnnnnactacgn

SEQ ID NO: 79912 - DNA, 266 bp, Triticum aestivum
  unsure (1)..(266): unsure at all n locations
  Clone ID: PAT_TA_79912
gacgtggttgacatggggtctgtatcaagagacaacctcgtaagctttctctgattgtgcctgatgccatcttcggtgtttatggttcctacataaaacgaatggcgctcacgaccttatgaaggtcctcggccaactggccagttcccaaagctctcttatttccagcttgagcttgtactcaagctcttcgtgacatgcttgaaccgtcgcatttgctgtctcaaacattccgtttcaattgatcaatgcatgttctctannnn

SEQ ID NO: 79913 - DNA, 316 bp, Triticum aestivum
  unsure (1)..(316): unsure at all n locations
  Clone ID: PAT_TA_79913
gcacgaggcaaacactctgagcagtacgttaatttacatatccatgctggcatacaaatgacctgacaaaatgcgtcgggatggtcgagttgaacacaaaagcgagcagtnnnaactagaccggaggcacatagtggaataatcaaactaaaaaacagtggacttaagacttaactagacgactcctccatactacatggannattgaccactaaactagctgctncagcatggcgacgacgaggatgaagttggttcngnccaggagcagcgccgtacgctggctgtcagtganncnncattgngncgccgcgcg

SEQ ID NO: 79914 - DNA, 340 bp, Triticum aestivum
  unsure (1)..(340): unsure at all n locations
  Clone ID: PAT_TA_79914
gcacgaggacgctgcggtaaaccatggccgccgcttcgcctgccacgctcgtcttcctcctctccctcatctgcgccccctcccggttcctcaccggcgccctgccacctccaccgctggcgccgcccaagcctgtgatgccagccccaacgacaccgcccaagcccgtgatgccagcccccacgacgccgcccaagcctgtgatgccagcccccacgacgccgcccaagcccgtgactccacctccggtgaaggcgcccaagcccgtgactccacctccggcgacgccgccgaagcccctgccgccacctnnggcgacgccgaccaagnnngtgcnnnn

SEQ ID NO: 79915 - DNA, 261 bp, Triticum aestivum
  unsure (1)..(261): unsure at all n locations
  Clone ID: PAT_TA_79915
cggacatgggcagcctcgagaggatgggacgggagctcaagtgccccatctgcctgagcctgctcagatcgnnggtgtccgtcacctgcaacnacatcttctgcaaccattgcctcacggagtcgatgaaatcctcctccacctgccccgtgtgcaaggtgccgttccgccgaagagaaatacnnnnagcaccacacatgnacaatttgntcggcattttgaaaagcatnnnnnnngcatcnnnnngnnntgttgtctcaa

SEQ ID NO: 79916 - DNA, 274 bp, Triticum aestivum
  unsure (1)..(274): unsure at all n locations
  Clone ID: PAT_TA_79916
gcacgaggccaccagttcatctcactgagctcgcaggcagccccagccaccagcgaaatggccgcgtcggcgctgcaccagacgaccagcttcctcggcaccgccccgcggcgtgatgacctcgtccgcagcgtcggcgacttcggcgnnngcatcaccatgcgccggaccgtcaagagcgcgccccagagcatctggtacgnnnctgaccgtcccaagtacctnnnnncgttctccgagcagaccccgtcgtacctgaccgnnnagtnnnnnn

SEQ ID NO: 79917 - DNA, 340 bp, Triticum aestivum
  unsure (1)..(340): unsure at all n locations
  Clone ID: PAT_TA_79917
cttgttcgtaacccctctctgccaatttgagagactgttctgtacttccagagaaatacaacttatttattaggtttctcagtttctcgaatatgcagtatagctgctaatgcttcttcgttttgttgtatcatttctgcatatgtaattttaattgacagagagggtggagaggagaaacggctgcgccggacggtgctcgtcatgatgttcctgtgagtaccctccccccaccttagttgttgttctccttgtttaccccataacgnnnnntncgcgcggatctgcgcctccatccatcgcagggagaggagggctanngcagtcaccgtnnngnnag

SEQ ID NO: 79918 - DNA, 202 bp, Triticum aestivum
  unsure (1)..(202): unsure at all n locations
  Clone ID: PAT_TA_79918
ggaataaaatcattgctgatgttgaaacttagagcaagagataagtaaacattgcattatattatccgactagaaaacaaactctaaaccagggtaaacatcttgtagagcatgttctttcttcttccgaacacacgtcgcattcaagnntctgataattttttgggtgaagnntacaacactgagcagnntccttaaatac

SEQ ID NO: 79919 - DNA, 352 bp, Triticum aestivum
  unsure (1)..(352): unsure at all n locations
  Clone ID: PAT_TA_79919
cccccacccacactccaccgcaccaacctccctcccttcctccaccaccacaccacctccctcccttccccaccaccaaccggcgccgatctcctccggccctgccccacccgtgacctttcttccctcgccgatgagccccctcccccagccacctcctagcacgagccggcactggatctaggccgcggtgaccccctgatcaccttctcgcccggcttcccatggccccgccccgtgacgtcgccaactccggcnatggccgcggccccctgccccgtgaaggccggcctcggcggccccagccccgccccnnnncaccgccccaccccggccgcgactannncnntgc

SEQ ID NO: 79920 - DNA, 199 bp, Triticum aestivum
  unsure (1)..(199): unsure at all n locations
  Clone ID: PAT_TA_79920
cttgcttggcatctgaaccacctcacccttcttcctggcctgtatttttttgctgctgggtagtggtgtgttctcttctcatctttcttctttgtggaggggcggattgagtgcagctccatttcgcctcggagtcaaagatgggggacgtgnnnaaggacctggccgccggcacggtgggcggcgcggcgnnnntggt

SEQ ID NO: 79921 - DNA, 206 bp, Triticum aestivum
  unsure (1)..(206): unsure at all n locations
  Clone ID: PAT_TA_79921
gcacgaggatcgcaaactcccccccggtccggctccagctagggttccgcgganncaagcctagctagctagggtttgctgccgccggcccgcgccatggccgccgcggcggcggaggaggcggcgccggggggcgccgacgccatcagggacggnttcgcggagctggagcggcagcnnnagctgctgnnnnnctgcacgcgcct

SEQ ID NO: 79922 - DNA, 374 bp, Triticum aestivum
  unsure (1)..(374): unsure at all n locations
  Clone ID: PAT_TA_79922
cgctccgcaacctggaccccgacgacaaccccatcgtccagttcaactacttcgcccacccggacgacctccggcgctgcgtcgccggcatcgaggccatcgagcgggtcatccgctccaggtccttctcgcggttcgcgtaccccaacttcgcgttcccggcgatgctcaacgtcacggcggagttcccggcgaacctgatgcgcgtgcgcggcggtagcgaccccgcggcgctcgagcggttctgcagggacaccgtcatgaccatctggcatnancacnncgggtgccaggtnngcagggtcgtcgaccgcgactaccgggtcntnnncattgatgcgctgcgcgtcatcgacnnnnncacgttnnnngcc

SEQ ID NO: 79923 - DNA, 402 bp, Triticum aestivum
  unsure (1)..(402): unsure at all n locations
  Clone ID: PAT_TA_79923
gcacgaggaacgtactggagtaggtcttcgggagtctcagatgtgatcgtcgcctgtgctcgcgtgaggccttgacgagccgaaaccgccgcgccgccgcctgcggctctacgctgcacatacacctcgcctctagcgatcagcctcggcctgccatccccaaggaagaagccgtaccaatcaattattcaatcaagcttgaaggctagaaaatcagggacgtaccaacaaaaaggaacggcacattcaagctattctgccttaactggtaatgcagagctcagttattcaaaaacgagtggttccacgatacaatggccaagacaacgaaaaataaaatggtacnacacacatgacaatgtnnntgacaaggaaaaagacatcacaagacagnannnnnnn

SEQ ID NO: 79924 - DNA, 155 bp, Triticum aestivum
  unsure (1)..(155): unsure at all n locations
  Clone ID: PAT_TA_79924
gcacgagggccagctagtgagtgtgtgcggtgcgccactgctttgcggcgctgcggctctcgcgcggttccatggcgatctcccggctctccgtgctcgtcgccgccctggcctgctgctgcctcgtgcggctcgcccaatgcgnnngcgnnngg

SEQ ID NO: 79925 - DNA, 211 bp, Triticum aestivum
  unsure (1)..(211): unsure at all n locations
  Clone ID: PAT_TA_79925
cgctcctgccattacaaaccacccaccattttcgtacaccacgcgggatcagggcacccagtccagccttccgcggctccacggaaccaagnnncccgagagcagccatggccggcgcgtccgccaccagcacccgcaagggcggcatcnnnncctactggaagcaccgcgggtacgnncgcctggaccnnnnngncgcgcnnnnnctccc

SEQ ID NO: 79926 - DNA, 344 bp, Triticum aestivum
  unsure (1)..(344): unsure at all n locations
  Clone ID: PAT_TA_79926
gcacgaggcctcccaatccctaatcacggctcaatccctccatggcggcacatacatcggacccatgaatccttggacggcagcagcgcatgcccacctctgcgtttgtccgcctcaaacggctccatggcctggtgatcccaacaatgatggccacccttggcctgcctccacgtttgttcgcctcaaattgctgaacgccctcggtgatccgttcggcggccgtggcgggatccaccacgtttggcgtaccaccgcgctcgtccaccttcttgccggtccgccgccggccgcaacctgcacgccatctaccgcactgcacctgcatccagnnngttgctgct

SEQ ID NO: 79927 - DNA, 160 bp, Triticum aestivum
  unsure (1)..(160): unsure at all n locations
  Clone ID: PAT_TA_79927
gcagtcacaacaaaagcatgnnnggaatgataattaacatcgattcgtccacggcagtttgcccatgatttataaaactaagttgttaagcactgnnntgggatcctaacaatgggcatacaaatgattaactttgnnaaaagctaagcctngcnncnat

SEQ ID NO: 79928 - DNA, 226 bp, Triticum aestivum
  unsure (1)..(226): unsure at all n locations
  Clone ID: PAT_TA_79928
gcacgaggatcgtcgtcgtagtcacactgcacagaccggacgtacgtacacacaaaccctcacacgagaagaccgannnatggggccatccccgnnngccgccgtgaatacgacgagagcgacgtgcgtgctgttgatcctcctcctgttggccgacgggcggtcgacgcctgtgnctgggcaggcgctacctgcgcctgaggaggccgccacnatcgnnnnggat

SEQ ID NO: 79929 - DNA, 221 bp, Triticum aestivum
  unsure (1)..(221): unsure at all n locations
  Clone ID: PAT_TA_79929
gcacgaggttgtaaactattcacatggggagatggcaataaaggtcagcttgnacatgctgacagggaaaccagactcaccccagcctgtgtgnnatcacttcgtaagcttagtttttgccaagtagcttgtggctatgactttacgnncgccttgtcaacttctgggcaagtgtacacaatgggcagtnntgcttttgnacaactnnnnaatcnnnnnan

SEQ ID NO: 79930 - DNA, 261 bp, Triticum aestivum
  unsure (1)..(261): unsure at all n locations
  Clone ID: PAT_TA_79930
cggaaaccatatatgccagccggtttgggcaactgggccgattccatccaagaagaattaaaggagtaactcgctgcgttataagaccgccgggcgcatcgatcgctagctagctgttcgcacgcagagcaccagtccagcgtnnnngatgnnncgggtaggcggcggcgatgtcgagatcggggggcttccggcgccgnngggcgaccctcgnnnganggtcgtcgccgccgacgactccctcgacgacgacnnnnagcc

SEQ ID NO: 79931 - DNA, 308 bp, Triticum aestivum
  unsure (1)..(308): unsure at all n locations
  Clone ID: PAT_TA_79931
gcacgagggcgcagtagtcgacgcagctgagccaatggcccgccgcacggccctcatcctcgccgcgctcctcctcgtcgccctggccgtcgcgccgttggccaatgccaagaaggccgccaaggaggagaaggcctccgacgccccctcggccgacgcgccggccgccgactcacccgcggaggggccctccgatggaccggcggctgcccccgggcctgagggcatcgccggnntctcgcccgacaacgacgacaacgacgacnngtnnncccgagtgcatgccctttnnnnnnnnnngnnnnntg

SEQ ID NO: 79932 - DNA, 250 bp, Triticum aestivum
  unsure (1)..(250): unsure at all n locations
  Clone ID: PAT_TA_79932
cggatcttttcctctcgacaggcggtggggtccgtcccgcccgctgcgcgcggcggcagcatctcgccacccaatccgcacccaaatctcgcgtcgnnntccctcgaaaaagcagccgccgcacgccacttcccgtctcgnnnaaccgccggcgcgggagagcaagggtaagggcggctctcagctcagctcgcggccttcgcccgaacccccttccccnnngctccccctnnnatgcgcgnctncgacc

SEQ ID NO: 79933 - DNA, 209 bp, Triticum aestivum
  unsure (1)..(209): unsure at all n locations
  Clone ID: PAT_TA_79933
gcacgaggacccaccccagcgaggacactcttgcttacctagtacgctcttggcctcttgccggccatggagcgcgtgggggaggcgccgcacttcctcgtggtcacgtacccggcgcagggccacatcaacccggcgcgccacctcgcgctgcgcctgctccgcgccacgccgggcgcccgcgtcaccgtctccnnngccgtctccgc

SEQ ID NO: 79934 - DNA, 225 bp, Triticum aestivum
  unsure (1)..(225): unsure at all n locations
  Clone ID: PAT_TA_79934
gcgagcgagatcccgcccttcccccttctccacccacccgccctgccggaaccgatcccgatctgatctcgccgccgccgccgcgcgccggacaagatgnnncccgtgtcggctctgnnnaagtacaagctggtcttcctcggcgannnntccgtcggcaagaccagcatcatcacccgcttcatgtacgacaagtttgacaacacctacnnnnctacgatngnn

SEQ ID NO: 79935 - DNA, 239 bp, Triticum aestivum
  unsure (1)..(239): unsure at all n locations
  Clone ID: PAT_TA_79935
gcacgagggggcaacggcggcggcgccaacgtggtggcgcccggctacaccaagggctccggcctcggcgccgagancatcggcaccttcgtcctcgtctacaccgtcttctccgccaccgacgccaagaggaacgccagggactcccacgttcccatcctcgccccgctgcccatcgggttcgccgtgttcctggtgcacctggccaccatccccatcaccggcaccgnnntcaaccc

SEQ ID NO: 79936 - DNA, 517 bp, Triticum aestivum
  Clone ID: PAT_TA_79936
ctcgttgcacaagaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgct

SEQ ID NO: 79937 - DNA, 528 bp, Triticum aestivum
  Clone ID: PAT_TA_79937
cttccagtttgaatgggctccccgcggctggcgaccggttcggctgcaccgccgccgctccctctggccggcgaagccacccccttcccttcccgaatcatatccacccattctagccgccacagcctgatctaccctttcccccggtccggttcgtccgcgcggctctcttggagctcggatgaagaggaggacgaggcggtgctggggaccccgccgtctctccacatccgggggcctgccgccccgattcgcgttcaagacctggaccggcgtgcccaggacggtcgtattgatgccgccatcatctcccagcgctgcgcgctgcctctgggatgctgacggcgcaaccccagatctccatcagcagctcgcggccgctccggggatcctcctccaccttgatacggtggaggatctgcgtggcctcggcgacggggctggggagggcaggcgtgagggcgagctgtggaccaccaccgtcgattggttccggatggcactcccgctgattcctctctgccagat

SEQ ID NO: 79938 - DNA, 521 bp, Triticum aestivum
  unsure (1)..(521): unsure at all n locations
  Clone ID: PAT_TA_79938
ctcatctgtcagccatcgcagatcgccgcatcttgctgatcgatctccttaaccagcccacgcccttcgctgcttcgcagtacatcagtacgcagtcggcagcatcacggcgcatctgccagtagcatacaagtggcaacagcgacatgagcatgttcagtcaattttgagcatggtctgcattggctcgctataaaacttctgaagaagtgcaaggaaaccaagctaggtagccaagaaggagttcgaaagaagctacccggaaagatgaaggtcaaaacgaagatcagcaaagctgccgagttcttgaggaaggcggtgcgggcgctgaggggcagggctggcgtcctcagggcgcggctcctcttcctcgcctcgttccgccacaggacggcgatggtcggcaccgtgtcgcgccacctccgcgccctcctgccgggccgccagagannncggtgcacgaccaccgcaaggtccacgcctcgtcgacgatggcggcggaggaggacgggcaggccgcc

SEQ ID NO: 79939 - DNA, 519 bp, Triticum aestivum
  unsure (1)..(519): unsure at all n locations
  Clone ID: PAT_TA_79939
cgctgttccgtcccgcttcgtggtgtttgcgccccnnnagcaattccttaggcgagttcgcgcaggtggccatcttctcatcggagactaggcgctggacttcggtggagagtgagtggccttacaaaaccgttcttcttggtggtacagcttgtgcctacctgaatggcactatgcatctgactacccatcatggtacaatagtcactgtcgacgcggaggggaagacttggagggaaattgaggatgtcatggaggacaaccgtgaggttgtttccattgggcattcccagggcagcttgcatgcttggctgatagataatgataaggatcccgaactctgtgtttgggttcttgaggattatgctagtggaaagtggaccctgaagcacactgttgagatatcggaacttttcgggaggcagccggacaaagatgaagcgtgctatagcatgcttgcgatccatccagattataatttggtttacctcaccgacaacaagaagatgacagtgtcgn

SEQ ID NO: 79940 - DNA, 518 bp, Triticum aestivum
  Clone ID: PAT_TA_79940
gcacgaggctggtctccaccacctcgatcccgacgctccgcatcgtctcgccggtgccgtcttcccgctggtgccgccgtgccgggccgttggcctccgctgggctggggggagccgcgcgcagagaccggcgccggagccggagtaggcggggacggagggtcctgaggatctgtgcctacacggcggaagctgaacacgggaggtgggaggaggatgtggccgacgatttctactctgttcttggcgtcatgccagatgcaacctccgaggaaatcaagaaggcgtactacagctgcatgaaaacgtgccacccagacctcagtggaggtgaccctgatgtgaccaacttctccatgttcatcaacgaggtttacacggtgctgagcgacccggtgcagcgtgcggtgtatgatgagatccatgggtacacggcaacggcgacaaaccctttcgttgatgacagtgcagtcaagaaccatgtgttcgtcgatgagtttacctgcataggatgcaga

SEQ ID NO: 79941 - DNA, 427 bp, Triticum aestivum
  unsure (1)..(427): unsure at all n locations
  Clone ID: PAT_TA_79941
gggttaaaaaaaaaacaaaataacttcgaggggacgccaaattttacaaacccacccggtaaaaaaagaaaaaaaaatttttaggaggggagggattcgggagggccaattggaattgcttggctgggaacccggggaattggaatgggaattggaattcaacaaaaggagggcaaagctcttgggggggcccccttcaaacccaaagggcaaaaagaaatttgggtcttcaaaccccaagggggtaaagtggggccgcaaacccggcggaaacntatgtacccaccaattnanaccggtcagcgtaatttgtgggtnnnccaaaccgcaaagtcaaactttngntagttctccttcaagtcaaaatttcaggggaaaaaaaaannncaaagtgggggggactttcaaaaaacttgtttgggtccnn

SEQ ID NO: 79942 - DNA, 505 bp, Triticum aestivum
  unsure (1)..(505): unsure at all n locations
  Clone ID: PAT_TA_79942
gcacgaggcagcaatcttcgacgggccccgtgctccaattcccaaaacctcccgtagccgcacgccatgcaaaacctgcttctccccaatgccgccgccgccgcgccctggtgcgcgcagccgcggcggcggccgtcccgcctctccgtgcgcgcctcggcgtcgtcaccgtcggcgcctcggcgggagaccgacccggggaagcgggtggtgatcacggggatgggcctggtgtcggtgttcgggaacgacgtggacgcgtactactcccggctcttcgccggggagagcggcgtcggcgccatcgaccgcttcgacgcctccgggttccccacccgcttcgccgcccagatccgcggcttctcctccgagggctacgtcgacggcaagctcgaccgccgcctcgacgactgccaccgctacgccctcgtcgcctccaagaaggccctcgagtccgcctgcctcgtcgccgggtccagcgccatggagaaggtcgacaaagaan

SEQ ID NO: 79943 - DNA, 531 bp, Triticum aestivum
  Clone ID: PAT_TA_79943
gcacgagggagaatcatgccgatggcagttcagggagtggggctctgccgtctgttgtccagaacagtcaatcgcatctgcaaaaccaggatccatcgcctgttgtccacaacagtccattgcatttggtaatccagaatccatcgcctgttgtccagaacagtccatcatactcgcaaactcggaatcctcagtatattgctcagagcagtccatcctactcgcaaactcggaattctcagtatatggttcagagcagtccatcctattcgccaactcagaatcctcggtatatggctcagagcagtccatcctattcgcggaaccagagtcaatcgtccaatatccagagcactccattctatttccatgaccagaatcaatcgtccaatgtccacagcaatccatcccatttccattatcagaatcaatcttccactgtccacaacagtccatcctattctcataatcagaacccatcgcccaatgtccagaacggtccatcgtactcgcaaaaccataacccttctc

SEQ ID NO: 79944 - DNA, 513 bp, Triticum aestivum
  unsure (1)..(513): unsure at all n locations
  Clone ID: PAT_TA_79944
gggaatcgctgatgcgcgcatgcgcatcccaattcccggcatatctgcggcaaagaaaccttcccggaatcaattcgcgcttatttctacgccgaccaagctgttgatgatcggacagcgacagcgatatgacagccggatcatatcgatcgcgctggccgattaaaatccggctgccggccggcgagtgatttgttccctgcgacgtacggccgggccgggccatatggtgaatttgcgtggatcgacggcggtccgggccggcaggtacctcctgccgctggccttcccggcgtgctgcgccctgtggatgctactcgtcttcccttctccgccggtggaggtcgccgtcttccggcagagtttccagccgagcattgcgctgacggggctgcgggtcgttgacacgacgccgccgtcgccatcggagcgtcgagagannnttgacacgtcctcgccgccgccgccgccgcagccgacggagcgccatgtcatcattaacgcgcagcctcc

SEQ ID NO: 79945 - DNA, 205 bp, Triticum aestivum
  Clone ID: PAT_TA_79945
cgagatggggctcaagaagttcgtccggtggtacctctcctactacgggtacaaccggggcacgcaggcattcaacaacttgtgatgactcatggtacattagcgtcggtgtatgtatatgtagtgcatatgtatgtatgtatgtatgtatgtatgtatgtatgtatgttttttttttgtttgtttcttctttaaaaaaaaaaaa

SEQ ID NO: 79946 - DNA, 457 bp, Triticum aestivum
  unsure (1)..(457): unsure at all n locations
  Clone ID: PAT_TA_79946
ctccccttccccgtcgccctcaccgtcgcggcttcgatcatgagcgtcgccgccgagtccccgtcgccgtccctatcttccctgagcgaagacgaagatttcgctgacatcctggacgcggagctcgagctcgcctctgccgctgactccgcctcccctggcgagccccccgggtcacccagcgacgaggaggaggaggaggaggaggacttggtggtcgaacnnnncgccgtnnnncagggaagtaacaaaaggcgtagactggaggaacatcaccaagatcaaggaacagcaacaaggcctgaagaagatgccattggctcagttaaagatgctcaaatcaagatatgtcctccacatcctggattttttggtggactatgctttagatgcgggaaanncaagacgaagaagatgnnnaggaatcgcttttggttacatccacnnnnnnttgagn

SEQ ID NO: 79947 - DNA, 527 bp, Triticum aestivum
  unsure (1)..(527): unsure at all n locations
  Clone ID: PAT_TA_79947
gcacgaggccttgtccaaacggcggcctcggccgcctcccggccatccgccgtcgtcgctggacagagggtcccggcgcgccgtacttctcctctgaagaagaatttatctcgctgccgcgcaaggaaactgcctgacgcttgcctcgacgatcagcggcacgccgacgccgtgcgccgtcgcgccgttcgactgctgctaccgaagctgcgcgcccgcgcaggaatgcctcactgggccccgacggttgtgccgagggccgcaacgcgggctgggcgccgcctacgcgcgctatgcacgcggtgccgccacggtcgcttatgcggggctgcatgatcttctttggcatggagatggaggggctggtgcgtcgccgccctttgtgtagagagcgccgacaagaggcatctcctcccctctataatcttgggcgtggactcangaccgctgctgatgccgannnnaccatcggccatgttcatgtcgtggatggccgttgtcgacgctgnnnnnnncatacgctttct

SEQ ID NO: 79948 - DNA, 436 bp, Triticum aestivum
  unsure (1)..(436): unsure at all n locations
  Clone ID: PAT_TA_79948
gcacgagggtctcgttcgcggtgttcctctgcggtggcggcggaggaggaggaggtggtggtggcggtggctgcggcggcggcggcggcggaggctgctaagttggcgggttgattcattcggtcttgtgttggcatgcatgcacggcgtattaatggctgcatgcatgcgtggtcatcttcgttaagtcagtctagtgatgttaatttcaagattatgtgtgttacgaccatggtgttctttttggcgatacaaccatcgtgttggttagctgcggattagtgtttctattnntacgtcttcctagattatctccatcggagagttatttgttcctgattttcttatttcagtgcctcgaatgttgacgacgaaatgtaattcaacaaatgtgtttgttgttatgaatgttttttgttgcgtgaaaaaaaaaaaa

SEQ ID NO: 79949 - DNA, 475 bp, Triticum aestivum
  unsure (1)..(475): unsure at all n locations
  Clone ID: PAT_TA_79949
gcacgaggccacatccagtcgacgacaccatgacccgccgccgccgccgccgccgtgcacgccccgcctcgccaccggcggcgctggaagacgacgacctcctacggaagattttcctcctcctcccacctcagccgtccacccttccccgcctctccgtcgtctgcaagcagtggcgcgacgtcgtcaccgacccccagttcctccgcggcttccgcgaccaacacaggaaacctcccctcctcggcctcgtcatgggccacaccgggtccccctacttcaggtccgatctcgaccctccagaccacatcccgcacgagcgcttcttccctcgagacatccgcagcatgaacatggacatattcgactgccgccatgggcgcgtcgtcttcttcgcccaacggctgggcgaggtcgtgctgtttgacccgccacgggaggccgccgttgtgtggtcgttccaccagtgtttcan

SEQ ID NO: 79950 - DNA, 543 bp, Triticum aestivum
  unsure (1)..(543): unsure at all n locations
  Clone ID: PAT_TA_79950
catcatcacatagagtaactaaaaagagcattgacaaactccaaccgcagatcaacggtagaagaagctaccaggcaactgtccatccatggcggccttgcttcggtttgcagcgaggaaggtctgcagccgcgccagccttgagcgactaccgcaggtcagcttcactgcgaccacgtcgcttgccgtcgtaaaggagctggaacagcagcggacgctgccctggacgattcttttccatggccgggtgagctcgcttcgctggttcagcagctcctccgaatcaccagacaagatccttgcggcacaagtggaggacaagaaacaagagttgcgccgtctgcttcgtcggctggatgagctccgcaccgagaaatgcgccatcgccgccagggagaaggagaaaaaatttccgagaaaaagaaacacaaggaaaataagaactcctccacctgctttcattgggcgacccactgtatcagctgtctcgtcagnttccaatcgtgggtaccctgcttatcatgagcttggtaatccttgtca

SEQ ID NO: 79951 - DNA, 531 bp, Triticum aestivum
  Clone ID: PAT_TA_79951
gcacgagggctcagcaacggcgtctcgcttcccgagacgggctccaggcaccaccacggcgacgctgacggctcagccgctacattcagtccgtcggccaccggcgccgcgcggctcgccattagctacatcgtggcgcagttctcgacggggtcgacggaggagcgtaggaaggcgacgtccgaggcccgcaagctctccaagcacagcgtgttctaccgggcgctcttcgtggaggccaatgccgtaccgtggttgctgtgcctcctgtcctgcatggacgcgtccgtgcaggacaatgccgtggcgtccctactcaacctctccaagcaccccggtggccggacggcgctcgtcgaggcaggaggcatcggcctcgtggtcgacatcgtcaacgtcggctccaaggccgagacgcagcagaacgccgtggccattctcttctacctctcgtcgaacgccgagtacgccgaggagattggccacgacatcgtcaacgtcggctccaaggccgagacgcagcagaacgcc

SEQ ID NO: 79952 - DNA, 624 bp, Triticum aestivum
  unsure (1)..(624): unsure at all n locations
  Clone ID: PAT_TA_79952
ctactacacgggcaaggagcgcgccatgctccttcccaactgcctgttccggatgggcggcgccgctgtgctcctgtccacccgcggccgcaacgcgcggtttcggctcgcgcacgtggtgcggacgctgaccggtgccaaggacagtgcgtaccgatgcgtgtaccaggaggaggacgaccgcggcaacgtcgggatcaacctgtccaaggacctgatggtcaccgccggcgacgcgctcacggcgaacatcacggccatggggcccctggtcctgccggcgtcggagcagctgctattcgcgctgtccttcgtggcgcgcaaggtggtcggcagcagcaggatcaagccgtacatccccgacttccgcacggcgttcgagcacttctacatccacgcgggcgggcgcgcggtgatcgacgagctccagcgcagcctcaggctgtcggacgagcaggtggaggcgtcgaggatgacgctgcaccggttcggcaacacgtcgagcagctcgctgtggtacgagctcgcctacatcgnnncaannnggcgcatgcgcannngcnnnngcgtgtggatgatcggcatcggctccgggttcaagtgcaacagcgccgnnnnnnnnnn

SEQ ID NO: 79953 - DNA, 598 bp, Triticum aestivum
  unsure (1)..(598): unsure at all n locations
  Clone ID: PAT_TA_79953
gcacgaggagagctcgctcgcccggcctccgcccccgcttccgcccccctcggcgcggggctccgcgggcgcgaggctcctcgcccggccccggccggcgccggcggtgaggtgccacggcgagcccgcgtcgtcgtcgttggcatctggatgggccccgccgacgccgttcacggggagggacccggacgcgaggaagccggcgtggctgcggcagcgggcggcgcagggggacaagtacgcccggctcagggagtcgctcggcgagctcaagctcaacaccgtctgcgtcgaggcccagtgccccaacatcggggaggtagtgctggaacggaggcggcggcgccggcggggaaggggacggcatcgccaccgccaccatcatgctcctcggcgacacctgcacccggggctgtcggttctgcgccgtcaagaccagtaacaagcccccaccgcccgacgccctcgagcctctgaaaacgtccatcgcaattgcgagttggggagtggactatgttgtgctgacaagtgtcgacagagatgacatccctgatgnnngaagtggcnnnttcgccgaaacagtnnnnnctctcannnn

SEQ ID NO: 79954 - DNA, 608 bp, Triticum aestivum
  unsure (1)..(608): unsure at all n locations
  Clone ID: PAT_TA_79954
tctccttccctcaccccaccccccacccgcgtcgccgccatcgccgtccccgttcctcctcctcgccgcgcccctgccgtctccgcccgcccgcccgtcggcagtctctggattcgaggccccggcgctcctatggcgacacccgacgagcatgccgaggaggagtatgctgagaaggagtatgccgatttcgaggagagggtcaagaggacgatatacatcgaccacctctcccctgtggttactgggcaggttatccgagcagctctttcccagtgtgctaatgttgtcagtgtggagttcgttgagaactacacgatcccgtatgacatcccagccgccgcgctggtggagttggacgacgagtcgcaggccaggtctgctgtggacctgatgcgagacttccccttcataatcggcggaatgcccaggcctgtccgagctagcctggcaaggcccgagatgtttcctgaccgtccgagcccgcccggctcgannnnngagttcctttggctgaaacaaggagatncggagtatgatgggatgagcaagctcagnnncttgcaaagagcnnnnngcannnncatggcgctcatcnnannnannnn

SEQ ID NO: 79955 - DNA, 648 bp, Triticum aestivum
  unsure (1)..(648): unsure at all n locations
  Clone ID: PAT_TA_79955
gcacgaggctcaccagaccaatcccctgacccgtctctctcgtctcccgcggcggcgggggcggtggcgcgcggccgttgacccgatgaccggcggaggcggagaggacgtccccgcggcgaggcggcgccccctgacggttctccccctcgtcgcgctcatcttctacgacgtctcgggcgggccgttcggcatcgaggactctgtccgcgccggcggcggcgccctgctcccgctcctcggcttcctcatcctcccggtcctctggtcgctccctgaagccctcatcaccgccgagctcgcctccgcgttccccaccaacgccggctacgtcgcctgggtctccgccgcgttcggccccgccgtcgccttcctcgtcggcttctccaagtgggcctccggcaccctcgacaacgcgctctacccggtgctcttcctcgactacctccgctccagcgggctcgccctcgcgccgccgctccgctcgctcgccgtgctcggcctcaccgccgcgctcacctacctcaatttccgcggcctnnacctcgtcggcctctcggcgnnnntcctcaccgccttctccctgtccccgtttcgtcgcgctcaccgcgctcgccatccccangnnncnnnnnnnncgctgncnnn

SEQ ID NO: 79956 - DNA, 437 bp, Triticum aestivum
  unsure (1)..(437): unsure at all n locations
  Clone ID: PAT_TA_79956
gcacgaggaaacaatcttaggacaccttctgacacagtgcttattttcctgtgaatgagaaggcattttattctgatgatacaccctgtttatttgagtttttggcccaaggatgtttagggccctgttttctatctagaacgcaaatggagcctatgatgattagctttacgttggaattaccgtcagattcgaaatgatgatatttttgcggctttctgaggcttaagacagcttagctcttctacttttttattgttatgaagtttcttcagcctggttaagattcttagaccataggatgttctgcaagtgtcctcctttgcccagaacctttgtagtttggtctgggctggaatccccagccgcactttgttttttcagctgtgtgtgtaattttaaacaggttcctgnnngattctcctaaaaaaaaaaaa

SEQ ID NO: 79957 - DNA, 635 bp, Triticum aestivum
  unsure (1)..(635): unsure at all n locations
  Clone ID: PAT_TA_79957
gcacgaggctggtgggtccaagggttctcttaggctctgggatattcgaactggcttgacaactaaagagttcaacagaagtcttggcaccatcctcgaccttgacttcagtgctgatgggaagcagtttatctctccaactgacacaaccagaagtaatgtcagtgagaacactataattgtatgggatatattacgagaagttcctctatctaaccaggtttatacagaagcgttcacctgtccctgtgtgagataccacccatacgaagcttcttttgtcgcgcaatccaacggcaactacatcgctattttctcagcaaggccgccattcaagctaaacaggtacaggcggttcgaaggacatggagtgtggggctttccgataaagtgcagtttctctttgagcgggagggaacttgcatctggttcgtcagatggctgcatctatttctatgactataagtcctcgnnntttctgaggaagatcgaagccttcaaagaagcgtgcacttatgttgcataccaccctgtactacataatgtgattgcttcatgtgggtggactggtgaaatatctgttctcgaatgannncactgatcgttgcagtnttctctgggatttctnnntgcan

SEQ ID NO: 79958 - DNA, 481 bp, Triticum aestivum
  unsure (1)..(481): unsure at all n locations
  Clone ID: PAT_TA_79958
ttgctcgacgcggccatgggcgctcggctctacgactttggctccacgctcgccgggttcatggcggactttcgcccgccgagctatgtgctggctcttgcggcatngtcaannnnngcccgcactacatctgctctggctatgctcaccanngnngacttgtccaacgtcatcatgctgtctctctgctctagctgctcaccggcatgcaacggttgtgcgaccgacggctactgatttcctgcgttgaccgtcgcgccgatgattaagaacatatcgtgcgacgatgctcatatgctcgtcgaccntnctgtctgtgtgntnnncgaccgcaccancnncactgnnnnntnnnaacaaannntngtatgtacgtgcatcaaaagcatcgtnnnnnnnnctgatgaaggacatttgatnnngacatgaaactcnanngaatcagtttgcgatcatatctgnncaccngctgctctttcnn

SEQ ID NO: 79959 - DNA, 618 bp, Triticum aestivum
  Clone ID: PAT_TA_79959
cctcgtgccgaattcggcacgagggcaatgtaaggtaccatttggtggagcaggctaaatgcaatcagcggccgcagaatcctcgagaactattcaacctgaggcatgcacaacttcgtaatcatgttgagcgtgtaattggagttctgaagaagcgtttccctatactaaaatgtgcatcgcaataccccatcaactcgcaagcagaaattgcgatagcatgttgtgctcttcataatttcatttgtagtaatgagggtggcgaacaatggttggaccaagttgaatcagagattgatccagtaaaaataattgatgttccaagtggagatatgaagtatacaaatgacatacattctctcaatgagctacaagcactaggtagcacaaaaagggatgaaatagccaatgccatgtggaatgactatcaagactatctcagacggactagaagaaatattgcatgactttcatttgctctcctgtttatatatgtttttgttcagaagtgtactgaataaaataaattcatatattttagcatttttttcccggtaggttggatgtctcatgagtacaataaaataagcagaatattaatattgtaaaaaaaaaaaa

SEQ ID NO: 79960 - DNA, 633 bp, Triticum aestivum
  unsure (1)..(633): unsure at all n locations
  Clone ID: PAT_TA_79960
ccccactggcccctccgagtctccggccatcccatcctagaaacaagtgccgagtccacagccaccgcgcggccacacctccggcgatccatgtccggcggtgggtgcagcatccgcgcaatctggatcctcacgccaaacgacgcggtcgccttctccaggcggtttgcagtggtggagaagcggtggcgggtcgcgtgggaggcggagggggcggggaagggcgcggagatgccgctgccggcggactacgaggtcgccgccgcgtttgccaaccgccggagaagggaaggcacggcccgtggttctggtatccgcacaagcttatcatctgtggggtcagattcctgggtcgatgatccaatcactcgccacattatatcgcttcaaattgacaaagaggaagggggtgggtttatgctgtgtcctgtagttcttcagaaacgtggaagttattatgtccttgtgctgcctctggtggatcctcagtcatttagagcgtccgagagcctattgaaaagacctgattgcgggagttcagccaaagagaatggcaatctttcttccattttgctcaatcttccgtgcataacaggggcctttatggttgcgaatgttattnnngacataatt

SEQ ID NO: 79961 - DNA, 632 bp, Triticum aestivum
  unsure (1)..(632): unsure at all n locations
  Clone ID: PAT_TA_79961
cggtgcatgcgagagtaggcaagccgaccccaagacccgatcatggccaatccccccttcctgctcacgctcgccgccgtcctcctgctcctcccggcgacgccggccagcgccgaggccgccgccgccgcgcccgtgcccttcgacatcgtcaagatcctgtccggcttccccgagttcagcgacttcacctgcatgctggtcgacacgggagtggcccgctccatcaacgcccagaagaaggtcaccgtgctcgccgccaacaacaccggcctccccaccgccgccctccgccgcctcccgcacccgctcctcggcgacctcctctcgctccacgtcgtcctcgacttcctcgacccggagaagctcgacgcgctgcggcttgggcgcacgggcaagggctccaaggtcaccacgctgctgccgggagacgagctgaagctcctccgcgtcgccggcggcgagaagggccgcatcaccttctcctacgccgggcccatcgggaccgggccgcagccactgaatgccacgctcctcnnngtcgtcaccgcgcnnncgttcaacgtcatggtgctccaggtgagcggcctcgtcctcccggggatgatgcccgccacgnccgccnnnccann

SEQ ID NO: 79962 - DNA, 536 bp, Triticum aestivum
  Clone ID: PAT_TA_79962
ccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataacccttcctacgtgcatgcatggacgcgcttgtgtggagcttaatgtctatgttgatggagtgctcatacgatactgatgagctact

SEQ ID NO: 79963 - DNA, 351 bp, Triticum aestivum
  unsure (1)..(351): unsure at all n locations
  Clone ID: PAT_TA_79963
ccacttttcttccccagcacgaatcggacctcgcaacctctttcctcctccggacgcaaatcaaatcgattcaatcccggcccgaaacattgccgaactcgcgacgtcgtcatctccgctgtcttcttcttctctgatctctgatccgcccgtcggttcgagttggccgcccgtgcatcgatcgaccgctataaagcgctcgccttttcttctcgccgccacttcacgtgcgggcccgccaccgcctcccatgcaagcagcgcagcggcagtaggagcacggctgtcgtctatatctcgtgagctcccccncgcccccgcccctgcccgctgactcntnnnngnatcgatc

SEQ ID NO: 79964 - DNA, 622 bp, Triticum aestivum
  unsure (1)..(622): unsure at all n locations
  Clone ID: PAT_TA_79964
gcacgagggtcgtcgccatcgtccaccaccacctccaccgcgccccaaccctatccccgttgcttccgcccccaccttctcccaatcccctcaccttctctcccgtggccggtggattcgcccctcgcgggatcgattcctccgagccgacagggtcttcagggccggacgggagcggcgcgtcccccatcggcgcgttggtgagcgcggcggcggccgtggccgagctcgagcccgtagctcagatccttcagggccggacgggagcggcgcgtcccacatcggcgcgttggtgagcgcggcggcggccgtggccgagctcgagccggcccttctccgcgccggcgacgcgtgcagcaaagaatggaaggcgtgcgttctgtcggcatctgatccagacgacctcacgcctccgcgcccgtcctccttccccgttgcccctcctctcgagccaccggctggcgctctcccttcgccggaagagcctccgactcctcctccggaagctatttgtggcccagttgttcggagatggatctaccggctcgatcgnnnagcggcgggggtagaagtgcaaggcgaggagtgcttgatgcgnnnnnntcataacagccacgcgnnn

SEQ ID NO: 79965 - DNA, 631 bp, Triticum aestivum
  unsure (1)..(631): unsure at all n locations
  Clone ID: PAT_TA_79965
gcacgaggctcaccatccccctctctttctccgcccgtcctcccccagcccagattccagtccccaaatcgtctcctttccccatccatcgaggagcttcttggcaagatggggaggaaagagaagggattcatgtgaggtacccaatagtaatgctatccatgataattatttgaactcaccatcacgtaattcctgcatgccgtgggatggaggaactgaatgttgaaggagtgcagcaagtggaggaactgaatgtcaaaggggtgcagcaagaggaggaactgaatgttaaaggggtacatcaagtagctgttgttccaaacactgtcgactcactggaaaacttgactgattcaaagcctcttgtttctgttggttttactgaaagttccccagatggtcataacagacatttaagtgaagatttaagttcgcttacaattaataatatacgtgtgaatggggaggagatttgccacaaccaatctaaggggaatggtcacaatagaaatttcagtgaagatataggttcccttacaattaatgaatgccgtgcaaacaaagtagaggaaaattgtcataaccagcctgaagtgaaggaacaacaacaaattagtcgccataacnn

SEQ ID NO: 79966 - DNA, 511 bp, Triticum aestivum
  unsure (1)..(511): unsure at all n locations
  Clone ID: PAT_TA_79966
gcacgaggggaatcgaaaccctcgtctctcctctcgcccaaccaaggggcgacgccgcctccgccgtcccggcccgacctcctccccgtcgccacgcccccgccaagttcaaccgtcggcgnnggcgacggcgaggccgtcgtgaaccgagtgacgtcttcctcgcccttctcgtcaaccctgcggcgcaccccgccgtcgcccttcccgtcgccgtctnnagatccaagannatgggaaataaattgaatanncttcaatgatttctgttgggacatcatacgctctggagcctttgtgttaactcagnacaacttggggtacagtttcaggattatgtaaatgccaacttttggagtttgtgcccttttggctgaatcatcaagacactagntagcgattatgtaaagatacaaatgaactgtttattgccaccaagttggcgaaattaatggaacacagcnnttgnngggagactaatgtcanngcccaaagtctctnnagtcggaga

SEQ ID NO: 79967 - DNA, 496 bp, Triticum aestivum
  unsure (1)..(496): unsure at all n locations
  Clone ID: PAT_TA_79967
catgctgggaagatcccgaagaaacacgagctgtctgacgtggaatataagttgaaggttcaggcggagctttctaagaatttaaaggagttggagaagttgcagcaggaagaggcgaatgcaagaccaaatgccattcagttgaggttgatgtctattgaacgtgcgattgatggtgtgatcggtggagccgccaagttgggatttttcggtatgcttattgctgttacttttggtgacgagagggtagaagcccgggttgctatcaaggaaaaccaaatggttatgagttgtggaagaagttttgatcatacttgctcaaatattgtgtgaatgaaggtaaagacagattattagtcggatcatcactctctatgcagtacgcatacatttcaaattacctttttatcagcttacaatgctagtgaatttcaattattacaggattgttactcactattttttctatacatatgaaatttaatttgcatnnnnn

SEQ ID NO: 79968 - DNA, 631 bp, Triticum aestivum
  unsure (1)..(631): unsure at all n locations
  Clone ID: PAT_TA_79968
gcacgaggatgatgtgttgcttgtcaatcaaatatagtctactgtcggcaacagctatataggctacagtaaaccgacgaattgacaaacagatgagacccatcatgcactcctacatacatggattctgtttgtacttgacagcaacagactactccaatgtatgaatatgtttgtttaaaaatggcagaatgtgtatgaatattaacttcatacatggagtaaattcgtaaaagatgtatgggatgagtttactgataaaaaaagaatatagaatgtctgaatgaccccaatgtacctagctctcaccgccatatagctagcacaagagcttaaaagcaaagtgccagcatgcctcatacatgttccaagataaactagaacatagctacaaatgtagtgcgtcagcaacgttgtctgctactctgcttcacatacagcgtcattgcacattcagttaggtacgtgcaggaccttgcaacattcagtcaagcaagtagccgctgttgttggaacgccgttgtgtgggcagtgctgannnagtcggctcgtcctcggattngngcagtgccgagtccgccggatcgtcctcgcagtggggaagtcccnnnnntgccgggtcgcaatcgnn

SEQ ID NO: 79969 - DNA, 625 bp, Triticum aestivum
  unsure (1)..(625): unsure at all n locations
  Clone ID: PAT_TA_79969
ctccagcgctcagatccgtgggatccggcggttgctcacggcggtgctgctccggtgagcctccgtccccaagcgcgacgcggaaaacggcctcctccctattgttcctcctccatcccccgagcacggcgaatccacgacgacctcctctctcccatccccttctttgcgctggtaggcgtttgtgaagttcgacatggccagccgcgtgagtttgattccgccgcgccctgcgcccctgccctacctccacccaccagaggaggcctagctccgagccaccacctgcgcacggctgccgccgtgacgcacctaccccaatcccaccgggcggcgccaccagcaacccctccccaaccacatgtcagatccagcgccggcgtcaggcacccctcttccttcacgtcctcttgctccgatggctcgcccctaccctccccgggcttcggctcccgatgaagccccgaccatcttgttggtggcagatgctccaacggcaggctcactccccacggtgtgattgaacttcagtacagggnnnnagtagaaccgccagnnatgctcgtgtcaattccttccagcgacgtttgtccacacctcgtcgccggcgtgaggtatatatann

SEQ ID NO: 79970 - DNA, 463 bp, Triticum aestivum
  unsure (1)..(463): unsure at all n locations
  Clone ID: PAT_TA_79970
ctagtaagtagtaatttttttaaataatagaggtcagcagctgggacaaanntttttttgaaaacgaggaagggtgcttctttttttttttcaaaaacgaccccaagnncgtttttttttttcaacagtaacctccaagaaattcgggaagccccatccccctgagttcccccccccccagtgttttttccccccccgccgtttgctctcgcgcgcgcgcgctcttaataaaataaaccccccgttcgtgttccgtttttttgtgtgcccctggcgggtgtgttaaaccaattgtggcctttcttgtgcccccatttttagagaatttggggcccctccnnnttgaaaaaaaaaaaaaaaaaaaaaaanntctggggggggggccgggcccccatttcccccttttgggggtttttttnncccccctctggggccggttttttacaacgtggggggggggaaa

SEQ ID NO: 79971 - DNA, 409 bp, Triticum aestivum
  unsure (1)..(409): unsure at all n locations
  Clone ID: PAT_TA_79971
gcacgaggacttatcaaagtttaaagaataccgccataaatggaatacaaaatcgctaagtttctnnnactgagggtgtgtgtgtgttttcaaccaattctgaaaacatagtcatgggtacatatatagacaaaacatgtgtctgtccggcgagtacatcattcatcgtgttcaagtccatactcttacattggtgtttaaagacttggcggtaaaccgagtgcaattaggcaacagcagtgccaaggttcagttcagcaaggagaccaagtgcccctacattgtccattcctacaacaccctggcctgtccaacgagaagactcgatgcagccagctacgactatggcccacttgacaaccaagccanncaacacgcataacannncnnnaannnnnnnantacctca

SEQ ID NO: 79972 - DNA, 559 bp, Triticum aestivum
  unsure (1)..(559): unsure at all n locations
  Clone ID: PAT_TA_79972
aggggaacaccaaattttcttgtcagtctacttaagcgttttcttcttgtacttctttcaaatagttaacaatttatgtgtgaaaaatcttttaatcatgccctttcacgggtcctttttttttttcaaataaccctttcagttttttttcctgataacccttccagggttcttgaaagcaataacttttactactcccgataattatttgggacggagggagtactacttaatttatgttacaaaaaatgtaccctngttgttcaaatgtttttttccaaatgttttggaaccaccttgcacgaacaatttcattgaaggacatgataaatttcgatgtgaannnnaaaaaataggttttcaaaacacaccacttatctttatcnntttctcttaaattttgagtttgggccnngataannnaaacnnnnnnaatggtaaacagtaaattgtatttaatatatcgttgnnnaatatatcccatgaaaaagtaaatttctataggggaaatcaactgatannnannnaggactgnnntgatcaacacatgnnnnnnnnn

SEQ ID NO: 79973 - DNA, 615 bp, Triticum aestivum
  unsure (1)..(615): unsure at all n locations
  Clone ID: PAT_TA_79973
gcacgagggcgtgtagccccgctccttcctcgcctcgcggctcccctcccgtaaccctaccccctcctctcctctgtgccgccgccgtcgtcgccagtcctcctcccctcacaccgcgcccgcacggccctcgaggcgatgcgccggatccaatccgaccatgccgccctgcgatgcgacggcgagtgggcgcctgccctccccgtccgtgagctcgtccccagggacgtcatgcagtgagtgggcgagagcaggtgaagtgaaggctcgaagcaggcaagcggccgtgactcgatggggtgcgaggcggaggcggaggagcacgtctccggtctccccgattccgtttcggtggtggcgtgaggggatctgccgactggccgagcagggcagcaggcgacgacgacgaccaagggagaagccgagcagggcagcaggcgatgacgacgaccaagggagaaggggaacggcgctgcggcatccgganngcacgcggccacaaccccgtcaagctagcgcgccatatcgcgctccagtggacgggaggagccaggtgccgtcgaggggaggagccaggcggagcgcgccgtctcgattggttgcgctctgggcgac

SEQ ID NO: 79974 - DNA, 608 bp, Triticum aestivum
  Clone ID: PAT_TA_79974
gcacgagggatggcgtccctcttccagctgcagctctgtccaagcgatcgatcgtccgctgtctgtccaacgagctctttctagctcgatcgaggcacgccattgccatggaagccgcacggatcgcgtcctttctgctcctcctcggggtcgtttggtcacgcgcacagcccggcgccgaggcggccggcacgacggtcttcacactgcgcaacaactgcaccttcacgatctggccggccacattgtccggcaacagcgccgtcgccgtcgggggcggcggcttcgagctcgcgccgggcgccaacgtgtcgttccccggcccgacgggctggtccggccggctctgggcgcgcaccggctgcgtcgccgccgcctccggcgcgtccctcgcctgcgccacgggcgactgcggcggcgccgtgcgctgcaccctgggcggggcgccccccgtcacgctcgccgagttcaccctcgggggcgcggacggcaaggacttctacgacgtgagcctggtggacgggtacaacgtcggcatcggcgtggcggccacgggcgccagggtgaactcctcgacatgcggctacgccgggtgcgtgggcgacgtg

SEQ ID NO: 79975 - DNA, 614 bp, Triticum aestivum
  unsure (1)..(614): unsure at all n locations
  Clone ID: PAT_TA_79975
ctagaaattggaccatgtggagtttccccctgttggccttctgtctaatgtgaaaagattgttgctccatgaaaacgtagggaagggcaaggtattgtgttctttggcaacatatctcatccactcagcaatttttttatttttaggacatatgtttttttattacttgtggatcgacataatgttttttttccattactttttgggcgaaaatcctcagctagtcaatttttaagatgaaaagttgttctacaataatataagatcatttttcaagctaacatagcttgaaaaacaatcttatattgtgggacggagggagtatccgttcaggtagaggtgtaatctacggtgaatagattgagggcacttggatattgatgttttcagttcttttggttgatcaaacagaacaaggaagaagagggaccaacaatcattccctggtgcactgttgaatgtacctatatctcctaagtggtatttcatttgactttgttaattgatgatatttcttggtcacataatgctttcctgttgaactaggtctttnnnatcatgtgtttggttaatacagtcggttaatacaggttgtttctaataaaaaaaaaaaa

SEQ ID NO: 79976 - DNA, 601 bp, Triticum aestivum
  unsure (1)..(601): unsure at all n locations
  Clone ID: PAT_TA_79976
tgagagcatgaagaagggtggggcgacaggcggggcgactccgggatcttctccggggattgccggcgttgccctttccagcgggaggaggcgggtgggcggccggttctgggcgctagccgatgaaggcgccggggactcggacgacgacgacggcgacctgcttgtcgggccgtcgggcgttccgtctccttctccttccgacgtcatttgcgaggcctttcggcttgggtacccggaggacgaggtggctctgctcgtatatcgggctatcccctccgatgatccggcgaggatgggactacgggcggaggacaagatcgagatcgtcaggcgggtagttcaccggcgtacggcgacgacggcgatccgaccttggaagggtcctctacctaaggttattttccgagccacggccatgatccgttcatggtcgctactcactccgatggtggccagggagcatttggttactggatctatccgctgggagatggtagctcgggatatcttcaaccggtttggatggcggtcatgtaataggataggcaattagtttacctatctatatttagccnnccggttgtggcgtcttatctnn

SEQ ID NO: 79977 - DNA, 620 bp, Triticum aestivum
  unsure (1)..(620): unsure at all n locations
  Clone ID: PAT_TA_79977
cctccaatgaagcgtacgcatcgcccatgcactgtgagcctcgtcacgtccctggaactgtaggccggaaacatacgcgccacatttatgaggagcctctctcacgtagccatccacggatcatggaccatcctcctccagcgcccctccaatggagctagcacgctccacgtacggcagatctagatgctacgccggccttgacgcacattccgcgtccatccgtccgtccgtccgtcccatgcacacgcgcagtttccacttgcgcatacatacatacgtacaccatcgcgcgcttccgatcctcactcgctcatcagtctcccggccgcggccagcctccccatcccgctatataactcccagccccacgcaccactcatcactcacctcgcaacgcaccagcgccaagtacatccattggccacccacccacccacacacgaccctccacccccactccactccactccaagagtagctagctagctagcaagagagtcccagcgggtgaccagctgccactgctgctctcctaaaggcactcaggcgagctagtcgatctgcccacggcgacctgccggcgcgcggggagggggagggggagctggccggcnann

SEQ ID NO: 79978 - DNA, 345 bp, Triticum aestivum
  Clone ID: PAT_TA_79978
tggcttggctcttttctctgcgacagaaagaccaccttgaggtatccatccttgaaagtggtgtactgcctgcctgaagattttataatttctgatgatggatcaaataccccagcatcccatgatcacaaattcacaatatccagggcaatatctcttgggaggacctgcatggctaggctgatcgcatcaaagcaagaagtacctctatttttggtgtgcatgatatatttcctagcacctgagggcaaatgggtagtcctagaataagtgcattgaagtttcttccaccttgtcgtcataaagaactctcaaggtactgattttctgctcaaaaaaaaaaaa

SEQ ID NO: 79979 - DNA, 626 bp, Triticum aestivum
  unsure (1)..(626): unsure at all n locations
  Clone ID: PAT_TA_79979
caccactgttcgtctaaaaaaaacacccaaccctcgatccagatcccctcttctcttctcccgattcacccctcgtctccctcccatcccacgccgccgccgccgccgcccgccaccccggcgacctccccaccggcgatccccagcctctccctctccttctcccctgcatccgtcgcccgcaccttccctcccagtcccagatcaacccgcgggtgagccggcggccaggatatagcagtagcgcagagaaaacagagtcgcctcttcttctcctcccaaatcctcccgctccccctgcacatttcttcatgtccccgctccctccctcgctccaccacggcggcctcccccgccggcggatctgggactgggggacgcggctgcgctagcggcggtcggttggttggtggcggaccggcagagcctcaacgaccatcgattggaggtgaggggattgggggcggggagtccacggcgaaaacagagggcggagatccatcggtggccagcagcagcagctcagttcgttgtcagaatccatggcgctggccgcgccgcaccttttcctgcttcttctagtctgnnncgagcaccagcgaaatcttggattcataaatgggagn

SEQ ID NO: 79980 - DNA, 450 bp, Triticum aestivum
  Clone ID: PAT_TA_79980
tgaactttggcatagaaagagctatgttcgtgagaacctgctggttcgtctcctcttgagtgtacaataggagataggagattattgtatcttggaggagagccgctgtacaactcgtgcaccgtggcgagggcgtaaatctccttgaaagctgctgcaccacgatctgctgcgaccacctcttcttcaacaacagctgcctgcgtcgtcgtccccaacatatgccggggtttatcgcctgtgtaatttctcaaaattggtaggcaatccgctggttttgttcatggtcttgctgccaaggcgcatcagattggaattagtaatctatttatggtatgagtaaagcaaaatggtctgtgctcccttccgttgacaggatgtctatgttgtacgttaaaactgaaaaatgtcagtatattgtatatacatttgaagcccaaaaaaaaaaaa

SEQ ID NO: 79981 - DNA, 630 bp, Triticum aestivum
  Clone ID: PAT_TA_79981
gcacgaggcaagtttcttctttcaagacaatgtcaacttttttttaccatggcaaatttttaaagtgattttgccattgaaaattcactagatgtcccacggaaaattcagtttaatgtcggtgacaagtttcttttttcaagacgatgccaagtttttttgaccatgatttttttaagtgattttgcatggcaaattcagtagatgtcccacggaaattttagtttaatgcccatcgcaagtttcttttttcaagacgatgtcaacttttttgaccatgccaaattttataagtgattttgtcattgcaatttcactagatgtcccatggcaagtttcattttcaagacgatgccagaaagaacacaattttaaataaggaatatcatcgatacattcttatccatgtatgattttctggtattatattagatcggcacttatttttgtacactagatggaaaaatacttattgcatatggtcttttgttattttctatttttgtacacattgtaggttttaggcattttcatgttccttttaattttttgtaaacaaagatctttttttcaatagcaaaatttgctttgttaaagacagacttgttttgccatggtaccatgtcctaa

SEQ ID NO: 79982 - DNA, 267 bp, Triticum aestivum
  Clone ID: PAT_TA_79982
gcacgaggggcgaccagactgacgatggcaatggcgaggacctcagctaactccaagctctgcttaagacagactaaatgatttgctggtaataagaagccttatgcatcttctgggcagctatattatgtatatccgaagccttgttgtgttagtatcggaaccctgcatgcacgtacgcatgcttatttatgtatgtctgtgtatcactatgtttctgtctaaaatatgcgagtgaaacattctaatttggggaaaaaaaaaaaa

SEQ ID NO: 79983 - DNA, 547 bp, Triticum aestivum
  unsure (1)..(547): unsure at all n locations
  Clone ID: PAT_TA_79983
gtcacgtcaggctcggtggatcacggtagcactagcttcagctagccagcctctgccactccgggcattttcttgcatccacgacggcaatggccaccgctgatgtccagaacccgacggccgcgctgacggaggaggcgcccacggtggagacgcccgtcgccgccgaggaggtcgcgaagacggaggaggcccccgcgccggccgaggccgaggtcaaggcgcctgctgcccccgtcgaggtcgaggagaccaaggaggtggcacctgccgccgctgagacggaggaggccaaggagcccgagccagcagctgcggccgagccggaggccgaggcccccaaagagacagaggcgccagccgtggtcgagacagagaccaaggaggccgtggctgaggcagagccagcggcgcccgaggaggtgaaggaggaggccgcgcctcctgccgagccagaagcaccggccgtcgccgaggaggcaccggctgcaccggnnnnnncgcccgcggccgcggcagnnnagccggccgccgcggtggccaacgt

SEQ ID NO: 79984 - DNA, 635 bp, Triticum aestivum
  Clone ID: PAT_TA_79984
gcacgagggccgtacctcccgccaagcgcccagcgcttccgccttcatccgacgacaagaagcttgattttgctgtaattaaatacagaaaccaaaagctttcagaacagctagaagtccataagtctgagtaccatgccctcgagggtaaatttgatgatctcaaacagaaacagaagtctcaccatgagacccaagatcttgttaacaagtcatggcagcatcttgtgagagatttgaaggctatctctgtttgcaaaagtggatcccaaaattcttcctgcagtgcagttcctagcaacgagtctacagatggtgcatgcatccggaaagacaaggacttccttagcaggctcgttgagacaggtgccacagaaagttctggttgccatttggaaaaccacgtacactcgtcaactactgatgtgctgcagaatatcttgttctcatcaaatgattcatggcatgcaaacgagaagttaccgttagatcactttactgcattacccgaagatgagcgcattagggaactgcgaagtactgctagtgagatatcactagagcttactgatgctgtacgagcacttggtgatctccacttgaagcacagacagctgacagagaagcaccatgaa

SEQ ID NO: 79985 - DNA, 539 bp, Triticum aestivum
  Clone ID: PAT_TA_79985
gcacgaggctttagcttctgaccatctaaaatgttaggggaaaacaaaaacgtgagatccaagttggtgaagttaaaaggagcaaaaaaacactggcaatgtagtgtcttgcagctcttgcttagtccactcgaagtcagattgccattttacaggatatgttctggtggcacccacccccaccctccacggtccagctatctttctccagcattagtggcaccagacaaaaatgcttggatgtctgttccagtagaagtcctcacctggaaattggaagttgatccaaatatctgttccattgttcacaagtctagttagttagagaaggttctccattgtattatcatccctctaccattccattacgttcagcaaatttctgttcttatcttgacagtacccactgcctgacagagttaacctttttggcaaaagtctttctgtcataaatggtccaaacatatctatatgtactctgtatgtccccaacaacagacaaaacaattctggtccttttcctgtttaaaaaaaaaaaa

SEQ ID NO: 79986 - DNA, 624 bp, Triticum aestivum
  unsure (1)..(624): unsure at all n locations
  Clone ID: PAT_TA_79986
cctcgtgccgaattcggcacgagggcgaagtcgacgcggcgaagaaatcaggcgacaagattgcgaacgctagatatctcgacccgatccgggtcgggtcggccatgacggtagatcggaaggacgctgaggcggcggcggcggcggccgcacccttcgagatcccggcgctccagcctggaagaacttgtggagcagaggaaagtacccggagtcatgttctcgtcaaaccaataggaagcagtaatcttccctgtaatgaatatgcactcttggcgcggcaaaaccccaagggagatgcgcagccagtggcatctattctgcggaaaaagcgacctcggagatcacgtgatgggcctaattcagtctctgaaacgatcaggcgatggaaagaagtgaaccaacaactggagcatgatccacagggtgcaaagagggcgaggaagccacctgcaaagggttcaaagaagggctgtatgcaggggaaaggaggacctgagantcacaatgtggattccgtggtgtaaggcaacgtacttgggggaagtgggttgctgaaattcgggagccaaatcgggtgagcnnnntctggttgggaacgttccnactgctgnnnntgctnnn

SEQ ID NO: 79987 - DNA, 624 bp, Triticum aestivum
  unsure (1)..(624): unsure at all n locations
  Clone ID: PAT_TA_79987
gcacgaggctaagatcaagtgtagtatctgttcttatcagtttaatatctgatatgtgggccatgtgttcacaacgatattaaatttattttttatggggagggcccaccacagtggcttgccactgggaccctcgggtgtcgcccaggcgttgcactacagcctgggctggcgcaccccaccaaatcaatccaatttatcttctttgaaaattacacacaaacttttatctagtggtgattaagcagcattaggatatcatgggattgaagtttggcattacagtttcagtcggtttaatttaatttgttgcacaaatacctgggccaaattcgttcaaaaactatttgtatttgtaaatctcaccaagatttggcatcaaaaatcatattctggccccatagtagacaaaacttggtggggaatttccaagttccgatatatctgggacccctctttccccattcccaaaacccaaccaaacccctcttcccctccgcctccccacaatggctcccggtgccctnnnccgcctcatcatcggccgccgcgcagcgtccccgctcctggcgcgtcccttcgccgcgnnnnnccgcgcgccgcagcgggcaccggnnnnnnnnn

SEQ ID NO: 79988 - DNA, 597 bp, Triticum aestivum
  unsure (1)..(597): unsure at all n locations
  Clone ID: PAT_TA_79988
gcacgaggctccatttctccccaccttccccgacccccaaatccccacgcgaatccgcccccgccgccatggcctccccgccgggcgccgcccgcctcgccgccctgctgctcctcgcgctcctcgccgggcccgccgcgtcccgcttcgccccggcggacaaccacctcatcgcctgcggcgcgacggccccggccgtcctccccgacggccgcgcttcgtcccggactccggctgcgcgtccatgaccctccgctccgcggcccccgccctcccgtccgccgcccccgctgcgcccgcgcccgcgccgccctcccctctccacgccgccgcgcgcgtcttctcctgccacgcctcctacgacctcgccgtgcgccgccgcgggcgccacgtcctgcgcctccacttctaccccttcagccccgccctcgcctccgcgcgcttccacgtcggcgccgggggcttcctcctcctccacaacttcaccgcctcgtcccccgtcgtcaaggacttcctgctccccgtcgacgccgacgtcctcgtcctcaccttcgtccccgnnnccggatccgccgccttcgtcaacgccatcgagct

SEQ ID NO: 79989 - DNA, 625 bp, Triticum aestivum
  unsure (1)..(625): unsure at all n locations
  Clone ID: PAT_TA_79989
gcacgaggaccacacccctccgtctctctccctcgccagccgccagaacacgaaccctagcccctttgcccaatccaggccgccgccgctgcgcccctcactcctccctcctcctcatcaacacagccagcaggacccttccttcttaggccccatggcgggtggtcgagtctggagcgggatagaaggtcgtgggaagttcggcgccggcgggaggaagcagtaggggtgggtggatcagcagatgcaggcgagatcggttgagagaggctagcaagccagagcagcaggagcaaggagctcgaggtgattcatggtttacccctcctcccccgtcctctatcttcccctgccctcactctcgtctcctttttatctcatgggtgacggcgtcggctgggcgcagcgaggagtggaaggcacatgccacgtgcgggacggagcagcaggagcaaggatctgttgcaggggcgccacaaggagtggaaggccannnncgccaactctacaaatttgaggtncnnnnagcattgttgagggaagatgcaagttctggatgcgnnnnactacaagctatacctggagaacaagttcnnnnatgggacntggnagtacgnnnnnnnng

SEQ ID NO: 79990 - DNA, 625 bp, Triticum aestivum
  unsure (1)..(625): unsure at all n locations
  Clone ID: PAT_TA_79990
gcacgaggcacgagggttggccgccaaatcgcgccaaggaaggcagattggacagaacgtattgaacttcttcaaagctgtggacaaggactgcaccaacatctcaagagaagaatttcttgatttcaagacttccctcgagcacagcttgaaagaagtcaaggctgctgttgagaaatctgccaaagaacagaaaatgtttatcgaggccagcactacagcaaactctgagttgatgcaaagggccctgcaccgcctagaggtactctcgcaagatatcaaggctgttgttgatgctggcgtcaagtcccaggaagcaagcactgatactgccgagaaaattttcaacctcatgaatgagatggcggccacactaaaagaggccccccctcaaaggccggtgatcttcttggcaggctggagaagcttgctttctggccaaagaaggttaacaacatgtgtgagcttgtctctgactatgcaacagtaattgtgggcatttgtttgattactggacttgctgatcaaaaacatggacttcttgaaccangagtggannnnnctcttattgagnnnnnctttcccaacaataaccctggcttgtttgannnnntcgggcgtcgnn

SEQ ID NO: 79991 - DNA, 624 bp, Triticum aestivum
  unsure (1)..(624): unsure at all n locations
  Clone ID: PAT_TA_79991
ctcgtattgatagcagttttcttgttctgaagagaatctcttcctctttgaggaatcaagttttcttggtttgctcacgccttgttgctctgttcttgtacgtgctgcaggcagacccctagatccaggaggttttggagatgcaacctccaaatcttgggctccagagcgacaaggaggcaaggcagtccctcctcaagacgagggcctgcatgcttcatgatgccctgcatgtgggggtgctaagcttctcaacccttccgtcctctccgagctaaagatgagctgttaccatggaaggtccctcctctcctgagagcgggaactcgcagcagcaggcactccagccacctcaagcactagacgagcaaaagctccaagatgaaccagagagggagtgatacatttccaactgaaatgctatacaaaatttcctttagcaagaacaaggaagtgtcgatgacacgagctctgggaccgggtccggcggaaacctaagcttcaagtgtgaggctggcggctgctcgtcggtggcggcgtcgtcggtgttgtactcgcagctatcattcgtgtcggtgccggtcacgnnnacggagcagcagcagccgtcttgggggaatgggc

SEQ ID NO: 79992 - DNA, 316 bp, Triticum aestivum
  Clone ID: PAT_TA_79992
gcacgaggattatataaatgtatgaaataaaaaaatgtctcataccaggttggctattgcggaggcgggtggggtgcggcaagccgcacttcctatctagtgagcgtgaaaaggggagagtgacaatataaccaaaacctgagggggttcacttcttgtagccggcagagatatttatggcattgcttgttgctatcactttggcctgccaaccccccttatcaccccctggtcgtttttccgttgacgcatatcatatccaacaaatgatgaaaaccacctagcctgccagattcagattcaagctaaaaaaaaa

SEQ ID NO: 79993 - DNA, 604 bp, Triticum aestivum
  unsure (1)..(604): unsure at all n locations
  Clone ID: PAT_TA_79993
cttcaagtttgttctccttttgttgaaggtacattgtgatgggtttgcctcaagttcctgcaattaaagaggaggagcctcctaagctaagtacatgtgtagttagtcctccttgttttggtggtagtgataatagtgatttgggcaggcttcccaccggaggctcaagtaacagggcatttccatacccatccatcagcgatctgaagagaaaagctgcattagattctttgattggatttgatggaaattttggagccagccatgctgtcgatgggcctgctggctcccaaggcttaaaacctgatccgaggaatccaagttttagatcatgccctaagttgcgacctgttcagatgcctgcgaggagggttattgggtttgaatcaagttttgctggtttcaagggagattctgatacaatggtagctgacaaaatgaattcatctttagtcatcaacacttgccattcatctattgaacagcatgggcctcaagcaaggaaannngtgttatcgnnnnnnactaatgagctccatggacactncagcggcgatgcgctaaatattggttctgctgatgccaaaatgcagcattctgatca

SEQ ID NO: 79994 - DNA, 301 bp, Triticum aestivum
  Clone ID: PAT_TA_79994
gcacgaggacggcggccggggaccactaccagctgcaccaccaggtgctgggaggatatcaccaccagcatctgcagtacctcgccatggattgattgattccctttattactagccactataggtccatggatggattagttgatatagtacgtaattagttcccttcctgctcgtattttgttttctctttcatttaaatatgtgaagtttaactaattaactcgaggagaggacaatgaaatcaaattcgaaagcttctggccgaaagtctcggatcattctcaccaaaaaaaaaaaa

SEQ ID NO: 79995 - DNA, 443 bp, Triticum aestivum
  unsure (1)..(443): unsure at all n locations
  Clone ID: PAT_TA_79995
gcacgaggcttttttgtttttgtttttgtacttctggagtataaaagcaaactcactctgtcccaaagccattccgtgttttgaggcagtttcttcgtctgcgagatggatgtaacccaagtatctcgtccgcgagtccttctcaaaccagtagttttgctttgttgttatagaaaatgaagagagttggttttgcttggctggtgatgattcaagtccgaatggatctgagcggatttcggtgaagcggattcgtccgccgttgatcgattcatgttgttacacacactgaagcctttttctttctttcttgtttcgattatccttttcgttcttgcgatgcgatgatgattcatatannttttggcagtggtggcttctgtcaccgtgagccttcaaaccaaaaacgacttctctttccactgagcattaaaaaaaaaaaa

SEQ ID NO: 79996 - DNA, 230 bp, Triticum aestivum
  Clone ID: PAT_TA_79996
caggagttcaccgacattttggtgaagccgaccaaggccctgatgcttgatgcaccagccgagaagatcgaagcttaagatgatgtctctttttgccgtcaagtgttggtttgtggaactatgctactctcttttatcgtcaatggaagctacataattatggcaatcagtcttttttatctatagatgtttggcttctatctatgctgctttgtgttaaaaaaaaaaaa

SEQ ID NO: 79997 - DNA, 626 bp, Triticum aestivum
  unsure (1)..(626): unsure at all n locations
  Clone ID: PAT_TA_79997
cgctagnntacaggagncagggcgtggcggccatcctcggcgccatggccatggtggcagccatccaccacctccccggcgacctacaagtacccccccccccccttggtcgaaccctaacctctcctccctccccctcgcgccgtagctcttaccctcgcagacgctcgagccctcggcgcatggtctccgacgtccacgtgcctaccgagctccccgcgcccagccacctcgtccgcgagcttcgtcgacgtccactccttcgactacatgcaccaattcgaaccgggagcccctgcatcgacgggatcgacgccttcttattcctcgggcaccaccgcctccgccgtcgatccgccgcctccgctgctcctaagccatcgccgagccacccttgtgctccccgaccccgagaacgatgctgccctatgatcgactacgtcgacgatgacacttcttctttttcagcagagcttccagatggtggagcccaggatccagacgaccccaccgacgactactactatcccgnnngtgcctactactacgtggagactgccgacgaccaggagtagttagnnngctcccnnntnnnnngccttgacttttcnntcaatgttgctttt

SEQ ID NO: 79998 - DNA, 611 bp, Triticum aestivum
  unsure (1)..(611): unsure at all n locations
  Clone ID: PAT_TA_79998
gcacgaggctcctcctcctcctcctcctcccgcgtcgccggagccgccgccgggtccgggcagaaccaggcctgcgcggcctgcaagtaccagcgccgcaagtgcaacccggactgcccgctcgccccttacttccccgccgaccagcagcgccgcttcctcaacgcgcaccgcctcttcggcgtcggccacatccaggccacgctccgggagaccccgcccgacctgcacaccgacgccatgcgcgcgctcatcttccaggccgaggcccgggcctacgaccccgtcgggggctgctgccgcatcatcctcgactacgagaggcagctcggcctcgcgcaggccgagctcgccgcgctcctacgccacctcgatctctgccgccaccaggccgccgccatggcccaggacgcgctcgtcgacgacccagggatgctgctgcttgccccggggcccaacccggccgatgtccaggacggtgtcgccgctctcgacgcgctctacgccggccacgagatcagcaatggccaggctaaccaccacgatcacgatcattatctggtcggcgccacggaccagctgcagccgcagaagcaccagccttacgacnn

SEQ ID NO: 79999 - DNA, 573 bp, Triticum aestivum
  unsure (1)..(573): unsure at all n locations
  Clone ID: PAT_TA_79999
cggcaacaaacattcctcctccctctttgcctctccccctcgctcgctcgccgctccccgcgcatgatccactccctctagccatgtcgtcgtcgtcttccgaggaggaggcggcgcggtcgaggagcgcgccggccccaggcaagcgcggttcggcgagcgcggcggcccgcggcaagtccggttcggcgggtgcgagggtccccggcaaggcccgctcggtcgcctccggcaagtcggtctgggccgagatgggcgtggcgcccttccaggacgggcagtacgtgcgcctccgcaaccgcggccgcggcggttacctctgcgccgacgagacggggcggggcgtctccatcgaccaccgccgcgagatggtcaacacggcgtgggccgtgatggtcctggagaccgacaccaactacttcgtcctgctccgcggcgcctacggccggcacctcgccgtcacgcgcgacgaggcggggcccggccacatcggcttcgacgccgcccagtgcgccttcgacgagccggaggacacccacgtcatgtggtggaccaccccggggaagnnnnnca

SEQ ID NO: 80000 - DNA, 180 bp, Triticum aestivum
  unsure (1)..(180): unsure at all n locations
  Clone ID: PAT_TA_80000
agctcctcctgccagcttacaaggcaaccaacgcagcgcgcgcaatggcggcggtgcagcagtacacggtggcgctcttcctcgccgttgccctcgtggcggggccggccgtctcntacgccgcntacgcccccggcgccccnnnnanccccgnnnnnccannnanncngcccaaagcga

SEQ ID NO: 80001 - DNA, 527 bp, Triticum aestivum
  unsure (1)..(527): unsure at all n locations
  Clone ID: PAT_TA_80001
gcacgaggccctttcgttcccccgctcccacacccaccaggagattcccccaacaatggcggaggacggcctcaacgactacgagcgccttcgccaggagaacatccgccgcaaccaggaaaagctcgcccccctccgccgcaaggccgacgagctctccgccgccatccggctcgccaaacctaagcggccgtatcaggccaggcccaagcccacggccccgaccggccccgtccgctcctccggccgcgcccgcggcgtcgcccccgacaacctccccccggatctcagaagcacccgcctcgcgccctcgctcgcctcctccatcctcggggttcccccgccggagggggccaaggttcgtgcggcgggcgatttcgatgctgggagggacatggtgctgatgcccgcgcacgcgagnannntgatgccctgttgcatagtgtcgatgcgggtccttccgctcgccgaccggaccgtggtggcggcgggcgacagaatgnnnnatattgggtactgggacgtcg

SEQ ID NO: 80002 - DNA, 354 bp, Triticum aestivum
  unsure (1)..(354): unsure at all n locations
  Clone ID: PAT_TA_80002
gcacgagggtccctccctcccccgcctcgccccccgcacccactttccccaagtccacttcttgccctcaccctccccctcccttccgtccgccttgcttccttcctgcgcaatcatcgcggccggtctcttctgcttctgctccgggagggcgccgatcgagcgaagcgcgcgatggacggcgactacgtctccggcctgctcatgggctccgcggggctcgacttcggcgtgccgggcctcgacgccggcttcttcgagacgctctgcggcggcgcgggcgccgcgggcctcgccgtcatgttcggggaccgggcggacgggatgcccggcnnnnncnntaacnncnnnnnn

SEQ ID NO: 80003 - DNA, 610 bp, Triticum aestivum
  unsure (1)..(610): unsure at all n locations
  Clone ID: PAT_TA_80003
gcacgagggtatgattttccagtatctcacacataatttctaatacactatggaacaatataggaattgtttttatagtacctgcaatgtatgatgtaccagtgtctcgcacataatttctaatacactatggaacaatataggaattgtttttatagtacctgcaatgtatgatgtactagtatctcacacctaatttctaatacactatggaacaatatagagctcgtatctcccttctctggatttgtcacgcagcttttgttaaaatggattctaatgtttagcatgtttgtaaaaacagatcnnnccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtagccatgcgcagacttcccttgcttgtcttttctgtaatttaagatatatatgatcgtcatcctt

SEQ ID NO: 80004 - DNA, 592 bp, Triticum aestivum
  unsure (1)..(592): unsure at all n locations
  Clone ID: PAT_TA_80004
gcacgaggcactagaaaagggagcactttgtgttggcgttacaaatacagtggggagcacgctgtcaagaaaaacacattgtggaattcatatcaatgctggttgtgagattggtgttgccagcaccaaggcttatacaagtcaaatagtagtcatggcgatgatagccttggctattggatctgatcagttatccactcaacctagaagggagtctataatcactggtctttcaagccttccaagccatgtcagtgaagttctcaagcttgatgctgaaatgaaagaactcgcatcttcactaatcgactcggagtcactccttgtgtttggaagnngttataactatgccactgccttggagggtgctctcaaagttaaagaggtcgcgctgatgcacagcgaaagcatgcttgctggcgagatgaagcacgggccactagccctggtggatgaaaatcttcccatcatcgtcatcgcaacacgcgactcgtgcttcagcaagcagaagtcggtgattcagcagctcctttctcgnnnnggcgtttgatcataatgtgctctgannnggacatctccgnngtcggtccta

SEQ ID NO: 80005 - DNA, 559 bp, Triticum aestivum
  unsure (1)..(559): unsure at all n locations
  Clone ID: PAT_TA_80005
gcacgaggggcgtctgagggccggctcagcaactgcatcgccatgtgcgccctgtcgagctcggtggagaagccaccggcggccgcggcaatcgcgctggggctgctgatctcggagctgagcaaggatccgtggaaggggcgggtgatcaccttcgacgccacgcaccagctgcacaaggtgcgcggcgcgtcgctggtggagaagctccggacgctggccgccgtgagggcacagaagggcgcgaacctgcaggccgtcttcaacaagatcctgaacgtggcggtggccggcgcgctgtccaaggacatgatggtgaagcgggtgttcgtgctgagcgacatggagttcgacgggtgggtgggcggcgaggcgtgggtgtcggagcatgcggccatcaagaagaagttcgcggcggaggggttcgccgtgccggaggtggtgttctggaacgtgggcacgtccannnngtcggtgccggtggtggcggcgcnnnccggcgtggcgctggtgagcggctactcgaagaacctggtgcggctgttcctgnnnnnnnacg

SEQ ID NO: 80006 - DNA, 627 bp, Triticum aestivum
  unsure (1)..(627): unsure at all n locations
  Clone ID: PAT_TA_80006
ccgacatcgacgacgtcgtcaccttcgtcaagtggctcgacgtcgagctctcacgcctcgtggatgaacgggcagtgctcaagcacttcgactggccggagcagaaagcggacgcgctccgcgaggcggcgttcggctaccgcgacctcaagaaggtcgaggcagaagccgcgtcattctgcgacgatccgcggcagccctgcgcttctgctctcaagaagatgcaggccctctttgagaagttggagcatggggtgtacagcctgtcccgtgtgcgcgacggcgccatgaaccggtaccgcgggttccagatcccatgggagtggatgcaggacaccggaattgtcagtcagataaaaattcagtcagtgaaactagcaaggaagtatctgagaanngtttcctccgagctcgaggccacgcanngcggccccgacgaagaagagctcatgctccagggagtccggttcgcctttagagtgcaccagttcgcgggcggattcgacggcgacacgatgcgggccttccaggagatcaaggagaaggcgaacgcgctccagtcacagcgcgatcagcagcacctgcaacagcaaaagctcgccgctggcagaagctgagnccagacct

SEQ ID NO: 80007 - DNA, 540 bp, Triticum aestivum
  unsure (1)..(540): unsure at all n locations
  Clone ID: PAT_TA_80007
gcacgaggccaaggacgacttccccgagtactacgacggcaagacggggcggtacatcgggaagcagtcgcgcaagttccagacgtggtcggtggcgggctacctggtggccaagatgctcctggacgacccctccaacctccgcgccgtctccctggaggacgacggccacatccgggagcccgtcctcaagcgcagcaactcctgcccgggcctgcacatgtcacactgacagagtacaggtttcggctcactcggttccgatggcgaggaggtacattacactacgtacatacgaacgtcgcaacgaagctggcgtacgtgacaggttcagacgcatctctgcatagatccctgtgttgggagaggaacatttctcttttttcggtctcgctgctgtcactcgttacttacggtagtaaaggaacattggtaagtactgtaggatcgatggaacggtgaggagtaagtggtagagataactggtgatttgctcgtgcatgcgctggttcaccggnnnatgtctnnnntgctgaannn

SEQ ID NO: 80008 - DNA, 625 bp, Triticum aestivum
  unsure (1)..(625): unsure at all n locations
  Clone ID: PAT_TA_80008
ccaaatcacaggcacccactgagagtgcagtagagagagagagggagcagcgcagccgcatggcgacgctgccacagcggttcaagctgctggcgacgcggtgcgcggcgggggcgcccagcccatcgcgcagccccgcgccgtcgtacgccaccagccccgggtaccgcctccggcgccgccgcgggtcgcgcctgcgccgcttcctctgccgccgcgtcggcggcgggctgccggagcccgcggggcgccgggaggaggacaagaagccgctggtgggccgcgggagccgcacgctgagggatctgttcgtcgcgtcgccggaggcggggcgcacccgccgcggatgcagctgcgacgccgacagcgacgacgacgaggannnnncagggcccgccggctccggcggcgcgtcgggggcggcgagcggcgggggcgcgaggaggttccggcccgccggcgggggcctgcggagcctcctgatgcggcggnnctggcggccggtgctggtggcgatcccggagagcgagggcaagatcgagctcggcgccatcgnnnagtagatcagcgacggacgggacaagaattgcattccccccggccggccggcacggatcggagcggg

SEQ ID NO: 80009 - DNA, 342 bp, Triticum aestivum
  unsure (1)..(342): unsure at all n locations
  Clone ID: PAT_TA_80009
acctgaacatgcacgcccataattaagaaagaaaacaataaccattcattaattnnncgaacaagtagggcacgcacatcnnacncacccatcaggtcnnactggnntacaggaaggaattgacagttcactcacgcatacggacgcgtgcatacatgttacataaatatgcacgcacacacagtgtgcgtncnagggacatacatacaccccctactgaactcacacacgcaagcaacttcattttattatttactaacccaacatcgaacgatccctccatcaacgaataaatcaacctccaagcaagcccgtgcatgcatgcacgaaggaaggattata

SEQ ID NO: 80010 - DNA, 590 bp, Triticum aestivum
  unsure (1)..(590): unsure at all n locations
  Clone ID: PAT_TA_80010
gcacgaggtcaccgagaaaatcctcgaccgatcggaagacaagcgcccctcacgctccttcaagatgcagatcttcgtgaagaccctcaccggcaagaccatcacccttgaggtcgagtcgtctgacacgatcgacaatgtgaaggccaagatccaggacaaggagggaatccccccggaccagcagcgcctcatctttgccggcaagcagctcgaggatggccgcaccctggctgactacaacatccagaaggagtccaccctccacctggtgctccgcctccgtggaggcatgcagatctttgtcaagaccctcactggcaagaccatcacgctggaggtggagtcctcggacaccatcgacaatgtgaaggccaagatccaggacaaggagggcatccccccggaccagcagcgcctcatctttgccggcaagcagctggaggatggccgcaccctggctgactataacatccagaaagagtctaccctccacctggtgctcnnnntccgtggaggcatgcagattttcgtcaagaccctcaccggcaagaccatcaccttgnnnnnngagtcctcggacannnnnc

SEQ ID NO: 80011 - DNA, 530 bp, Triticum aestivum
  unsure (1)..(530): unsure at all n locations
  Clone ID: PAT_TA_80011
cgccgccgccgcaatccaaccccgattcgattcggttccggcggccgcccaccctctcctttcctctccggaccagcgcaggcggcgatgcgcggcgggcggtcggggggcggggggctgcggaacccctgcctgacgatgcaccagccgtgggcgtcgctgctggtgcacggcatcaagcgcgtggagggccgctcctggccgtcgccggtgacgggccgcctctggatccacgccgcctccaaggtgcccgaccccgacaccgtcgccgccatggaggacttttaccgggagatctacgccgtcgacggggtccaccacatcgacttcccccagcactaccccgtctcccgcctcctcgggtgcgtcgaggtggtcggctgcgtcaggtccgaggagctcgtctgctgggaggacgtgccccaatcagtcaggcttgaaggcttgaccgacttctgctggctttgcgagaatccgcagaagctggtggttccgttcgagatgcgcggttatcnnnntgtgtnnnantt

SEQ ID NO: 80012 - DNA, 621 bp, Triticum aestivum
  unsure (1)..(621): unsure at all n locations
  Clone ID: PAT_TA_80012
gcacgagggttaagtttacaaatctatttaatgaccaatggcaaagctttgccggcattatgttaatctgaaaggtgtatctacatttttaaagttgtgattttggccaattaccactcctattgatctttggtttctgtctttgctacagatcctatgtgcctgctttattattctgctgctgtgaaacaagccttgtcgccacctcacttgtcatcgtagtcgtccctacctcactcccctctgcccttgaagcaagggtatgtaccttacttaattcttcactggaaattctttgaattgatatacaagtatttcaaacacttcatctattggggagctgctatattttcctcctgttgtccggccatcgcttgatctttgcgttccactcgttccactcctcctattggtcatagtttgcctctgccttgctgtgtgccaaagacagatccagaagatatggtaactactgttgatggattgattttatgtataactcatctattcataattttatgttaacttagttgttgtgtttttcttttcaaatgcttttgttttatgggaagctgaaggttttggaattatttgtatgggtgagttctttttctgtaagnn

SEQ ID NO: 80013 - DNA, 613 bp, Triticum aestivum
  unsure (1)..(613): unsure at all n locations
  Clone ID: PAT_TA_80013
gcacgaggcgctggaggaggtcaattacataaacgcccacgcaacctcgacccttgctggagacctggcagaagtgaaagctttgaagcaagtcttcaaggacccatcccagattaagctgaatgcaacgaagtccatgattggccatagccttggcgcggcaggtgccttggaagccattgctaccatcaaagcgatcaccaccggatggctacacccaactataaaccagtttaatccagaaccggcagttgatcaatttgacacggtgcctaacgtgaaacaacaacacgaagtaaatgttggcatctccaattcatttggatttggcggacagaattcagtagtcgtgtttgcaccgtttaagccgtgatgttttgtttgcacgatcttatgatagaaattcggtcttggatagaatggtgaagcactttcctagaagcgacaaccaagaaattactaaatgcaagcagttcagagcgccacaacatatagcatctatgggaaacttgcatatatttggctccattcaaaggaatttgttgcaaaaatatccttgactgttggaacttgtagggtgacccatgtatttgtgtgaatattctaaatgtnn

SEQ ID NO: 80014 - DNA, 611 bp, Triticum aestivum
  unsure (1)..(611): unsure at all n locations
  Clone ID: PAT_TA_80014
caaaaaatcttgtatcgttgttgatgtgtctagaggtgttagcgtctcacctccacaactaccacttgttgaatgtgctgagcccaactatggtgcccttactgctcctctcacatcacccaactctcatctcattatcgaggctggacctcataatctgttttggcgtgttggtagcgactcgtgggtgagatgttctactcgtcatggacatatcaagcaaatcgtggtctttaaaggacgggtgtttggcatggattctgatcgcagaatcttcaaagtgcacttgacaccccagattagcatccaagaactaccagtcatcgagtcaagcatgatcagtaaacggaatctttccaatgcatggctggtggcttgtggagatatgcttctcttggtcggctgtcggggatctatcgtagtatcaagggtaacctttgaagtctttcgccttgacctatcgtttgagcctgcattgtggttcaaggtggagaagctagagcattgggctatattcatcagcacggacaagagaagccaggcattgtcttgcatgaacccggagatatggggagggcggagcaactgcatatactgctataaccatgann

SEQ ID NO: 80015 - DNA, 309 bp, Triticum aestivum
  unsure (1)..(309): unsure at all n locations
  Clone ID: PAT_TA_80015
ggaaaaagaaaaccctttctccttccttcctccctcgctcgcacgcccaaaaagcctaaccacccggcccctgcccccgaccaaacccgcgcgcggccgccgcgcctcgcgtctcgctcgccgccgacgcggtccggtggtggtgggggcctcgccgcgatggattgggcggcggtggcgtacacggcggcggcgctgctgtgcgccgcggcgnncaccgacatcacgctcggacacanntaccgacacctgctccactacgccgagcccatctnnnaangctanntgganngaannatannaatgnnn

SEQ ID NO: 80016 - DNA, 424 bp, Triticum aestivum
  unsure (1)..(424): unsure at all n locations
  Clone ID: PAT_TA_80016
gaaaaaaaacaccctctcacatgtaacaatccaaccnnnntaaatggaacaattacctccccatgccccaacccgtcattggattttgcaacccttaagtagntaagtancacccctcattaaatgcttcaacaacccacgcggacagggccggggaaaaacacaaatttactaaagcgggcggggggggggaaattgaccccccccaattacaccggacccaacgaaccaacctccctttaaattaaggggggggaaaaggggaccccctcggggaaggggaaccggcaaacccnnntaccccggtcgggggggaacttggcgttgaaatccccgagggcgggaaaaaaacgggttttgngggcggacatgggcgtgcttgccgggaggggnnncctgcccccccnnnnnnnnttggcctaan

SEQ ID NO: 80017 - DNA, 634 bp, Triticum aestivum
  unsure (1)..(634): unsure at all n locations
  Clone ID: PAT_TA_80017
gtcagctcacaaaaaggaactggagaagggaaagaatgaggttgaggatcgacgcaacctgtatttgtcaaaggaaggtgaaatactccctggaacgccagctgcggaaggtgtatcagatgttgacatgaataaacgtagttggttggctaaaagaaaagcagaaatgcttgtatctccaaaattccatgtctccagaacaaggcttatcatttacaatttgccaaagactctgaccattaatgatgtaaagaagctttgccgagaagcagtaatttctcgtgctaccaagcaaaatcctgtcatccggaaggtaaatatcctaaacaatgaaaagaaaggtcagggtgctgcacagaagcattcccgaggggtagcctttgttgactttcaagaacatgagcatgctcttgtagctctgnnngttctaaacaacaaccctggaaccttcggtacagaacgtcgtccaattgttgagtttgcacttgaggatgttgaaaaaatgaggctccagaagnttcgaaacgaacgcaatggtagggcaaaagnnnctgcacaagagcgtnnngctctgggnnatcagtctacaactgatggccctcgtccaaaaaagaagnnnccttttnnnnnaagg

SEQ ID NO: 80018 - DNA, 630 bp, Triticum aestivum
  unsure (1)..(630): unsure at all n locations
  Clone ID: PAT_TA_80018
gagagagaagagagagaacgaagatcgtgaccgcgaccgcaagcaccgccgccggtccttgcaccggcaccaccaccgtgatgtggagccagaggagacaccgctgacaagggaggaggaggaggatgcggaggaggtggagagacggcggcagaagaaggaggaagacatggaggctgagcagcagcggcttgatgacgagatggagcggcgccgccgccgtgttaaggagtggcaggagaagaagcgccgtgagcagcagcaggaggatggtgccagtggtggtgcagctgccattgaggctgatggtggaggcaagtctgggaagaagtggaccttggatggtgaggatctcctggaggaagccatagctgatctctatctgctggacctttttggttaagggatgagctttcatgctgcatttttgcgataaataataaaagcgccctttatcgagaaaaggaaggaggttcatttcggcgatttcgtgcaccaggaaatatcaagatttgtgaaagaaatgctagtgttttgggtcttgctcggtttaagcaaaactctgtagcttgtttatgccagcccaggtagacaggtggctgatgcaaatgtaatatcccagttccatnn

SEQ ID NO: 80019 - DNA, 621 bp, Triticum aestivum
  unsure (1)..(621): unsure at all n locations
  Clone ID: PAT_TA_80019
ggcctcgaccaccgccgctgggccggccccgcgcgcggcggcggccacgagttcctcgccgacgacgtgctgcgcctgggcgcgtccaagatccggatcggcctcgacgtcgccggcggcgccgccaacttcgccgcccggatgagggagcgcggggtcaccgtcgtcacgtccgtgctcgacggccccgggaagcccatgaacgagttcgtggcgtcaaggggcctgttcccgctgctgctctcgccggcgcaccggttccccttctacgacggggtgttcgacctggtgcacgtcggcaccgcggcgctggacgaggccggggcgcccgcgatggggcaggcggcgacgccggaggcgctggagttcttcatgttcgacgtcgaccgggtgctgcgcgccggcgggctgctctggatcgacagctacctgtgccnnngcgaggagaggaggcgggtggttgccaagctcatagagaggtttggttacaagaagctcaagtgggtcgccnnnnngnannccggcggtgcggcgacatcaacctacctctccgcggtgctgcgaaagccggcaaggagctgaaatctacacannnantgatcaatccaggctccttgatnn

SEQ ID NO: 80020 - DNA, 332 bp, Triticum aestivum
  Clone ID: PAT_TA_80020
gcacgaggctcaagatgtcaaagccagtgatctccttttgttgaatgaagaaggtacggagttgcccattgacaacctctgtgattgcgttgtggagaataaagatggtacagagtttcccgtctaccacagccgtacttgtcatgttgccaacgaagagattacagagttgcccattgttcttgccaaggcgagctccctaatttttgaatgcattagttttactttttgttaccctgtgtatttggcctccgaatcttaaactaagattttagaatacaagatagtgagctagctccaagcaccttacctttctttttaaaaaaaaaaaa

SEQ ID NO: 80021 - DNA, 337 bp, Triticum aestivum
  unsure (1)..(337): unsure at all n locations
  Clone ID: PAT_TA_80021
ctcaactaaagcaaagcaaacaatttgaacacaaattgtagtacatgctgcacgaaagtgcttgcaaacccaggcgcacaaaactacggggctttcccttgtcctaaacgacaacgtgccctgccggtacgctgtgcccggccgtgctgttgcctcngcaggtgccaccagtgattgacctgcatcctgctctgggtacccgcgcgcgccgtcggagctcgcgctggtgccttccgcgctcccaacttgtgcttcaccagcgcgccgaacnncgagtgcgcttgccccccgccgcgctnnnnngccggcgccggcaccatcaccaccgtccggctnn

SEQ ID NO: 80022 - DNA, 593 bp, Triticum aestivum
  unsure (1)..(593): unsure at all n locations
  Clone ID: PAT_TA_80022
gcacgaggctcaccggcaccgcacagtaccgctgcggacggactgtagagcagagccatggtgaacgccttcttcgcgaccctggcgcgggggctggacgacctgagcggcgcgggcgggctgtcctcgctgccggcgctgctgcgtgcggcggcgctgctcaggggcctgcactcgcagctcatggtgctcgtcggccagctccacctgccgcccggcggccggtggctggacgagtacatggacgagacggcccgcctctgggacgcctgcctcgccgtcaagctcggcctcgccgccgtcgagcgctactgcgccgccgcgtcctgcgccgccgccgccctcgacgactggctccaggacccctcccccctctccactcgccaggtgatgcgggcgatctcggcgtcgaggagggaggccatggcggcggaggaggagaaccgggcgctgtccgagtcgaggatcgcgccgctgtccctgcagctggacgagcggcgcgcggcggacgccnnnctcagcggcttcaacggcttccgcgggctgctctacgcgctgcacaacgccagctccctcctcctgctcatcctggc

SEQ ID NO: 80023 - DNA, 505 bp, Triticum aestivum
  unsure (1)..(505): unsure at all n locations
  Clone ID: PAT_TA_80023
gccaagcacagcctgcccgatccatccatctgcttccatttatccatggagacacatggtttgcaatttggcagaaggaacccctccaagcagatcccctccctccattcttctccatgggctacgtactactcatcagctcctgacggcgtccccacctgtggatgtcgtggttgccaaagatggtagcggggatcatgacaccatcagtgcggctgtggcggcagcaccgccagggggttcaaggtacatcatccacatcaaggannnactgtatcaagagaaagttgaagtgctccaacggagcaatgtcatgctcatcggagatggagctgctcgaacagagattatttaattttgttagtgtgatttttgttgtanncgttcccccctttttatcttgtactacctttgttcattctccttttataagacattttagacatccactatatatgaaaacaaaaggagggagtagtatatatatatctgtaaaaaaaaaaaa

SEQ ID NO: 80024 - DNA, 547 bp, Triticum aestivum
  Clone ID: PAT_TA_80024
gcacgaggatcacccatggcggcggcgtcggcagctgctgcggcgtgccgcagggccgtctccagcaccctccgcggcccgccgatagagagcctggccgcgacggccgcgcgcgccgccgcccccaccggcgaccagttcgtggacctcctcgacgccaacttcaacaggccggccccgccgccgccccccaagacgcgcacggagaacaactccccgacgttcgccacctcgggcgacccctgcctcgacttcttcttccacgttgtcccgggcaccccggccggcaccgtgtcatcgctcctcgccaacgcctgggccgccgagccgaccaccgcgctccgcctcgcctgcaacctccgcggcgtgcgcggcaccggcaaggccgaccgcgaggggttctacgccgccgcgctctggatgcacggctcccaccccgccacgctcgccctcaacgcgcgccccgtcgccgagttcggctacctcaaggacctccccgagatcctccaccgcatcatccacggcggcgtctccaccaggaagccgg

SEQ ID NO: 80025 - DNA, 328 bp, Triticum aestivum
  Clone ID: PAT_TA_80025
cctggttgaacaagctcctgatccatgttacaagacaggctagctgctaatggattttctgtgttccaaaggcaattggttggattcaattcaattcctataaattgcaggagagatgcaaatcaatcagattgtgcactgcacggtttgcttcttatgctcggtgcagatgtgatgtagttagagattagttattatgtgcatccgcgtttgtacatttttaaacggtatttcattagacatgataacagatgtaaacttccaaggttcttctatcagcattgcgacagtgagcagattttcagctttctttctcaaaaaaaaaaaa

SEQ ID NO: 80026 - DNA, 501 bp, Triticum aestivum
  unsure (1)..(501): unsure at all n locations
  Clone ID: PAT_TA_80026
ccttttttttttttttttttttttttttttttttttttttttttttttttgggccaaacaaaccggttggcccaattccccccgggggggttacctgggggcatttttctgggggggaaaaacccaccagttccctggccaggggggggttcctttttttggtgggggctggaattggccctttttttgggaaaaccggtggggattcccttttttacaatttggcccccccccccccccccccctttaaaacgggggaccggggcccccnggtttttgggggggaattttttggtattaccggtncccccaattcccnggggttttggcacccggtttctttggctggccaaaaaggggggggccctntctttttttttttttccgggggggggggggaacttcttggggccgggggttgtgaccttancgggctttttgggggttttggggcccgcggggggaaacttgtcccnntcggcggcggcggngnaaaacccn

SEQ ID NO: 80027 - DNA, 583 bp, Triticum aestivum
  unsure (1)..(583): unsure at all n locations
  Clone ID: PAT_TA_80027
gcacgagggttcctttccttcgtctagaaggaagaaagagaggagcctgcctcgagccccacgcaccttcttctttcctctccaaaaagttagtttgtttcggcgatgcgccgcgccgctgccttgtattccttttcactcctctccttcgagcagatcggctgataaggcgtagtggccggaggttgtggaccggtggaggcgaggtatgtgtgtggcatggcgtattaagcggcggtgtagcacggtttccttccgctagatccggcgacctacgagatggcagcggtggtaggatgctggcggcagagacgcggatcaacatctacctcgacgccggcaagtcagcgggcggcgaccgcccctccgttctcctccgcgagcgtagcaccacacgcccgtcgcccacgcccctcctcctctactcgttcctgtctccgtcnnnctggtcgcttccctcctcgatctattatgtcaacctcgttgagattttcttctttgcaaaattgtccgtcnnncagagattctcttctttgtccatcattccatttgataatctatacttgcagttcgactaaaaaaa

SEQ ID NO: 80028 - DNA, 592 bp, Triticum aestivum
  unsure (1)..(592): unsure at all n locations
  Clone ID: PAT_TA_80028
ctcccctcaaccaaggacgacggagatctagtcctctccccgcgcggcaacccttcctcccacccaccgccgacctcgccgtgctcctcacccaccgcccacctcgccctccctcccctcaccatctctccctaccctctgccctctgccccctgcctcgatcccccagatccaatcgacacaaccccgccgcccccgcaccccgtactgtccaccatggccgcctcctcctcctcctcgctccggatccccgccccaacccaccaccccgccgtgggggcgcgtccgcggcggctgcccttccacgccgtctccgtccgcccccgctgctccgcagtctcctccgtctccgcctcctccccgtcttcgtctgcttcttcgtgggttgaatgaattgattgatcgtgcatgtggtgtggtgtggcagttacatgacgagcccggagctggacgaaggcgtggtgtnnnnngagccggcggcggcgtcgtgtgacggcggggtggccgtgcaagcgnnngacggggtgttcacgtgggacgacgaggagacagnnnccgggnnnnnnntgcttcgaggcatcgacctggagat

SEQ ID NO: 80029 - DNA, 623 bp, Triticum aestivum
  unsure (1)..(623): unsure at all n locations
  Clone ID: PAT_TA_80029
gcacgaggtgtattcatcaatttgtccgtttcaaaaaaaagtattcatcagtttgtaagccaatcttctttctggtgcattttatctagcagaagtttctttttgggtatatttcttcttccatacctgtcaatgaagttattattgtgacataaacacattggtgatgtttttttcttgtaggcaaaaaagatcttttttaggcaagaacacttagatgatgttgttcagtacaattttcagcttttgaaaacaagcacggtggacttcctcgacagttattacaagtccatcaagctagctggtcggttttcggtggatgaaattctgaaaggaaaaatgccatcttcggcgattccaacagctcttcccaggaaagaaaatatactactatcttggccggcgccgggtccgggttatgttgccctaactgtcgatggatctttccaggcagcagatagctcggcggccgccggaatggtgttgcgcgaccatcaaggacagatcatctttgcagcataccgagtcctgttccactgtaacgacgctctggnnnctgaacttcacgcgctcatgcnnnntatggccttggccatccaacactcggatcttccagtcgtcgt

SEQ ID NO: 80030 - DNA, 619 bp, Triticum aestivum
  unsure (1)..(619): unsure at all n locations
  Clone ID: PAT_TA_80030
tgcatttcccctcccctcccttacctcccctccatttactcgcctctccgtccggttttatcatccgcatcaacacacgctccagaaaccccgacgcccgcagccgcagcatctccctcccctctctggtttcgtcgccatccaaccgaacccccccagcccgcagccgcagcactaggcaatcttttgctatggggaaagctaagggtcgaaagggtggtggcgctgtgggaggacggacaatgaagaagaacgctttcaccgagtcgctccgaaagaccaagttgtttgaagatgggaggcttccgaaccagtgcccttgcccaaaggtcaccagtgcccaccaggcgacatccaggaggcaccagctcatgctgcaccggctcaaggcccgtcagttccaccgcaggcgaatgtggcccctgcccatgggtgattttaccttagtgatacaccaatattagttatttgcaagctgcctggaccctgcatttgggtgatttatcttaaatgatactacactagtactattagttatttgcaagctccagcaagacncatcagctatcatgatgtagtatactagtatgtcagcgttgatatctaccccctgttagac

SEQ ID NO: 80031 - DNA, 628 bp, Triticum aestivum
  unsure (1)..(628): unsure at all n locations
  Clone ID: PAT_TA_80031
gcacgaggctttcctcgatcgcgtacgtatctcgatcgaccaaccgacctaccatggagacgggcatcggatccgtggacgggcccaagggggcgccgagcggcgccgtagcttgcccggcgacgttcccggcgtcgtcgcccaccttcgtcggctccccggaggccacgctggggcgccaccttgcgcagcgcctggtgcaggtcggcgtgggcgacgtgttcgccgtgccgggcgacttcaacctgaccctcctcgactacctcgtcgccgagcccgggctgcgcctcgtcggctgctgcaacgagctcaacgccggctacgccgccgacgggtacgcgcgcgctaagggcgtcggcgcgtgtgccgtcaccttcaccgtcggtgggctcagcgtgctcaacgccatcgccggcgcgtacagcgagaacctccccctgatctgcatcgtcggcgggcccaactcgaacgactacggcaccaaccgggttcttcatcacaccatcggcctccctgatttctctcnnnagctgcggtgcttcacgccggtgacgtgctaccaggccgtcgtcaacaacctcgacgacgcccacgnnnagntngacaaggccatcnnnannnntctcnn

SEQ ID NO: 80032 - DNA, 625 bp, Triticum aestivum
  unsure (1)..(625): unsure at all n locations
  Clone ID: PAT_TA_80032
gcacgaggagccagagctacgtctcggcgccgccggccttctccgccgacggccgcttcctcctcgtctgctccggcccccatttccccgcccgccccggaaccctagccnnngctacgtctcggcgccgccggccttctccgccgacggccgcttcctcctcgtctgctccggccgctccgtctccgtcttcagcacctccaccggcatgctggtgtcggagctggaggggcacgagggggacgtcaccgccgtcgtgattgtgccgccgcaaagcaacgccgcggcggccgccaagctcgcgacccactgctggacggcggggctcgacggtttcctcatctactgggacttcgccaccgccgagctggtgcggaaggtcaaagtcgacgccccagtccactccatggtgattcccaacataagcaaaaaattgaaagtgaccgaggtgtattttcctttcgcattcgtctctgtggaagctttgagcaacaaggctattcaagataaggcaaagggcaagccagtaactaaaannnaggaattgttggggcagctgaggatttatgacttgtggaaagggtnnnnnnnnnggttctgaactggctcnnncacggaagccaaa

SEQ ID NO: 80033 - DNA, 624 bp, Triticum aestivum
  Clone ID: PAT_TA_80033
ccgttccccatttctctccgacagttggtgctcgaggcgcaggcgatctctggagagggagacgcatcgttagtggcggcgattgtctgggagcgagcaggggaggggaggagaggagcattcaagtatgtggtcgtttttcccctggtttatgtgtataggttaaagtagtgtgcaccagcggtatttaaattagtgtgttagtcactgaatggttctatgagtaagcaaatttattctactttgtcatgtttttgagggagagatatatgatccatccctgttttttttaatgttggggttgatgctatgtacatatatgtacccatttgttttgtttgaatcatgcctgcattaatactgaagaagttttttcagcagacaataactgaattatcagtagtgtcaaatcactcaagcagtaactgaaattaactgggtttttgtgtacaatctatgcaaatggagtcattattttaatgttaccaaatggcatgaaacttgctgttacatatttcagagtactcatctctgcaggtgttgtgttttttctgtagcttgcttgccggaatatgcttatcattgtttgatgaaactactttttgctctgacgacatatccccc

SEQ ID NO: 80034 - DNA, 617 bp, Triticum aestivum
  unsure (1)..(617): unsure at all n locations
  Clone ID: PAT_TA_80034
gcacgaggcacaccgccgcctccgaggggtcctacctgtccgcgctcaagggcagccacagcgccgcctggaagcagcagcaggaaaccctaaccctcgcccacaagcggaatcggcggcggtggtggcggctatgtggatgcgggcggggaggtggaggagaaggcgtgcccctgcggcgctgggatctgccttgtgctcacctccagcacgcccagaaaccccggccgcaagttctacaggtgtcccacgcgggacaatggaggttgcaacttctttgagtggtgtgatgctccatctccaggcgctgctaatgctcgcagcagcacaagctttcagtcagatgcatcaattgtgaatatgccttgttcttgtggtgctggaacatgcttaattctcacgacaaaggcgggagttaatgttgggaggcagttttatcggtgcccagctcagggaggtagctcttgtggctttttcaaatggtgtgacgatcagcagcagcctaggacagctgctccactgcaaggtggttcatcaccatatcaagctggcgctacccccaccaaccaaagcatgagcaagagctcttcgggctgcttcaaatgcgggcangnnnn

SEQ ID NO: 80035 - DNA, 628 bp, Triticum aestivum
  unsure (1)..(628): unsure at all n locations
  Clone ID: PAT_TA_80035
gcacgaggcacgaaccccatgcccaccgcgaagatgagcccgccgccccgcggcaggaagagggataccgccgagaagatggtcatggacatgatggagtatccgagcaggctggcgcaacggtagaggctgaggtcgccacggcctcctcgtcccggcgagaggagcatggaggagatgaagtagaggaagactgacgcggcggtggcccagccgaggacgatcccgaagtggagcttcccggccaggagctggaagaacgccaaggagagtaggatcagcgcggggccggagagatcggcttccgcgtggagggacgggtccacggagcggagcgggtggaggatggagaccgccttccgccagatgaggcccgtgtcgatgtcgagctcctccagaagcggcggctcatcgtcgaagttgacggcgacgttcccgttcccggggataggatggtgggtcggcgtggcctggttgagtaccaccccttggaagaaggggaggtatctgttcaccatggctgctgcggtggcggcgaggttgcttccgcctcggcgaggangnnnnncggtcnngntgtccagctcatcgagaagcggcggctcgtcgnnnnngtgcagcagcgggt

SEQ ID NO: 80036 - DNA, 510 bp, Triticum aestivum
  Clone ID: PAT_TA_80036
cacgggtgggaggaggtgttcgacaaggccgccggccaggaggcggccgcggagcgccggagggtcgcggggatgggactcgaagagtgcgtggcggagatggaggcgctcagggcgcggaccgaccgctgggacgccccgagctccgacgagatctgccgcctcggcctcgcgccggcgagccgctccgactcgtcctcctcttctgctgcttcctcctcagacagagacagtaaacaacagctaatcgaacagccttagacttcttcttctacttggtgaacatttgtacaaaatctacagggattcattagcgaccggcaacgaatgcacaagagatagaatcagttcagctcgagagtcctgtttgtacgtaatttgtagcggcaggaatttcgcgggcattttgcatgtgaatagtttcatttgacgcaaaaacagtataattcaattgaagctaactcgatgtgccatggaagcacacaccaaaagttcgtgaaaaaaaaaaaa

SEQ ID NO: 80037 - DNA, 369 bp, Triticum aestivum
  unsure (1)..(369): unsure at all n locations
  Clone ID: PAT_TA_80037
cgctgtgcatgcccaacctgggccaccggctccagtggtacctctgccgcgtcgcgccggaccggttcctcgacgcgctccgcctgcgcgagaacctgcggcagagggccgtcttccagcggttcaggtcgccgagggcgccgtcgcacgccaacggcggcaagcagagctaggcttggccctgagcgcgtgcatacggcgtggccgaaagaaccagctatgatatgatatagtactatgtattatctgtactgtatctctgaaccgcggtttggtttaaatctctgccgtcgatgcatatgcgtccacgggtgctacctgtatatcttcgtcaaagacaagctcaaaataaaatgcattgtgcagtnn

SEQ ID NO: 80038 - DNA, 608 bp, Triticum aestivum
  unsure (1)..(608): unsure at all n locations
  Clone ID: PAT_TA_80038
gcacgaggctggctcgccgccaacaagctcgtcctcctcgcgttcgacctcggcccgctcaaaccatccctgcccctcctcccgtttctcctctgcgccggcttgcccatcaagctccgcgaaggtccgcagcctaccagccattctgcgtcaccgggaccgcccgtcgccgatttccttctcccctgcggccgcagcgttctcttcctcaccggcctcgccctgctcttcccacacactggttcgctccctctctacgtcgtccactacctctactgcgcacaaatctttctcacgctcgatctcgtcttctcttctgtcggcctcgtcgccgctgccgtgctgggctcggccatggagaggcagttcagagcgccgctcgtggtcgcgtcggttaacgacttctggggccggcagtggaacctgatggcggtggacctcctccgcgcgtcggcgtacaagccggtgcgagcccggtggggccgggacgccggcgtgctggccgcgttcctcatgtcgggcgtcctccacgagctgctctactggtacatgacgctggagccgcccacgggcgagatgctgctcttcttcacgctccnnnccgcttt

SEQ ID NO: 80039 - DNA, 569 bp, Triticum aestivum
  unsure (1)..(569): unsure at all n locations
  Clone ID: PAT_TA_80039
ggccgggggaaggagcatttagacaggagaaataattatacagttcaatggtctacacctatgcagattatctacaattaacaatccacagtcgactaccttcagatactcttcctggaatcttgctaaaaaaaagaaaactacaatctcttaaaaccttcacaataaaatgcataactgagatgtttacagaaagagacctatcaccaatcaatcaacattccccaaatcctacaaaaagaaggcagcagagagcatatgccaaattcatccaaatttcaaacatcccgcggccctcactgacgatcaacttgttggtttgcgccctgaaaactgtttctcactgcaacggcacgctcatatacaatcagcggagttcatcggggagctgcctctgctcaggnnnnnnnggatgtgcagcgttggtcactgaataaaagtccagatccctagtttgatcggagctctcagtaattgttctggtcataaccgggatctcagtgtctgaatcacttctgcgatatcttgcaccattgcttgcagtgcccaactctaagtcactcnnttcn

SEQ ID NO: 80040 - DNA, 505 bp, Triticum aestivum
  unsure (1)..(505): unsure at all n locations
  Clone ID: PAT_TA_80040
gcacgagggcccaactcggcgggtgttctcgggccacgcccgggggcccagcaccaggcctaccccgtcgccgccgggcctccccctgccgcgccctgggatccgcaggctatgacgcacgccttcgccaacctccagatgcagccgccgccgaccagcaacgagtggtacatggatacgggtgcaacttcccacgtcgccagctcctccggacatggcaacggggaaactcatcatgaggtccagtagctccggagatctttaccctttcttgcacaataatggcggctccatggcactctccgtttcgagctccggcgaactatggcacttgcggctgggccatcctagccatgtttccctttctactttaatgaacaaccttttagattcatgtaataaatcgcaaggttcttcggtgtgtgaatcttgtaaaataggcaaacaacctcgactaccgtttccccattccacttcgtttactacagaaccttttcaactnnnn

SEQ ID NO: 80041 - DNA, 440 bp, Triticum aestivum
  unsure (1)..(440): unsure at all n locations
  Clone ID: PAT_TA_80041
gcatgatgtgcacaattacagaaggccatacagtcggcggcaaagtgctcgctgtcgccaatgattgactgttgaggatctccattcggggctacctgctcaaataatatggtcaatagctgatcctgtgatccattctacggatgaagaaggagaagacgagggaacacaataatttctgtgtaatattatttgtttatgatgtggctactctggaatacaatttatgggcgagagagcagactttcaaatttggtgcggtactatatcttatcagattcagtaaccagcatggaattaattttaattttgttcttcatcagataagtagagccacgctttaccccaatcttcatttgatgaatctcaactacaaaaattgtgatagttgcactgtattttgttgggtccaacataaagctgagaacagagtacctnnn

SEQ ID NO: 80042 - DNA, 622 bp, Triticum aestivum
  unsure (1)..(622): unsure at all n locations
  Clone ID: PAT_TA_80042
ctcgcgacctcctgtttccgcccaccttctccggctccggcgccggcgaaccaatcgcggatcgagcgattcctccgatcaggagaggcgagccgggaggaagagcacctacgcgggaggagacgagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggtacatccagagcacttgtgctacaacaggggannnn

SEQ ID NO: 80043 - DNA, 629 bp, Triticum aestivum
  unsure (1)..(629): unsure at all n locations
  Clone ID: PAT_TA_80043
ctgtgtctcgcaggttgccatggatgcccgaatgcctccaggaccccgtccgccccgccgcgttgcgatccggccaccaggaccctccaacgccgctacctccgccgtggacgccaggtgccaaggtccccgtgcccgtcctcatggcgccccacatcctcttcgtcgcttcggagctcctcgccttcgcctgcgttggcgccatgtccgccaccccgatgcctccgcttcgatcccactagaaacgggacccgaggacctttcgcgcttggatcctccccgagctcccgcgccaacccctccccatcctgccgctcgccggagtcctcagtgccgccgttgctcttcttcctgtcgagaagaggaggacgacgcctctgcctcaagtcgttcgagcgaccgcgttgacccttcctcgatctaaccaatgcaggccggcccagcgcgcctcctcccgtgccagatcgcagcccaaccggtccacctcaccatcgaatgggccttggcccatggtgggcagcccccaagcgccccctcctttttttcttactgttgggccagttcagttccagcccgtggtcatttttttcccttggacgttttgctaaatatcctaaacatgcatatnn

SEQ ID NO: 80044 - DNA, 171 bp, Triticum aestivum
  unsure (1)..(171): unsure at all n locations
  Clone ID: PAT_TA_80044
gcacgaggggcgatggagggctacgaccgcgagttctggcagttcggcgaccagctgcggctccagacggccagcttctccggcctctccctcggcgactccatctggtcccccgccgacgccgcnnnncccgcgcccgcaacgccnnncctcttctccccnnnccccggc

SEQ ID NO: 80045 - DNA, 639 bp, Triticum aestivum
  unsure (1)..(639): unsure at all n locations
  Clone ID: PAT_TA_80045
ttctcatagtgcaagcgtggacgccggccatgtcggagccatggcgcctcgttggaccgatcacggccacggcggcggcgaggtggaaggagctccacggcgagcggtcgtgggacgggctgctgcggccgctggacctggacctccggcgcacgctgatctggtacggcgagatggcgcaggccacgtacgacgcgttcaactacgagaagcactcgccgcacgccggcctctcacgcttcggcaggaagcgcttcttcgagcgcgtgatgctgccgggccacgccgccgcgtaccggatcaccaggttcctgtacgccacgtcctccgcccccgccgcgccggccgccgcgttcgtcaggagccgccacccgcggcgccggtgcaaggagtccaactggatcgggtacgccgcggtggccacggacgcggggatagccgcgctagggcgccgggacgtggtcgtcgcgtggcgcggcaccatccaggcgctggagtggatcaacgacctcgagttcgccatggtgcatcccaagggcatcctcggcgacgccaccggcgccgacgccatggtgcaccgtgggctggttctccatctacaccnnnaccgacccggcctnnacccacaacaacgacagc

SEQ ID NO: 80046 - DNA, 216 bp, Triticum aestivum
  unsure (1)..(216): unsure at all n locations
  Clone ID: PAT_TA_80046
gcacgaggcctcgtgccgaattcgacacgaggcgagttttttttttttttttttggcggaaacagtggagtataataatgcggctaatctgacatcnantcagagggactggattactggttgtgttattattggtaaataaacaaagcagcagggagtggccggcccacccccatgcatgcatgtcctctccaactgtccgtcaaaaaaaaaaaa

SEQ ID NO: 80047 - DNA, 608 bp, Triticum aestivum
  Clone ID: PAT_TA_80047
tgcccaccgccgacgcctacgcgcgcgcggcggtgcgctgggtcgggcgcggcggcccgctctgcgtgcccagcctccggcaccggctgctgtggtgccttcttgacgtcgtgcccggctgcgtgcaggactgggcctgcctgcgcgagggcctgcggcagaggaagacgtcccggagccggcgatcgtcgacggcgtcggcgtgccatgccagcaactgagtaggaaactgtctcacgagtgagtgaagtggcgtgattcctggacccactctcgttttatttttttggaatcactaaaaatctgacaccagccacttggacggataacttgggtctgaattctgcttctctgatgccgatggggcgggctgccgctatttcattggacaaagtttcggaccttattgacagctaaacaagaaaccggaatgcggatgttattcatgcaaatttcttgcaacccattcacagctgaattattagctctttgtgaaggcaccatcttcgctcaactttgtggttattcacaggtcataatggagattgacaacttgaagttagtcaatctatgaaaatcgcgcaacgatacacggttgattgcaacac

SEQ ID NO: 80048 - DNA, 576 bp, Triticum aestivum
  unsure (1)..(576): unsure at all n locations
  Clone ID: PAT_TA_80048
gcttgttaggtgtctgcatttgacaaggatcagaggtataaggagggcaagttcatcctggagaggtcagatcctcatgcctctccctttgttctcatattgcttcgctctcctttgcttctggatcgaattgctagctactctgctttgcttcaggatcgaatcgctagctactctgctttgcttcaggatcggatcgctagctactcttgcagtcttagtttttacatcatattaacctcttcttaatctgacatcattttcaatcatttgtgtgctaataaattgaacatgcaactgctgcgctcatagttctatgctaccctactaccctgttaactatgtctacaaactaaactagctagttcacaacactgatgatgcatcgcaaggaaaaacacaactacaacgcaagtcagcaatatgcaccgaaatccgttcctcatcctgttcatttatttgggcgaggcgcaggtgcaagatccattcggncnnnagcggccctcccgnccgcatccagctgtgggctgnncatgacgctcgcataagttccagcgaggatgannncnnnnnnnn

SEQ ID NO: 80049 - DNA, 376 bp, Triticum aestivum
  unsure (1)..(376): unsure at all n locations
  Clone ID: PAT_TA_80049
ccacggtgagcgggattggatcagtcagtaccggcactagngagaggtatagagggattggcactttgatttgattagcgcgcgacgaagcaagcaagctaagtgagagcgatggtggtgctcatggagtacgcccccggcgtcggcgtgaccatgaagaggaagggcgaggaggagccgggactgtttgcgttccccgacgacggcgactgctgcagcgttccgatttcctgccgcgcgaccangatgaggcggctggagattgccggcaccggccatgatttgccgccggcggcgaccgttgggacggagggcgacgttatgatggcggannnnncgccggcggngtcnntannggnctcagannaggaaannn

SEQ ID NO: 80050 - DNA, 619 bp, Triticum aestivum
  unsure (1)..(619): unsure at all n locations
  Clone ID: PAT_TA_80050
gcacgagggtcgacaccaacaccacccctctcgagctggtggccactagtggcgcaccaaggcatgctcaggaagaaggcgagggtggctcccatgccccagtcgggaaccggggggtgctcacccagaggcctctttccctcctggttttggcccggctccccaatacatccagatacaagaaactgctgtcctccccacccaggttgaggtgggagatgccaaagttcagacagaggcaaactcggtgctagggaaacgctcagctgcagaaactgctcgggctatagaggaaaatgatgtaaacagtaagatagagaaagagaaaaacaagaaactaaggggagaggagaatgtaacagaaaatgagaaaggaggcaagaaggaggaatcagaagcaaccggccccggggctgccggtgaactgacgggtgccaaggcgtgcgcccgtcaggagggatgagcatcctcagctggaactgccggggactagggcagccccggacagttcaggagttagtgtgcctggtgcacacgtacaagcccannntagtgttcatctcggagncacggcagcgaaatgaagtagtgaataaattgnnntgnnnnnntggcctcc

SEQ ID NO: 80051 - DNA, 461 bp, Triticum aestivum
  unsure (1)..(461): unsure at all n locations
  Clone ID: PAT_TA_80051
gcacgaggctctctctctccttgttcctctacccgtctccggtattaaagccccatcgccgttcgcccaactcctccgtgctcccctcccttgggcgcacggatcgatcgccgaggccgaatcaaatacaccgccaccaagaggccagcccaaccaacgccaaccaccatcatccccgcccccgcctgcgcgctggatccctttgcctagcagcgcggctccgggaggaccggtccattccatccaagtgcgcatggtggcgagcattgccggggcggcggcggcggcggcgtcgtccgcgcacgcgccggccgggcggcgggccaagagggagccagtccacatgcacgccggcatccggcggtcgcgctccgagccgcacctnngctgctcccgccgcggcggggccgcnngcgcgnnnntcaccaccaaccgctccatcggcgtcttcccctnnnnng

SEQ ID NO: 80052 - DNA, 459 bp, Triticum aestivum
  unsure (1)..(459): unsure at all n locations
  Clone ID: PAT_TA_80052
gataattggccttcacgcttcaggtataagctcaactcaatcatctccaatagtccaattagtcttctttcttgctaaaggtcttaaaagagtgcacagaatgaaatagttcttctgatacatagttcacaattttcagaactcaaacacacgtggcttccagttgcgattccaattagtattttctcatgttgcttcatcatccccttctgtttgcgggtctccttctccgtacagagttcttactgttagaaagtacaaggatcagcttttcttcccttctggcgaacggaaaagagagatacaaaggagtaataacgaaaggttgattgttcgtatatatgttcagtgatggcgagccttcaaccaacaaaaattaccttagatttggaacatttattcccaccggtggtatatactgctattgtgaacatacctattttgtgaaattttcnnnnn

SEQ ID NO: 80053 - DNA, 619 bp, Triticum aestivum
  unsure (1)..(619): unsure at all n locations
  Clone ID: PAT_TA_80053
gcacgaggctcgatccccaattctggcgccaatctcccgctccaacggagccaccgagctaccaccggcaagcttcttcggccaccgcggccatccgccagcttccccggccgccgcggccacccgacagcttctccggccgcggccatccgccaccaccgacagcacagccgtcaggacgccgttgtggcccatctccagcctactccctgcccacggcttcttcccacgccatcgcctccaacagccgacgcggccgccgtgacgcccgcatccccaccctcgcacgctacatcatccacatccgcctgaaatcgctgtcagaccccacacgtcgcccctgcccatgtactgcatcgatacaccaatggtggcctcggatctgagcgctagccgctggatccgcggatgttcacgcgtgggaggtgttgctgctccggcgagctccttcgtgcacggatccgtgcacccctgagcattgccatccggctaccatcaccgtcaagccattgcgcctccaccatgcctcgctacggcggcgctaggatcccaccgtcgtgccaccggatcctccgccttcaagcccctgtacctccagtgagcgatgtgcacgtacnnn

SEQ ID NO: 80054 - DNA, 622 bp, Triticum aestivum
  unsure (1)..(622): unsure at all n locations
  Clone ID: PAT_TA_80054
caaccatcaaaaaatccccaccatacacacccgcgaggctgctcaatcatcgcaccactcgatcggcaggcacggcagcaatggcggcggcgaccggaggcggcggcggtagcagggaggaggggctgacgctgctggggttctggacgagcccgttcgcgctgcgtgcgcggttcgcgctgaacctcaagggcgtcccctacgagtacgtggaggaggacctgttcggcgagcggggcaagagcccgctcctcctcgcctccaacccggcccacggcgggaaggtgcccgtgctcatccacggcggccgccccgtcgccgagtcgctggtcatcctggagtacatcgacgaggcgttcccggagcgcctcccgcgcctcctgcccccgcccgacgacccgcgcggccgcgccgccgcccgcttctgggcggcctgcgtcgaccagaagctgctccccacgtggacgccgctctacgccgggagcacggccgaggagcgggcgggcgcggcgagggnnntcgtcgccgtgctgnnnncgttcgagggggagctcggggacagggacttcttcggcggggacggcgtggggctggtggacgtggcgctcggcgggttcctcnn

SEQ ID NO: 80055 - DNA, 431 bp, Triticum aestivum
  unsure (1)..(431): unsure at all n locations
  Clone ID: PAT_TA_80055
cccccggaaccccgggaatggcctttttttttccactttttcccccccaaaaaatttgtccccggaaccccgggaattttccccggggggggggggggtttttttccgtttttaagggggggggttccccggaaaattttccctcccccggaaaacccccccgggattggggggttcccccggaaaaaaaaagggggtttttggggggggggtttttttttttggaccccccttgggggttacatggggttttttgggcccctactttttttccccnnnnttgggttaattttggggnnnccccactttncctttttaattttggggggggccgtggggtccccttttttttccccacccccccccccttttttggggaaaaaaannttccnncccngganaannnttnnnttttttttttcccctttaaa

SEQ ID NO: 80056 - DNA, 624 bp, Triticum aestivum
  unsure (1)..(624): unsure at all n locations
  Clone ID: PAT_TA_80056
gcacgaggcctcgtgccgaatgttaagaaggtagacagtgccgctatttccttgcaggaagaagatgatttccttgaggttgtatcaagtatgtcacgacttaggcatccaaacatcgtgccgcttacagggtactgtgtggagcatgcccaaaggcttcttgtttatgagtacattggaaacgcaacgctgcatgatatgctgcacttctctgatgagatgagcagaagacttacatggaacatccgtgtaagaatagcactaggcactgctcgggcattagaatacctgcatgaggtttgcttgccctctgttgttcatagaaattttaagtccgcaaacattctacttgatgaagagcataatgcacatttatctgactgtgggctcgctgccttgacacccaatactgagagacaggtttctactgaagtggttggctcatttggatacagtgccccagagttttccatgtcaggaatttatactgtaaagagtgacgtgtacagttttggagtagtgatgctagagctattgactggaaggaagccgctagacagttctagagngnggtcagaacagtctcttgnnagatgggctacgcctcagcttcatgatatcgnn

SEQ ID NO: 80057 - DNA, 628 bp, Triticum aestivum
  unsure (1)..(628): unsure at all n locations
  Clone ID: PAT_TA_80057
ttccgatcggatcggggaaaagcttccacgagctctcgacgactggtgggtgtgagcgccgccgacgtcttcttccaggagaagttcgaagatggttgggaaagccggtgggtcaagtctgagtggaagaaggacgagaacatggctggtgaatggaaccacacatctggaaaatggcacggagatgctgaggacaaaggtatccaaacctcagaggactacaggttctacgccatttcggcggagtaccctgagttcagcaacaaggacaagacactcgtgctgcagttcacggtgaagcatgagcagaagcttgactgcggtggtggttacgtcaagttgcttggaggtgatgttgaccagaagaaattcggtggtgacacgccctacagcattatgtttggaccagatatctgtgggtacagcaccaagaaggttcacactatccttaccaaggatggcaagaaccatttgatcaagaaggacgtgccttgcgagactgatcagctgtcgcacgtgtacactttgatcatccgccctgatgctacatacagcattctcattgacaacgaagagaagnnnactggaagcatctacgagcactgggatattcttcctcccaggaaat

SEQ ID NO: 80058 - DNA, 629 bp, Triticum aestivum
  unsure (1)..(629): unsure at all n locations
  Clone ID: PAT_TA_80058
tttttatgattttcctttactcatagtaagtactgaatattttgtgcttcaaccctttaggtgttaatttctgtgatgcagctagcaaagttggcaataggtacagtataaccatcatgatctgcacagggatatcacctaggtgcataaatcataatcattcagtttttatttggcaagctggagctacccagaactttcgattttcgtgccaagatggatggattgaaccgggtgacccactgtcaggtattattgttcagttatcctgagggtaatgtggatatgttctgtttgagatcaaagcttggtattgctagaaaatatatatatatgtgcactgagatttcaaatatataacagcactgatacaacgtaatgtttcccttgctatcatacattttttcattactatcataacctttttagatcaagcatgtcatgcattacatttcattatgtatgttgcaacttcaagnccacaatgcctctgtatgtaacatctgtatgctgattattttttggaattgaattatgtattcaaagctattgttcagcatatacatcgtttgaaaatcatacnnnnngcaaaatttatatgtacccttctnnnnnaatatatggctann

SEQ ID NO: 80059 - DNA, 635 bp, Triticum aestivum
  unsure (1)..(635): unsure at all n locations
  Clone ID: PAT_TA_80059
ccgattcacagccgcagttgacgccatgagaggggaagccgagctacatagcccccgctagctcctccgctgcacctcccggcgcaagaatccgctctccgtccaacaaagatgcggccttcacggggggatctcgccgtcctctgccgctgcttcctgctcctgctgctccctttcctgtcccatggcaaggacatgcccctgggctccaccctctcgccgggcggcaactcggccgcgtggtcctcgcccaactccaccttctccctcgccttcgcgccgtccccgaccgcgccctcgctctccgtcgccgccgtcacctacgccggcggcatctccgtctggtccgcgggcgccggcgcgcccgtagactcggggggctcgctccgcctctcctccaccggcgacctgcagctggtcaacggctccggcgccgtgctctggtcgtccggcaccgccggccagggcgtctccgcggccgccctccaggagagcggcaacctcgtgctcaagaactccacggggggcgccctgtggcagtccttcgaccaccccacggacaccgtggtcatgtcccagaacttcgccnnnggcatgaacctcanntcgggcccctacgtcttcgccgtcgaccg

SEQ ID NO: 80060 - DNA, 558 bp, Triticum aestivum
  Clone ID: PAT_TA_80060
gcacgaggcactccaccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttccccatcagcatgtccaccaactgcaacaatgtcaactagttcaatatataatccttcctacgtgcatgcatggacgcgcttgcgtggagcttaatttctacgttgatggagtgctcatacgatgttgagctact

SEQ ID NO: 80061 - DNA, 411 bp, Triticum aestivum
  unsure (1)..(411): unsure at all n locations
  Clone ID: PAT_TA_80061
tctctctctctctctctctctctctctctctctctcactctctatctctctttttttttnnntttttgtactcaacaagtgtgcattaatatcattgcttaagaggcaaannataataacacaaacatctgtcaaactcgcaaaaaaaaaannnataaaatcaacctctcaacttatcagcgtattacaaccatagaggcaaataaaaaaagttactaaaggcaaaaacactaaacttttataccattaacgcatgctctcaagccttccacaatatcccctgggtcccaccangaantaaanncagagacagacacagacctacaaacannggcggatccttataccctctgccccaatcagannccntcgctggnncaagcctgcgcgcggcccaccaacggaacagcg

SEQ ID NO: 80062 - DNA, 633 bp, Triticum aestivum
  unsure (1)..(633): unsure at all n locations
  Clone ID: PAT_TA_80062
gcacgagggagaaaggagaaaaagagaagtgcatcgtctcattaaacccccaataaaccggagatggagggggagctcacgaagaagatggagaggaaactcaggaagaagcagaagaagctattgaagaagatggggaaagagaagccccaatccctggtaaaggaaatcatctccgtggagagggagcgtagagacttgcatgcctcacttactcccacgttctctgtctggaaagaaatcgattctcaaacaacgtggacaatcgccacaaaggaccctgctactgctactaccagggacgatgagaatcaacttgcggagtacttcaacttgatgctccaagatatggaggacctgggccatcggatgctttctatgctgtattttctcaacaaatccaatgaccccatctgctcctacaaggccaccgagctgtgcaatacagcagccaaattaaatatgcagatatccaagggattcagcatgtaccatgagccggagcaggagccggagccggggcagatcaacttgtcgactcttttcagcaaatattatcgatttcccaataattacgagaacaccttggccaagttagacatnnnnnnnnnnnagnnnnngtgtgnnnnntgt

SEQ ID NO: 80063 - DNA, 625 bp, Triticum aestivum
  unsure (1)..(625): unsure at all n locations
  Clone ID: PAT_TA_80063
gcacgagggagctacggccgcggccggaccacggatacccggggcggacatacaagttttacgacgggccgtatgtgctttatcggttcgcccacggcctgagctacaccaagttccgatacgagagcagcgctggcaacggcaccgcagtcaccctcgccgccggcgggcactgcaagcagctcagctacaaggccggcgccgtggacactgccccgtcctgcccggccatcgacgtcgcgagccacgcctgcaaagagaccgtggacttcaacgtcagcgtcgtcaattgcggtgacgtggacggcagccacacggtgctggtgtacactgtgccgccgccagaggtggccggcgcgcccatcaagcaggtggtggcgttccagnnngtgtttgtgaaggcgggccgcgcagcgaccgttgggttctcgctcaaggtgtgcgaggcgtttggcatcgtggagaagacngcgtacaccgtcgtgccgtcaggcgtcagcaccgtcctccttgagaacggtgacacgtcgtcgccgtcgtcggtgtctttccccgtcaagatcagcttctctacttnnnnnagttttcctcggttcttttgcgnnntttnnnnncnntttttnnn

SEQ ID NO: 80064 - DNA, 557 bp, Triticum aestivum
  unsure (1)..(557): unsure at all n locations
  Clone ID: PAT_TA_80064
gnnncatcaaaagtctggtatttaccaccatgccagcatctcaaaatagatgaccatgaacaacaacacgtctcaacggtgccacataacaacacctacagatggtaacaatttcaccaatgattctgtggcaacatgtaatctttagattcacataaactagcagaagaagctgtcctggaggaatcaatagagccatcactcatcagtaagtcctggaggagtcgaaactagcaaaacgactcatcatactgcagttactttaagccttgttacggcagccacggtcctcgaactgctaactgtcactggcatctctggtcttgcatgctttaccatcttaacatcacccctggttaacgggtcttggaggtcgtggcagtaaagagtatagtaccagaaaaacaccatgattccttgaaatgacagtcgcatccactgannnagttggattttggacacttcttttantctttcggcaagnnnnnnaatctgtctgcaatccaacnnnnnncctttctcactcaaatcactnnncatttgnnnnntntctnnnn

SEQ ID NO: 80065 - DNA, 620 bp, Triticum aestivum
  unsure (1)..(620): unsure at all n locations
  Clone ID: PAT_TA_80065
gcacactgttgtttataaactacagaggctcactgtcctatacacaattgtttcaggtttttgaacctcgcccaatctaatagaatccttttgaattatgttttggccagaatcactatataggagaatgatttatcttcgtctctttcttacacattccttctgcttgagaattgaggaggtcaaagactgacataaatgaaatggtgatacacttatcacaggtgacacggtacttctttacaaacagggtacaatctgcaagaaaactcttagaaattcttaaacttattattccgtgaaatcgtaatacctgacaaagaggttgctgcccagtctctgttttgtttgcagtagttaagctaccactattttttgttttcataaactccaaattttcaacattgttagccagatcctcaaactatcttgacgaagctttagtctctattttgtaagctcatggagattttcgttgggtacaatttgcatgacaatatcttatatatgttgtggactattattacatgttgataatgctacttcagaaaacatgtgaacgccatcctnnnacagagaaagnnncactattggctagggattacatgctggctaccacn

SEQ ID NO: 80066 - DNA, 655 bp, Triticum aestivum
  unsure (1)..(655): unsure at all n locations
  Clone ID: PAT_TA_80066
ctggctttcacggcggcactctctccacttcctctggccaagggtctcgaagcctctcctcgcgccatggcaccacgcgcacagaagcagctgttccccgccgatgcagtgagcagtgaccacgatctccattccacggcgtcgtcgattagcaatgcaaagcgctctgtcgttgttaggccaagggctctgcttagtgttgtccttgctgaagttggcttgcccgaggtgaaatacaagacctacgcagcacgcggtggctgttttgctgctacagcatatttctggccatcaccgtcgggttcatctgcggcagggccgcatatgaggctgaatggtgaaccagttgtggatgctcaggaggccatacagaatgctgctaccctgtgcttggagaaccttcaagacagtatggatattgagtttgactgtccccgggtgaaaaaaatgaagactgataagaggtacctgttgaacagcattgctgggaaggacagggaaatcaaagatctagagactaaactggagaaaaggaaaatgcaggtcaatgggcttggcaaannntgnnnnncatttgcacaggatgtgcgtcgttctgcggggcgtattgacagnnngccgtgaactacctgcctacagcgtccgntctatggan

SEQ ID NO: 80067 - DNA, 649 bp, Triticum aestivum
  unsure (1)..(649): unsure at all n locations
  Clone ID: PAT_TA_80067
gcacgaggctgttcttttatcgtagttcttgactcgcgatatttaactctaaaatgttagaaattttgaacattaacatttgatatcatgattccagaataatgtgcgacttgggccaccatgttgcctttcttgcagtatatgacaactgtagttaggaagcaaatatccgttgaatttatgttcttgcatctctttgtgaggttttatatttaacggaactgaactggataattaattaatcattatttgtaattcagagaccacaagttgctctcctgttgacaacttgcaacattatcaatagggatactatttgtagcaaactgcatcctgtactgaggctcagttcctttagcggcttatggcataaggcgcccccttcctagcttatttagaaaccgttccccatattcattttgagttaaggattaatcagattagcagcttcaatgaatattgnnnnncggcttctaaaataagctggtgaggggccagctcatttcagaagctgccaaaagaactgggcattaatgtgccaaataagtaagtgaaaccgttgcgtgagctaagaaacatcttttnnnacttgcaaagtttcattcaacttataagcagaactnntcaaagtttatgtcggcctttctnn

SEQ ID NO: 80068 - DNA, 273 bp, Triticum aestivum
  unsure (1)..(273): unsure at all n locations
  Clone ID: PAT_TA_80068
nnnnagagagagagctagtctcgagtttttttttttttnnntttgttttttttttgttttttttttttttttttttttacaaaccaaccccaatgtataatttcttcacacaagttctgaaatttaaaactacaagggacnagttcctcctgtctggaaaatgaatcaagtttaactatgctaacaaacacaaaaagcgcttcctaaacctatatatcaatgaaaaatgcagttctgaattctcatgtcattgtttgttttaaaaaaaaaaaa

SEQ ID NO: 80069 - DNA, 601 bp, Triticum aestivum
  unsure (1)..(601): unsure at all n locations
  Clone ID: PAT_TA_80069
cgaccaccagcgcctcccactgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtcggccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcagcgagggcnnnnntcgactacctcggcaaccccagcctggtgcacgcgcagagcatcctcgccatctgggcctgccnnntngtgctcatgggcgncgtnnnnnnctaccgcgtcgcc

SEQ ID NO: 80070 - DNA, 624 bp, Triticum aestivum
  unsure (1)..(624): unsure at all n locations
  Clone ID: PAT_TA_80070
gcacgagggccaagacgtgccaccgccgaagatatcgacgtggtgtgacataccatcgaccctcacgatggtcgaccgccgccgcgtcttcgctgtggccgccgcgacgctctgcctcgtcttcgcgcacggcgtggccgcggcgcggccgctggaggagcaccgctttgccggagtggcaccggcggcggcggctgcggatatggtgatggacgtgtccgcggcgtcgccggatggatctgccacgtgggagcgcggggacgaggccctccgcgccgggaagtggctgcccctgccgctgccgaccgctctgaccggcggcctgcggttcccgggggtgttccagttccctgcggcgaccgtgggcccgtccatgccgtggatggccggcgcgccgcccgcgctcgccgggccggggatgccggcgctcgtgccgccgtacgtcggcgtgacccgacaggagcagctcagcgtgtgggcctcgctgttcaacccgttccgtgtcaagccgagggtgccggcccnnccgtcgtcggtgccggcggagcccnnngtccccgccgtcgctagcgcnnngctcgacaggacgacgacggtggaccagccggccgccggcgcgcnnnn

SEQ ID NO: 80071 - DNA, 217 bp, Triticum aestivum
  unsure (1)..(217): unsure at all n locations
  Clone ID: PAT_TA_80071
gcacgaggatgtgcccaatgagcaatcagttctttgaagaatctgctgagcattcagtatcaggatctcatgagaatggccaccatgannnnnctatgctgattgacctnnnaaatgagaacgatatctttggggaagcttcnnnaagtacagcaacttctgcaacatctgtacctactgcagatcttatgagtattgatcagcttctcgaancagt

SEQ ID NO: 80072 - DNA, 575 bp, Triticum aestivum
  unsure (1)..(575): unsure at all n locations
  Clone ID: PAT_TA_80072
cagagccgcactcgcaggggccaaccactgccagagcagagcgtcttcgtgccgtttgagcaacggcacagctcgggagatcgggcggcggaagagggaagcacccccggggttgagctggttgccgagatgaactcggacagcatctacgacatgtccggcatgacggcgcacctccccgccaagtaagtagcagtactactccaactaactcatccgtcgacgacgaacgacgggcagagcaaaggctaacgatgtggctgcgcannaaggggctgtcggcgtactaccagggcaagtcgcagtcgttcgcgtgcatggcggaggtgcggtgcctggaggacctgcagaagaaggagaagccgcgcgggcacaagatgaagccctgcaagagctacgccgcgctggggggcgtggccatggccaggaagccgccgggctcctcctgcgccaacctcggcctcatggacgccggcaacggcttcatggcgccccggaacatccccgtcaacgacgactgctaccatcagtnnnnncnnnntctnnnnctcgggtcatcnnnnntctnnnntgtt

SEQ ID NO: 80073 - DNA, 556 bp, Triticum aestivum
  unsure (1)..(556): unsure at all n locations
  Clone ID: PAT_TA_80073
cgtattgataggaaggataagccacctacacgtctagattgaaatcccaaacaaaagatggatgacgcagccgcaacaagcgacgaagactagatgtggcgtccaccaataagcagcaagccgatggcggttgtcgtgacgcagacgagcttgctgcgtcgacgagctgttcgacgacgacgagacgagatccttcgctgcgtccttggctggcctaactagccgtaagtgcaccacgggccgccgatggggtgcctaatatgcaggttctcccataggcattgatcttgataagctctctgatcctgtacgggagttgggctatcacggctggccgcgcgtcttcttcgaccaagatgtggatcannttttgaacggttgcgcctacaaaactcaagggattctgttggcagctctaatcatgcgacactgtgatctagaactggaaggatcaattcatgcatgaagatagatgcgtataaaaaaacaagatggtgtaatgacgcatgtactnnnataatttcgtatttgggtcttgtnnnttaaaaaaaaaaaa

SEQ ID NO: 80074 - DNA, 441 bp, Triticum aestivum
  unsure (1)..(441): unsure at all n locations
  Clone ID: PAT_TA_80074
gcacgaggctcttatcttcctccgttcacaaatataagatgttctatcttttttctgatttggatgtatatagacgcattttgatgtatctgttcactcatttcagtacatatgtacgtagttcacattgcaatatctaaaacatcttatatttatgaacagagggagtattagataatagatagatgcatctggtggtcaaaatatgttgctataagcatcacttttacaaattgaagtaaagaagattaattatatcttcgtgcaacttgcctaaggctggtaagggcatgcgtccgaagtcctaacatgccgtgaactctgtatgagggagtaggacgatataaattattgccgcaactaaaatcatacgtggtacaacaacaaatgcaaaaaatccccnnnnnnnnnnnnnnnnnnnnnnnnnnnnnnaaaaaacaa

SEQ ID NO: 80075 - DNA, 620 bp, Triticum aestivum
  unsure (1)..(620): unsure at all n locations
  Clone ID: PAT_TA_80075
ggcagaaggtccgccgcaatctcgggtagccagccgtgcatagctaaggcctcacgggtataagtcgaccgtacgctgctaaaggaggggcaaggcaaaaatgtgtgtccagaggggtagaaaacccccaggcatcttggatgggctatacggcatacagattgctcgtcgactaccgcaggcacagagcgaaggcgaagccgtccggaccagtttcaccgattcgccaacttgtgaacaccaaaatggcggtagaacggtcacacaacaacatcaaagactgctgatacgacgactgtggcagcaacggccctcatgcttgaagcccatccactgtggcattacatgtgacaagcatgctggtgaaacttttgcaaatgttgtcacctcactacccttcatcgtccttggactgcagacaccaaggaagaacttgaacgctgccatctacgccaactcactggttggagtaggaatagcttcaggcctgtatcattcttcccgnnntgnnntcagaaaaatcctgagatgggccgactatactatgattgccaccactacgctggtgagtcatannnttgcactgannnnntgttcaaattatcannatctgcactcgt

SEQ ID NO: 80076 - DNA, 492 bp, Triticum aestivum
  unsure (1)..(492): unsure at all n locations
  Clone ID: PAT_TA_80076
gggccaaaaattnccangttttttttaggggaaaccggggaaccttccccttttcctttacgaaaccttgaacccttacccgtggcccggggccccccctttttccgacgaaacccaagagaccgaccgacccttgctcattggagggaactcgcttctcactcacactttggtttgattcgacccgcccaccatgccttttaanggacctggacctggatgggcttgggctttttgggctccgggggggggagctttttgacggggaccgggagccccccctcgcgggacacgggggggatttttttccngntggggttctcggggggcnccaacttgcgccttaacttggccctgcggggctcccttcgcannggcttggggnncttctttttcttccttcggggctcgccggtggttaccaacacccggttattcttcacctnnacttgggtgnngccgggccccagccccggnnngnnnnnnnnnnan

SEQ ID NO: 80077 - DNA, 546 bp, Triticum aestivum
  unsure (1)..(546): unsure at all n locations
  Clone ID: PAT_TA_80077
gcacgagggttcctagccgccgccgcccctccaccgccgcgcgccaagccgccggcgccgcctcccgcgtccgcctcaccgccgcgacctcctcctccgccactgctcgccggacctcctccctccgcctccccgcctcaacaactcgcgtggaccactgaaccagcaagggccgccggcgacgcatcccactgccccgccgcgaccccctccctccgttctccaagcgcagaacaacctagaacggcgaaggcgatggcaagggaggacaggaagcggaggcagcccgacggcgacgaggcggcagacgagggggagaggagggggcggagggacaagnnncccaaggaggagaagccggcaccgcccctgccgtcggagatcaggaacaaggagaagcgcagcgaggtgtacgccaagctcaagcgcgagaagaaggcccagaagcgcnnnntcggccgcgagcgcggccaggccgcccagcgcgccgccgagctcggcgaggaggtgccggnnnnnnnnnngccccggacgatcgagacancn

SEQ ID NO: 80078 - DNA, 624 bp, Triticum aestivum
  unsure (1)..(624): unsure at all n locations
  Clone ID: PAT_TA_80078
gcacgaggatcacaccactcaatccaaaaaaaaaaaaaaaaaaaatcttctactaaaaatttccgggggttgctcttgnnattgccggccgagcctcgcgtcaggatggcacccacggcggcggagcnnnnncagcagcacacgaagaaagcggtgggcctggcggcgcgcgacgcctccggccacctcgccccgctcgccattacccgaaggagcactggagatgacgatgtccagataaagattctgtactgcgggatctgccactctgacctgcacagcatcaagaacgactggaaggacgccacataccccgtgatccccgggcacgnnntcgccggcgaggtcaccgaggccggcaagaatgtgaccaggttcaaagccggcgatcgtgtcggcgttgggtgcatggtgaactcgtgccagtcctgcgagagctgcgacnnnnncttcgagaaccactgcccgggcatgatcttcacctacaaccgggtcgaccgtgacggcaccttcacctacggcggctactccagcatggnnngtggtgcacgagnnnntcgtggtccggttcccggacgccatgccgctggacnnnngcgcgcccctgctgtgcgccggcannnn

SEQ ID NO: 80079 - DNA, 614 bp, Triticum aestivum
  unsure (1)..(614): unsure at all n locations
  Clone ID: PAT_TA_80079
cttccacgacgaatccacgtcgcagttcataacggccgcgcctcttgccacgtcgtcggcatggtttctacgtcggggacggttgccgtcgtcgtcgtcatcctgtccgtgctggtggcgccggcgagctgccgccgggcactagtggctgccaacaacgggtccggcagggagaccgaggccgcagaccagtgcgtgcacggctgcctcggggagatgctggcgtgccagcaggcgtcggccggctgcgccaccgtgacggcggccacgtcatcgccgctgcagacgacgagccagcggcagcggagcgttccgtgcggctacggcggctgcgaggacgagtaccttggctgcatcgacgtctgctagttgataattaagctcgtgtttcaagtgccatgtgaactctgtctccggttctctactcatcagatcataatcttcttgtgcgtccagtatgagatgcaattagtgaacatcatgatttcaagatggaccaagcgatcaatctgatnnnnnntgctatttcccagttgcctcataaattanntcgcatcgctcgattccgnnnngcnncagcgtnnnntgnnnnnnnnnncgacatgactggcngc

SEQ ID NO: 80080 - DNA, 509 bp, Triticum aestivum
  unsure (1)..(509): unsure at all n locations
  Clone ID: PAT_TA_80080
gagagagaggggccgggccgacacacacagagcggcagngcgcccacgccgcagcagcaaccaaccnnnccaccccctaggagccgccgccgaattgggtgcgttcgcgggcgccgccatggagagggaagccacggtcgccttctacccgccggcgccggcgccgccgcagcagcgccccacgcccgcgcagccgctctcggcccgcgcgccgccgtccggcgtcgtggggcggggaggaggcggaggatgggcgggcaggcagtaccgcggggtgcggatgcggaagtggggcaagtgggtggccgagatccgggagcccaacaagcggtcgcggatctggctcggctcctacgccaccgccgtcgccgccgcgcgcgcctacgacaccgccgtcttctacctccgcggccgctccgcgcgccnnaacttccccgaccatctcctcnacngcgcccccgccnnngtgcccggggacctcaccgnnnnnnncatccgctagnnnnccn

SEQ ID NO: 80081 - DNA, 627 bp, Triticum aestivum
  unsure (1)..(627): unsure at all n locations
  Clone ID: PAT_TA_80081
tccacgaggaagacgacggaccaacaaatccagcggatcttttcccctcttctccgtcgacctgcgattttccctgacaaaatccacggaaaatatcctcgctttctccctgatttggccgtccggcgacagttcttgggcggaggagggaccaaccgcccggatccatgggggacgtgtccacgattcaacgcccgcccggcactgccgccaagcagggtgatcaggttggagagctggtgtcggccggatggaccaacgacacccacaacatgtacatcagctccatggaggcgtccttcatgcagcaactccgtggccagcagcagcagcaccaccacgccgctcccgacaggaacatcacccatgtgggtcttgttggccatgggctcaagccataccaagaannagcctccgataacctcggttctgagaagaacgtgcctcgcccgcgtgatgtgggtgcacgaagcctgcccgaggatccgtgggcgaggcgcttcaagccacgcgattctgctatgaatcgtcgtggcgatnnnnnntggtgcttccgatggtgaatcgggcaccgatacggttcaagggatggctccgaagcatggaagagaagtgatcagttgcgnn

SEQ ID NO: 80082 - DNA, 569 bp, Triticum aestivum
  unsure (1)..(569): unsure at all n locations
  Clone ID: PAT_TA_80082
cacccccgaactccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcgccaggctcaaggcgtacgagggcgtgccgccgccgtacgacaggaccaagcgcatggtcatccccgacgcgctcaaggttctgaggctgcagcctnnncacaggtactgcctcctcggccagctctccannnaggtcggatggaactacgccgacaccatcnnnnagctggnnnaaaagnnnanggagnnnnnnnnnnnctcc

SEQ ID NO: 80083 - DNA, 636 bp, Triticum aestivum
  unsure (1)..(636): unsure at all n locations
  Clone ID: PAT_TA_80083
gtcgattcatccaagcgagttgagcaatagcagtgagatttacagtgatttcagttcgtgtttgttcgtgagactgtgagagacaagagaagatggcctccaaccagaaccaagcgagctacgcggccggcgagacaaaggcccgcaccgaggagaagaccgggcagatggtgggcaccaccaaggacaaggcggggcaggccacggagaccacgaagcagaaggccggcgaggccaaggacaagacggcccagacggcgcaggccgccaaggaccgcgccgccgagagcaaggaccagaccggcagctacctcggcgagaagacggaggcggccaagcagaaggcgtcggagacggcgcagtacgcgcaggagaggtcctccgatgccgcgcagtacaccaaggattccgccgtcgccggcaaggacaagaccgggagcgtgctccagcaggccggccagacggtggtgagcgnngtggtcggcgccannnacgcggtggcgaacaccctnnnnatgggcggtgacaccaccaccannnncaccaccaccaccaggaatcactagacgcatgcgttggcgcttgatttgcnnngcnnnnntcgtgtttgctcgttcgcgggccttcnnntatctn

SEQ ID NO: 80084 - DNA, 603 bp, Triticum aestivum
  unsure (1)..(603): unsure at all n locations
  Clone ID: PAT_TA_80084
gcacgaggcctcgtgccgaattcggcacgaggctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgcgcgcgcgcgctgaataaaataaaaccaccgttcgtgttccgtagttctgtatgcccctgtcgcgtgtgttcgaccagtactgtccttcctcatgccnnnacttctaatgaatatatggcgcctcaacnnngnn

SEQ ID NO: 80085 - DNA, 584 bp, Triticum aestivum
  unsure (1)..(584): unsure at all n locations
  Clone ID: PAT_TA_80085
cgacataagtgataatgctgatgtacaagatgggtggaagttggaagagttgtcttctttgccgcaaatgatgtatcttaatcttgttaaattggaaagaacggctcattttcatacaaatgtagtgctggaggacaaaaaacatctaaaagaattggtgctagagtggaccacacatggagagggaccatattcagaagatgtttgcaatgctgagaaggtctttgagctgctagtacctccatgcaacttggaaaccctctatatctttggattctttggtcagaggtatcccacgtggtttggtaccacctgtttgtcttcagtaacacacttgttcctaaaaaatctacaatcatgcgtggatcttccaccggtcggacagctaccaaacttgaagtttctgagaattgatggagcacatgtagttaccaannttggacctgaatttgttggctacagggtgggtgaacccataagcaatgagttcattgctttccctaaacttgaatggttcttcgtcannnatatgcccaactgggnnnagtggtcttnnntnnnnnnagtggaaaatgttgttgatg

SEQ ID NO: 80086 - DNA, 373 bp, Triticum aestivum
  unsure (1)..(373): unsure at all n locations
  Clone ID: PAT_TA_80086
cttctttcttccttcctcagcgacccatccttctccattacgcacacaatcagggacctgctcggagatgttggagacacccacagccgagcttttctgaagagatgctggaggcaccgccgctttcgtgtgcgggtgttcgagggtggatcttcaaagttttctgcaacatggtagttgtttttgcaacgcagccattgtttcannaattgtttctgcaacacggtcgttgtttcagaattgtctccgcaatctccaaatttttgcaacatggtagttgtttctgcaacgcagccgttgtttcaagaattgcttctgcaacgcggccgttgtttcgggaattatttctgcaacgcgatcattgtttcaaann

SEQ ID NO: 80087 - DNA, 358 bp, Triticum aestivum
  Clone ID: PAT_TA_80087
gcacgaggctctgtacaccggaagcagccgcaggagggccgaccagtgctcatcctcaaggggggagcagccggctccaaggagggaccgccccgccaactggtcccagacccaggaagcccatctggacggcgtgtgggaggcgctttccaactaataatcgaatgatggacggacaaggatctagctgcactggcctgaagggtatccttcgcttgtaagtttccggctgcaacttgctcgcgagctgtgttattatggttgtggaatggttggcattccagtgccagtagctgttatcgtcgctgttttgaccaatgacgtgaacaaagtgataagtcattgcaaaaaaaaaaaa

SEQ ID NO: 80088 - DNA, 634 bp, Triticum aestivum
  unsure (1)..(634): unsure at all n locations
  Clone ID: PAT_TA_80088
cacgtacacatcacgccggccggccagttaggccgagcaggatgaatctcccggtgatcgcctgtgtcctcctcctacttctcgatctcaatgtttctcccgtggagccgtcccggccgcaggggctcgcgaaggggcgccacacgcccggaaaggggaaccaccacggccatagcgggcacagcggcgacgacgggcaccaacacgaccactccgacgactacaacgggtacagcttctacgtcttcggcgactcctttgccgacaacggcaacctcgtcaagatgaacccaagatccgagctcaatcgccagtggcgctatccctatggcttatccggccgcttctccaacagcttggttcagtccgacctcatcgcctacatgctagggcagaaaaagtcccctccggcgcacaggctcacgcgcaaggtcggcaaggctggattgaacttcgccgccggcggctccggcgtgtttgacgcaccggacacccagacgctcgccaggcagatccacaccttccacaagctcgtcaaggacggagacatcgaccaggaccgcctcgcgtccaaatccgtcgcgctcgtcgccgtctccggcaacgactacgcccgccttcccgccgacaccnn

SEQ ID NO: 80089 - DNA, 247 bp, Triticum aestivum
  unsure (1)..(247): unsure at all n locations
  Clone ID: PAT_TA_80089
ggcgaccccccaaaagaccggaagcccatgggaaaacaaacccttggtccagttcaacaaannattangggtccaaaatattaaagggtccagggcccaaaccttttccagggggaaaccttaaccaaaggaatcccctaaaaaaaaacacacccctcaaaatcggggaatgggccccccccggaaaaaccaagcgttgagggaaaaacggtgggggctcccaaaaaccggggggcgcttcaccaaa

SEQ ID NO: 80090 - DNA, 615 bp, Triticum aestivum
  unsure (1)..(615): unsure at all n locations
  Clone ID: PAT_TA_80090
gcacgaggccgcccgacctgacccccacccatctcccatggcggcggcggcggcggcggtgacggtgacggccacccgcctccaccctcctctcgtcctccactccgccgcacggccccagcccactctccgcctccgcctcctcctccccaccccaccgccgctccgcctccgacaccgcttcccgctcctcgccgtcgcctccgccggcgaaagccgcgcggaggaggccgccgagaagagcgacaaggcccggcagctgcagcggagggtgctcgtgggcatcgccatcggggtcggcgcgggcggcgtcgtggtcgccggcggctgggtgttcaccgccgccatgaccgccgtcgtcctcgccggtgcccgcgagtacttcgggctcgtccgtggcaccgccagcggcggcagcaccccgccaccgcgctacgtgtcccgcgtctgctccgccatctgcgccctcatgcccatccttacgctgtgctatggccgcatggatgttcccctgacgttatcggcatttattattgcaatatctttggtgttgcaaagaggaaacccccgtttcgctcanctaactagttcagtttttggtttattttattnnnn

SEQ ID NO: 80091 - DNA, 618 bp, Triticum aestivum
  unsure (1)..(618): unsure at all n locations
  Clone ID: PAT_TA_80091
gcacgaggcaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgcgcgcgcgcgctgaataaaataaaaccaccgttcgtgttccgtagttctgtatgcccctgtcgcgtgtgttcgacnagtactgtccttcctcatgcctcnacttctaatgaatatatgnnngcctcaacnnnngnnnnnnaaannnnnnnnnnnnaannnnnn

SEQ ID NO: 80092 - DNA, 549 bp, Triticum aestivum
  unsure (1)..(549): unsure at all n locations
  Clone ID: PAT_TA_80092
gcacgagggattactcctgctacgacgaactcaccgccccgccctcgatctgccccctccccccccccccccacgccctgcctcaagatcaggctgccgcgccgccactgacccccggattaggccgccccggcgccaccggtcttggatccggccgccgcgctgcccgcctctgctcctcacttctctgcctctgtgcccgcacgaggggatgccaagcccttgtgctcctcgatcggcagccataggggggccacccacgcaccttcccttcctgtcttcctctccttccttctccctcacaccctatgtctctgttctcctgcaggtacccgccatggccatcatggatagcagccatgcggcaggagctcgccaccgaagtcccctgagcaccgtacgccccgaatctggccgggagacgaggccgagccctcgcgcccagatccgctgcagcaacctggaagttcgccgccgccacctcgggcggnncaactgatgcaccnnngccctcaccnnnctccctgacagacgcgtcgtcctgactcc

SEQ ID NO: 80093 - DNA, 666 bp, Triticum aestivum
  unsure (1)..(666): unsure at all n locations
  Clone ID: PAT_TA_80093
cagcttacgggtctcaacttaatgaatacatcaaccgtgtacagaaggaaaaactcattacatgaatcctgagtaggtatttttagtctttcgcaatgtaatttatttatttttctctcataatatgttaggttcgacattggaaaatatttggcatgaatggagttgatttaaatcttgaaagacttcgattgagacctatgtgtatgtgtgttgccagccaactgtggaaactgaaagtagagacacaattcacataatgagtaacaacttccgatccaagtttaacaaccgcagctccattctagattggtgtttaagttctgaagtgtcgctctccagatttctgtctgtttcccttttatttaccgcaatctgcactgtaatggctatatatagaatcactagattcaagccgtgtgaggcatctactttgttgtaattgggcttccctagcatccaatatcatggtcctggcaacacttttctctgggagcaatacaaaccttgggaggctcatctgaaccttgagtcatttctctgaaatttatgaactttgcttgctgaaacctcttaacatttctggagtctgtcacctgattgattcttcacttggcaaagcagcaagnnnaattttggctgatgctagatgaaangannngtann

SEQ ID NO: 80094 - DNA, 575 bp, Triticum aestivum
  unsure (1)..(575): unsure at all n locations
  Clone ID: PAT_TA_80094
cttcgtcgatccgtcgcctctgcagctcctaagacaccaacgggccttcgtgtgcctctgtggtgagcacctcctccgattcccggcctttactccattgattcattgctgtatcgtcatccccacgagctcgagcgccatggccgaaacctctcatccacgtgcgcgcccacgtgctcctggtcgcgccctcgcgagccacccacgcccgcgcccttgggcctcgcatgcgcctgcgctcctcctcccctgctaccgcagctgttgctgccctgcgctgtcgcggccgcacactgctctacctgctgctgcttgcggcgctgctgctgccccgctacgccagccagcgtgcacgcgcaccgcgcccccgctcgccttctgctgatgctgccttgccgtgcctgctgttgttctgctgtcgctactgctctttcctgctgcttcctctgcctggtactgcgctgcttcttttgcctgtagttgctactaccgctagtgttgcttggctcctgctannnctgcttgcaatcgctggttgctgctagtggtggcnntggccgtgtgtgnnnnnnngt

SEQ ID NO: 80095 - DNA, 408 bp, Triticum aestivum
  unsure (1)..(408): unsure at all n locations
  Clone ID: PAT_TA_80095
ccaaacccccccccccccggggggaaccccccgccaacccacccttccaatttccattccaccaccttgggacggtcggcctttncttttacccatttttttttcggggcttggttgccttttggcacccatttnnactttaagggggcaaattccttttttnagcctttccgggccccggggttcatttttttcccccccccggggttttcccccaccggccccccccaggaatttttggggcaggcattccgggccctggggtggccccccccccccttttttttttcccccaantttttttggggcggccaggggcccaacaacaagggcttttcccccaacccctttttcgngggctntaaacntnntttcaaccggtnnnncttggattccttcnnnttgttt

SEQ ID NO: 80096 - DNA, 207 bp, Triticum aestivum
  Clone ID: PAT_TA_80096
ctgctctgtagcgtgatctgccggcgagatcagtggccaaattaatccacaacaaaaacacctgatcgctactgatgccaataaatgcagtagtccgtatatgattctgctctcaatctggcttaatgtagtgctgtaccgaaccctacttctgctcaatgcagtatatagtatgattgcggtgtgtgacatgataaaaaaaaaaaa

SEQ ID NO: 80097 - DNA, 600 bp, Triticum aestivum
  unsure (1)..(600): unsure at all n locations
  Clone ID: PAT_TA_80097
gcacgaggtacaaatacaggaggttcttctcacgtgaaagattagtctctcttttgatttattttaattcccatttatgtagaaacctaataatgtactgagttgaagagttgtactgctcctattagtttatcaagcagtggtgtgcattggcatgtaagatgcttgatttaagatggatgaagaacatatcatttacttcagcggacaaataaacaagtggaaaggcgggcttttctcctaactattaaactatcgccaaaagttcagttttgatatatcatctaccgaactatcattttcgtgcacctatgtttgttacctccgtttctaaaccaagtgcatcagtgtgtttagttgggattaacattttattctggtgcttaaaatgcgtctgttttggttcagttctaccattatagacatgattgattttattaatacaccctctttatggcatgcacagttcattcgatttggatgacaaaaaaatatgagaacgaaantatgcttccaaacaatgattcagatcctaaacnnntgcatgtacatacnnnanttgttagaaccaaattgcataaaatcttattgcgtgcactn

SEQ ID NO: 80098 - DNA, 590 bp, Triticum aestivum
  unsure (1)..(590): unsure at all n locations
  Clone ID: PAT_TA_80098
gcacgagggtggaatccaccaaaagtactgggggaagcacccaggtctatccccagcaccaatagttcatgttgtcctttgtggcaatggcattgtgccatataaggcacaaccaaaatttaactttcaagggcagttttgttttccagagatgtctaaatgatctatcaggaccagcatcagaaagatggacagtgtcagaacttctgtttgctgtgttccttttcgtttgtgcgacctacaacttggtgtatggaagcgacttctatttcatctatatatatctgcaggctataacatttatcattgtgggcactggtttctgcggaacctctaactcatagcagccataacaactgatccaaccacgggaactatatcttcactgtaggcatgatgtaacaacctttttttctagggaatattttctatgtaataacctcatcccttttgccgtgaatagcatcaggcgaagcgcagctgccttctagnaacaggctggtggaaatctaaaacgtcatttccatgtaacaacnnncnactnnnattnnncttttgctctcnnnnnttgcnnnntacnnnngctctta

SEQ ID NO: 80099 - DNA, 555 bp, Triticum aestivum
  unsure (1)..(555): unsure at all n locations
  Clone ID: PAT_TA_80099
gaccctcaccggcaagaccatcaccctggaggttgagtcctcggacaccattgacaatgtgaaggccaagatccaggacaaggagggcatccccccggaccagcagcgcctgatctttgccggcaagcagctcgaggatggtcgcacccttgcggattacaacatccagaaggagtccacccttcacttggtgctcaggctccgtggtggcatgcagatatttgtgaagaccctcaccggcaagaccatcaccctggaggtggagtcatctgacaccattgacaacgtgaaggcgaagatccaggacaaggagggcattcccccggaccagcagcgtctcatctttgccggtaagcagcttgaggatggccgcaccttggcggactacaacatccagnnnnngtccacccttcacttggtgctccgtctccgtggnnnnnnntaagctcctggccatggagctgcttctgtctctgggttcacaagtctcggtgtctccggtatcctccaatnnnnnctggtctgtgtctgtcgttgcctgaactnnnnntgntn

SEQ ID NO: 80100 - DNA, 659 bp, Triticum aestivum
  unsure (1)..(659): unsure at all n locations
  Clone ID: PAT_TA_80100
gcacgagggagccccagcgcccgatccccaactcctcccgatcccctcatcctctccctctcgtcttctcccgagctgccgccctgttgcatcgccgccccgccacccgcacagccgccaccccctctcttcccgaggcccgagcaggagcgctcggcctcgtcttctcgcgcggccagccgcctcgacggcgacctccaggtccaccgccgcgccctgcttcttcttcctgctcgaggagccccacgacatcaccatggatggctgccgcccggttcggcctcttcttcgagcagaggaggacgcccgcaaccattgcctcccgcggcgccctttgaccttgctgccggccgagcccgaagctccgccactgctcctcgtcgccggagtcccgctcctctgcctccctgcttcgtccgccgtgacgttcggccgccgtgccgtcatgttgcagcgccaccggcctcgacctccctcccccccctcgccgcggctgcaccctgcnnnagctccgcctcctctcccgcgccttcttgcctcctccgcgcccatcccctgttgcatctccgtcggcaccatcgctgtgctatggagctcctgcctgagccgtcccttnnnnnnnnctctgttgctgcnnnngctgcnnngatcttccctgg

SEQ ID NO: 80101 - DNA, 538 bp, Triticum aestivum
  unsure (1)..(538): unsure at all n locations
  Clone ID: PAT_TA_80101
cctccgccgggcggcatgtggccgacgagcttgggcacaccggagacggacaaactcatctgtctcgggctcatggtgccgtcgggttgtcggctgccgaaagccttcagaatcacggccgacgggtacccgacgagggggctggcgcgacgccggagcagctccgccgccacatcggcggccgctggaacccagacggccggcatgccttctgggacagcaaggacttctggtaggtcgtggccgagtgccggcgggaggcgaggtggttgggtttgacacccgcagcgactgctccccctctccctcccgctgtggaggtgccggccgagcaggccgccgagcgctggcgggcggcgaggaggcggggtccggcagccgcgccgactgctcctcctctccctcccgccgtggagatcccggctgagcnnnncgtcctacgcgaggaggacgacctcgacgacacccccggctacctcatagccttgcgggcgtcgnnnnnngccgcggtggcnnnnnnnnnccgcnnnnatgcnnn

SEQ ID NO: 80102 - DNA, 533 bp, Triticum aestivum
  unsure (1)..(533): unsure at all n locations
  Clone ID: PAT_TA_80102
cacgaggcccggcggcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatnaaggcactcactggatgcttgacaagcttggtggagcttttgcccccaagccatcatctggtcctcacaaggccagggagtgccttcctctgatcctcatcctgnnnnacagactgaaatatgctctcacctaccgtgaagtncagtctatccttatgcagcgtcatatcatggttgatggaannnnnnnnnntgacangncctaccctgctggttnnntggacat

SEQ ID NO: 80103 - DNA, 552 bp, Triticum aestivum
  unsure (1)..(552): unsure at all n locations
  Clone ID: PAT_TA_80103
gcacaggattccgatcgcgtttgctcctccgcacctatcggttcctgccggaaccagcgtgccaggtgcgcagatggcgcctgacactgattcaacggagacaagaaaaaggagaaacgaggatgctgtccagatggatccgtgcaagaggcaggccatacaaagtttggaggtcgataatcaggtttgccaacacatgacagaaggagatctgaatgagtacacgcacttgaaggtagagaatcagcagctccatgaagagtgcttggagttggaggtggctgggaaggagcttttgctcaaggagcaacagttgaggctccaaattcagcaggcggaggcgcaatacaagagtttactgaacgagtacatttccgccactcctgtgaggacgcgtatgcagtagatgtcactggccttggttttcttccacaaaacgaagacgaagaaccgcaaacacttcagnnnaagttgaacctgaacttacaatggctagcaacttagcatgatgannnntacgcccgttacnnnnnncgctnnnnnnncgntngg

SEQ ID NO: 80104 - DNA, 619 bp, Triticum aestivum
  unsure (1)..(619): unsure at all n locations
  Clone ID: PAT_TA_80104
gcacgagggtcatccagggctccgactcggtcgcgtcctggcaagccaacctcctcttcgagcccaccgcattcgaggacaccggcgtactcgtgcaccgcggcatctatgaggcggccaagggcatctacgagcagctcatgccggagatcgtggagcacctgagggcgcacaaggatggcgctcgtctgcggttcacggggcactcgctcggcggcagtctggcgctgcttgtgagtctgatgctggtggcgcgcggggtggtcggtccggagtcgctgctccccgtggtcaccttcggagcgccgtcggtgttctgcggcgggcagcgcgtgctggaggcgctcggcgtcggcgaggaccatgtccgcgccgtggcgatgcaccgggacatcgtgcctagggcattctcgtgccggtaccccggccatgccgtcgccgtgctcaagcggctcaacggcgcgctgcgcacgcacccctgcctcaacagccagaaggtgctgtacacgccgatgggcacgacgtacatcctgcagccggacggcaaggcgtcgccgcaccacccgttcctgccnnnnnncgcggcgctgttnnnnntnnnnnnncccggagnncgcgn

SEQ ID NO: 80105 - DNA, 667 bp, Triticum aestivum
  unsure (1)..(667): unsure at all n locations
  Clone ID: PAT_TA_80105
gcacgaggagagttggttgtgcctatgcaggacgcggcgacgcagctggaccagctggacagcgcggcggcgtacatcaagcagctccgggccaggatcgaggacctcaagcgccgcaagcaggccgccctctccggcaacaccgttggctgctcatcctccgtctccgccggcgactacaagtcacagacggcagcgctgcctgtgatcgaggtgcggcaccaggacgggacgctggacgtggcgctggcgagcgaggccgggcgtcccttccggctgcacgaggtgatggcggtgctggagcaggagggggccgaggtggtcagcgccagcttctccgtcgtcggcgacaagatcttctacacgctccattcccaggcgctctgcccccgcatcggccnnnncgccnnnncgcgtcgcccagnnnctccgcggcctcgccgccgcagccaccgtctcggcgctgctgacatgattttgtctctctagcattttctttttttgccatggcgacccgatcgactgacctgcaaggagatggatggagctggtagattgattaatttgcagctgtgctgcgggtagttgatcttttcccccctcttgtactagtattcttcctggctttctattggtnnnnnnggttggctaatggctcctcactcnn

SEQ ID NO: 80106 - DNA, 626 bp, Triticum aestivum
  unsure (1)..(626): unsure at all n locations
  Clone ID: PAT_TA_80106
gcacgaggctcccgccgccgtacgttcttctttctccgttatccatcgacgtaaggaaccgtcataattcctacctaatgggggagcccgcagaaggagcttcgttgggaccagctagggcgcccctggaccctcgcacagaccttgttgaaactgaggagtcggatccggttgccgaagttaccgcatcatcatcattggaatcgaaagaagagaaggttgaacaaggcaacacaaggaaaaaaataaggcggtcgaccaacgcagacatgacgaaataccagcggtgctcaaggcctggtgttgttggtctcaaggcggacaaggccaagaggatcatcaggaaaggcaagccggacctcttttgttcagttgttccagagaaccagtttctgaccatggcctagtgcacggatcgtgttaggctcatagtggacagatccaaccgcgtcgtgcgaactccccgtgttggctagctaacatcaagtgaacaacaaagtaaaagaaaaggaatcaagtgcttatgtcagattgctctatattttcatgtcataggaaatatgatttagaactnnannggttggacgtgttttgatgcgccattggtgttgttcgttttcttaann

SEQ ID NO: 80107 - DNA, 635 bp, Triticum aestivum
  unsure (1)..(635): unsure at all n locations
  Clone ID: PAT_TA_80107
gcacgagggcgaaccgaacaaagaaaaaaaaaaggaaaatcccacccgtgcgtcctcaacctacggatcctcgaccaccatggtttccacgcgccgctgccatcgggccgggatcccgcacgccgccgccatcaagccgggatccccacacgccgccgacgactctgcgattcccacgcgtcgccgtcgagcccgggacccccacgcgccgccgccggacctggaatccccgcgctccgccattcctgggatcccagcgctcggcgaggcttcggatccccacgcgccgccgcctacgcagctcctgcactagccgccgccccgctccagccaccctccccgacctggccacccacccacagcgccatcaccgtccccgccccaaccaccgcctccgcgccatgccattggacccagcgacccgcggcacaccaactcgccggagtggtgctgccccaagcggtcgtccctgcaccattgcaaccccccgtctcttcacgagcgttgctgcatcaccaagacccactgccactgaagttcgtcttgtctaacaatttcagtttgcatctttttttagtttcgattccttgtttgcatcctatattcagtgatgtggatgttagttgtnnnnnnag

SEQ ID NO: 80108 - DNA, 634 bp, Triticum aestivum
  unsure (1)..(634): unsure at all n locations
  Clone ID: PAT_TA_80108
ccgtccgcggcggcgccagccgtctctcttcatgcatcctccaccttcttgctcacaggcttccccggcggccaatgccgcctccaagagccctaatccccgcgctcttaccgccgatgaggatgacccagacctgcccccacgggaggcgcccccggggatccctgaactgctgcaccaccggaaccgcgcgggggcggcggagcgcctccctgccatccgcgccaacctccgcctcctccccccgcccgccgccccggccccgtcccccgcgagcgacgccggcctccgcgcgctcggcctcctcagcttcgtccatctggacctctcgccttccccatcctccggaggcatgcgcagcgacctcgtcacggcgctaattgccaactatctccccacacttgagtggagctacgcacgaggcgccggcttcgagatctcccgcggtacctttgccgccgcgctctgcctcccggccccgcgaagcaccgcgtccgtccatcacgagcccccgtccggcgtcgaccccgccgccgtggcctccgccgcgtcggagttcatggnnncgtacatcatgacgccgttagcggccaccaacaaggggaagctgcccacctatgtcgagtcagcggnn

SEQ ID NO: 80109 - DNA, 630 bp, Triticum aestivum
  unsure (1)..(630): unsure at all n locations
  Clone ID: PAT_TA_80109
cacagctcgagctaagctagctagcatcacatcatagtcatggcccgcaccctcgccgtcgccgtcgtgttggcgctcagcctcctcgtcttcctcagcgcctgcccgtgcgccgacgcgcggccgatgtccgcgaggccggtgagctccgggacgtccgcgcttgcactgccaccgtcggcgtccgagggcgtggcgcactggcgtgccgccgacgcggccgccagggcggggaagtggctgccgtactaccagtacccgggcggcgccggcgtgcactaccacccagggtacccgaagtacccggggtacccggcggagggaaagccgatgatgtgggggtcgggcacgccaccggagctgggcgcctacgcggcgagcggcaggcagcttgggaagtcgccgtacggcgatgagacccggcgggagcaggtcgccatgtgggcttcgctgctcaacccgtccaaggggccgaccacgccttccagctggctgccggcgaatggcggcgacgagccggcggatcaggcccgcgacgagcctannncgtacgacgccgctgccgnnnnnacggagatggacgtgcccccgggcggcggcggcgttcagnccggccagcagcccaagtgg

SEQ ID NO: 80110 - DNA, 621 bp, Triticum aestivum
  unsure (1)..(621): unsure at all n locations
  Clone ID: PAT_TA_80110
gcacgaggctacctttcctcccctctactccttcagctctcccaagcttcattcgctctcccccagatccccaatggtcgcgcccgccgcctcagatcctcccccaggcggcccctccccatccccactctcctcttgatcgatccgatcgacatcgacatcgctgcttcttgctcggtcggccgatcgatcatggacgccgtgggcgagcttgctgctgcggggatgcaccaccaccaccaccaccaccacaggtgcaaggtgtgcggcaagggcttctcgtgcggccgctcgctaggcggccacatgcgctcccacatctcgctcggcgaggcgctgccggaggccgacgacgagctgatgaggcgctcctccgccaacggcggccggaccagcgccaatggcgccgtcggctacgggctcagggagaaccccaagaagacgcgccggctgtccgacttcgccgacgaggaggaggatcagggcggtgacgggggcgagcagnnngcctgccgggagtgcggcaagctgttctcgtcgtggcgatcgctgttcggccacatgaagnnccatgcgcccggcgccgccagggatcacgatgagtacgacgaggctgacgac

SEQ ID NO: 80111 - DNA, 395 bp, Triticum aestivum
  unsure (1)..(395): unsure at all n locations
  Clone ID: PAT_TA_80111
cgctcgccatctcccccgacacccgagtcccgcacctccctcctgcccgcaaccgctcacccgtcctccgccgccgcccgcccgctggcttcccctcccgtgcgctggcccgtccgctgccgcccccgcccgcgcgctggcccgtccgctgccgcccccgcccgcccgctcgcccggccgcgcacgctcctgcccccgatccgccggccgccgccgcccgcctcactgccggagaccgcccgcctcgctgccgtagatccccccgtggtcgtaccnncctctgccggacacccccaccnnncgcggccgtcgccccccatccnntgaccctaccctgcggaggaggatcnnnnnannnntgaggtgtgaagttnnnatacnnnntatannnncnn

SEQ ID NO: 80112 - DNA, 641 bp, Triticum aestivum
  unsure (1)..(641): unsure at all n locations
  Clone ID: PAT_TA_80112
caacaatggcgctccctcgccactcccacctcttcctggtcaccgtcgtcctgctcctcctctcccgcctgccacgctcttcgccgacgtacattgacgtctcaccatgcccttctccggcggcacgtacattgacgccacgatggcttccacggtccaccgtcggttctccctccacttctccggcctatgatccacggccttcggagctctatgatccacggccacgtttcccgccaagaggtctcccacggtcttcgttgctctccgatgcactctccccgtccgctgctccgccgctgcgtttcctgccaccgccatacggcctgccacggagctcgccttcctcctacaaagcggcgccaatgttgccgtccactccggcgccacggctgacgccgtcgtcgtcgctgcccgtcaacccgttcacggccaaggccgccttcgtccggtactggaaccggaaggtgcacggcagccgcctccacccggccttcttcttcgccaagctctccccgctctccgcgcccgacgccgtcgccttctccaacctgcggccgccggccagctcggctcgcgcctccccgccttctgcaccnncgcgnnnatcctctgcccctcnacctccggcgccatctggn

SEQ ID NO: 80113 - DNA, 234 bp, Triticum aestivum
  Clone ID: PAT_TA_80113
ctccatcaagaggattggatagcctgtggggaactgcaaataacttctgatattacctccgaaagtgatgcgaagtgtgttactacttactaccgctgctcttgtttcacactgagaactgtggttgtggagatgtaaatttgcattaggagaatcgtggaaattgatatcatgacatggatgtggtagtgacagcaagtggagatgttttgccgattctttaaaaaaaaaaaa

SEQ ID NO: 80114 - DNA, 168 bp, Triticum aestivum
  Clone ID: PAT_TA_80114
gcgtgctgtaatctttttgtaaggtcagatcagactacgagtgccatctcaagttaacccactctcgctaggatttcttatgttggtttcagctaactgctttaactttattctcgttaggttaagaattgaagtggtgggtaaaccttgatatccaaaaaaaaaaaa

SEQ ID NO: 80115 - DNA, 642 bp, Triticum aestivum
  unsure (1)..(642): unsure at all n locations
  Clone ID: PAT_TA_80115
nnaagaagatgcagaagataacaataagaagaaaaagaagaaaaagaagagggtcaaactgagagctttcagaccagaagaaatgcaagctccaaacttcactttagggatgtcattttcttcagtagttgagctgaggagggcaattcaaaattatatcatacaagagagagttgaaataaaatatgcaaagaatgatttgcaaagagtgagggctcactgtgtagaaggatgcccttggtatttgtttgcagcacctgatagcaggactaaaaattttgttgttaaaacttatgtgggcactcacacatgcagtaaagagtgggacatcaaacaattcactgctaaattcttagctgcatattacattgaaacttttagggcagatgacaagatgacactatcaaattttggaagattggtgcggaaagattatgccttgtagagatgaaagatcatggcaaaaggtcaacggaattgaagtgagaccacctcagtatgaaaaacatgttggtaggccatctaagaagagaagacaaaatcctgttgagatggaagaaggggcaaagatgagtagacatggcactatatcccattgcagtgtgnnnnantcaatagagcacaacnnnngaaagtgcccnn

SEQ ID NO: 80116 - DNA, 382 bp, Triticum aestivum
  unsure (1)..(382): unsure at all n locations
  Clone ID: PAT_TA_80116
gcacgagggagagannnaaaaatccttacccttnaaccnaaaggattccaggcaccaattnatatttcctaaaaaacnnncttaaccaattccaaacccgaccggcctgttaaaccaaccaccaaacccttcggcttgaccccaaattccacccccaccaattatncaaccaacaacaaaaacaaaggcccaatttttgttgttaactgaaaaccccaccttttaaattaatttananaaaaattgttccttcccgtaaccaaggacncggttttccagaattttccttaaaaaaggtttttttccgttcttgtcctttaactttaaaaccccccaaccaatttttgacttaccccggcaaaacctgtaatggttcctaatt

SEQ ID NO: 80117 - DNA, 344 bp, Triticum aestivum
  Clone ID: PAT_TA_80117
gcacgaggcccaggtacatagctggaggcgtctcagtggaagaggaggatgctggtgctgtatagaattcaatgcaaagctggctggcggcgacggattgtacggagacggagacgggcagccaagtcagtcaagcatgcatgcgcctacctggctcgctcggaaaagcagtgtaaaggaaaaaaaaagggtaaagcgcttgcttgcttgctgtaggtgctaggcttccttggttttctggatccgaatgatgctttttgggatgcttccaaactttgttggaccgctcatacttcatttcgattcaagggcaaaacatttcctagcttgccaaaaaaaaaaaa

SEQ ID NO: 80118 - DNA, 639 bp, Triticum aestivum
  unsure (1)..(639): unsure at all n locations
  Clone ID: PAT_TA_80118
gcacgagggcgaggagcgcctccaccgcccgccgcccgccgcccacggccgccaaaccgggatatttcgccgccgtcaccgcccgactggagcttggtcgccccgtgcctgcccttgctcctgctcgccgtctccctcgcggcgtgctgggccggacgcgccgacgaccacggcgtgcactccgtgctctctgtgccgctcctctcggcgctgctcggcgtggccgtcgcgctcgtcttccttgccggctacctgcgccgcaagcgcgccgacatcgcgcacgtgcccccctccgcggcggccgctgccccggacctgcctaagcaggcccgccccgctggccagaacaagaagggcagagggcacgcccgcgtccaccaccaccacgcctccgccgccgacaaggtttcatcattcttgttctcttcataccaagcctttcatactttgaaggtgttgtgatttgggacagaaggaaggcaggacaggaggtgtttgattggtgtgatagacaggcttgaatcatgtctgggaatgtatcagacagctcnnntattggtgaatcagctgatgagttgttgcaaacaccacatagtnnnngagctaaagtctgggaatactatgagccagatntggtaa

SEQ ID NO: 80119 - DNA, 518 bp, Triticum aestivum
  unsure (1)..(518): unsure at all n locations
  Clone ID: PAT_TA_80119
gcacgaggacgtgcccctcttcctcctcctcctggccgtcgcttttcttgcgtcgcccgtcgtcggcctccctcccggcggctgctacgagacggcgacgaaggtgtccaggcggtgctcgggggagttcatcaaggcgctcttctccgacgacttgcacggggtcagccgtaaatgctgcgatgagctgacctgcgtccgcgagcagtcgtgcttcagcgtgctcctgtggtactgcccgcccgnnncgtgggcgcactgttacggtggtaaagcggccgccggggtgccattacaggggagcccctgagcgccggccggccgccgtcaatcccgacggcgcgatgtctacggagtacgggcaccaacaataggntgacgtgcacataaaataaacnnnttnnnngacgtggcgtgcgtgcacnngnnnacgttgtgcgcgcgtgcttcgttgcgattctgtttctgcgtgcnnnnatgttttanntcannnntgtgtcnnnnnncnnnnngatann

SEQ ID NO: 80120 - DNA, 593 bp, Triticum aestivum
  unsure (1)..(593): unsure at all n locations
  Clone ID: PAT_TA_80120
gcacgaggattgaacctcctctcttccgtgcttcttctcctcctctggttttcccctttttctcatcctgttcttcccgatcccctctcaaatcctacctgttgatccgtgagactagccagggcctcacaactggtatctagagccttgaatccgcgttcatctgcgcccaaatcctcctgattcggcggtaaaattcctccgcgaagggtgcgaaatttgcttccgcaaaattcgctcgaaatcccgagcggggttcgctgggttcggagcgggccgcaacggcgccgtcgaagccgccacttccgtccgcccagaccaagttggtcatcgccgccatgggagagaattccgagagtattcaggcgtcgctggccgcccttctcaccaagattgaagccatggatatgaggatttccaattttggcaaacagctcgaggcaacacaggagaatgtggacgcgattcgtcaccggcaggcggaggcgnnngctacaccggcagggtcgggagtcacggagcnngnnccgttatcggccacccgccccgctccgcggcttgcgaatctgcagcngnccctcctcgnnnnnnnn

SEQ ID NO: 80121 - DNA, 643 bp, Triticum aestivum
  unsure (1)..(643): unsure at all n locations
  Clone ID: PAT_TA_80121
ctcgattggatcctagagcagttctccacccagatcccatctctcacccgttgtggcagcgaccgacagcactcggcaagttacggtgctagcaaagtacggcgactggtggtggcggaaaacggcgactggccacgcatgctgttgtgggagcggcggcagcacgggctgatgggcgagcggggggcagggggcgcaaggctgatggccgagcggcggggcgtgctaatgggcggccggcgctgtgggctgatgttctgcgctgatcggttctcattcgcatgcagggtaaaggaggcgagagatccacatctctagctgaacagccgcccgannaaatgtctcctccctacccagccagaagtttgatccttccgatcgaagagtttccatttgcaagacgtatggttggaaaaggattgaagtactggtgtaacactaataattcttactaagatgtgatttctatgtcaatgtgtagatgattcctgaacaatttcttnnntattggtaagtcatattggagataaattgagttgtgataatgctatgatactaatgatgacaatggtacctatggcaatgtgggagattatatatatggcgatgggcantacgatcannnnnacgannntggtgatnn

SEQ ID NO: 80122 - DNA, 639 bp, Triticum aestivum
  unsure (1)..(639): unsure at all n locations
  Clone ID: PAT_TA_80122
cctcgtgccgaattcggcacgaggccccaacgaagccagatacacacctacacacccatccttcccgacccccaccaatcctcgccgttggcccgcccgtcaacacttcaaaaaccatacaaaatggcgcgcgccgcggtcgtaatcttcttcttcgtcctcgccgtcgcagccgccagcgccgcgcaggcccccgcggagtcgccgaaggcgcccgcagcctccgcacctgccaatgcgcccgaggtcgcgaagaaggccgcgtctgccccggcgtcgaggaagtccggtcctggtgccgcgccagccagcaagagctcgcaggccgccttctcttcaccgggtgctagggcgtgggcttctaccggcgaggcgtctagcccactggtgcccatggccgtggtgtttcctatcgccgacgggcctggtgccgcgccagccagcaagagctcgcaggccgccttctcttcaccgggtgctagggcgtcggcttctaccggcgaggcggctagcccaccggcgcccatnnnnngnngtgtttcctatcgccgacgggcccggtgccgcgccagccagcaagagctcgcnnnnnnnnttctcttcaccgggtgctnnngncgtnnnnttctaccggcgnnn

SEQ ID NO: 80123 - DNA, 485 bp, Triticum aestivum
  unsure (1)..(485): unsure at all n locations
  Clone ID: PAT_TA_80123
cctcgtgccgaattcggcacgaggacgcgcccagccccaatataggccaggcggccctctaccagatccctttctctctctcctcccctcgcctcgctctccgcctccgattccttccccaatcaatctcccgcggggaggcgatgcggtggaagctcggcaccgcggcgtacaagcgcgtgccgtcccgcgacgccgccatggaccccgacctcgagacgccagatccgacagcagagaagacgcccgacgggggcggcggcggagcnnnngcgggcccgtcgtggcgcaggtcgctgccgcacgtgtgcgtcgccaccgtcacctccttcctcttcggctaccacacaggggtggtgaacgagccgctcgagagcatctccgcggacctcggattcgccggcaacacgctggccgannngctcgtggtcagcatatgcctnnngggagcgttcgtcgggtgcctcttcagcggctctgtcgcn

SEQ ID NO: 80124 - DNA, 663 bp, Triticum aestivum
  unsure (1)..(663): unsure at all n locations
  Clone ID: PAT_TA_80124
ctgaatctcacgtccttctttgatcttgtatatcacaacttcagagcatgatcggttcttgacagcttgatgtgcagaatctttacagcatccttcgagcgaacaggtttagcctagcctcaagcaccttctctctgaatccctccatccttagccaacaagcctctaatctgaactctttatagtgcttgacatgcatcttctgggggatcattgggcagtgatgcgaaatgacagttgaggccagagacaactgatattacaagtggctcggctcccaagattaacacgatcgattttgaaatgaaccgagctctctctctctctctccttagaccaggtgaacctccttccattaagagcaatttcctggagctcaagatcctcaatcatgtttctaaaacggccatcattctgagattaatgttggcgttgctattgtcgctgacatggcaaatgagattaaagtgcccaagaatcatccaatcaggcaacacaatattctttatgctcttaacctcgttgagaaaaacagtcttatcactgtcctccgnnnnnncatacacagcagcattatttggtcagatcagtaatagtaccagtaataaagtgagagcctgnnnnattatagtcnnnnnaaatagcnnnancatctgtactnnn

SEQ ID NO: 80125 - DNA, 660 bp, Triticum aestivum
  unsure (1)..(660): unsure at all n locations
  Clone ID: PAT_TA_80125
gcacgaggccttcctccatgaatccggtcctttcatcaacgaccacctgtaggtaaaggagatgacgtcctggattccgcctcatcctctttccaatccgacgcctccacacacccgctccctcgccatcggcggcgccgccgcatgccggtcctccgtgcgtcgcctcctcttcctccacgacccctccacgtactcgcagacgacggcagccggaaccgcccccgtcgccctcgtcacctccacttgttccacgatctggccaagccaccgagagaaagctgttcgcggtgttgtagcgctgctggggagctgcgcgttatgatgaacatctgcctcctcctccgtgtcatgccctggtacctatctttggttttgattgatgcctcacatttctgttagagcgttgggtaaagacatgcagctgctcaagaacaggggaaggaccaatctgctgtttcggttgtttatgtgcgctgaagattgttcatacccgtatcccgaagatagaaggcaaaataatccaattcatcacatttgaatttcctaatccaacttcagtagttaaacacnnnaagttgttctccctaaagttacattcttgccagttaatctcatggcctaacctttgtgatcnnattgtcnnnnnnnntaagtnnn

SEQ ID NO: 80126 - DNA, 608 bp, Triticum aestivum
  unsure (1)..(608): unsure at all n locations
  Clone ID: PAT_TA_80126
ccgcccactcccagtctccggccgccgcgccctcctcctcctcctcctcctccaacaccggcgccgttgcccagtcccccactgccgcctctccgaccatcacaggcaccccagtcccttcatcgtcccaaaaccccatctccacctctcccgccgcctccccctcccactctagcaccaagctcacctccccggccgctgcccccgtccaggccaccgctccacccacattgcctccccccacgccctcccccatcagctccccgccgcccacactgccggcgccggccaccgcgccagcaacgtctcccccggcaccggcgcccgtcgcgaccgcgcccacattgccgccaccgatggccgcgccggctctctcacccccagcgctcgcccccgcgccggaactttcgacgtcccctccggccctcgcgccggcgcccgtcgtcctcgccgccccggctcccgcgccgagcaagaagcccaagaccaagaagcacgtgtcccccgccgcgtcccccatgtccgccgcgtcgtcgccgaccaccggccgcggcctcgccccctgtcccggcccgtccgccgccgacatgtcgagcgacgcggcgcgn

SEQ ID NO: 80127 - DNA, 615 bp, Triticum aestivum
  unsure (1)..(615): unsure at all n locations
  Clone ID: PAT_TA_80127
tcagtcttcactctccatcgaccagcctctatccccccattctatccagaccctgaatccatggaaacctccacgcagaacgtgagaagcggcggagtaatggagggcgaggcgccggcgtgcgtgtccaaggtgctcgacgaggacaacctcctccgagagatcatcgtccgcgtcggcttccccaccagcctcgtccgcgccgccggcgtctgcacgcgctggctcagccacgcctccgaccgcgcgctcctccgccgtttccgcgagctccacccgcccaggctcctcggcttctacctcgcgaacagggagcgtccgggcggcgcgcgcttcttcccggcgctgcctctgcccccggatctcgccgccgtcgtccgccgcgcaagcttcagcctggacaccgcacgccgctccgcaggcttcagccccgacacccactcggacgggcggaccgacgtggtgggctgctggaacggcagcgtcctcaccagctcgcaggggcagaattacgcgcacggtcgatctgaaatcatatttgaagtgcacagcccgctatgctccggctccgannnnnnngcgnnnatcatcccagcactacacctcnnngtcnnn

SEQ ID NO: 80128 - DNA, 623 bp, Triticum aestivum
  unsure (1)..(623): unsure at all n locations
  Clone ID: PAT_TA_80128
cgtcggtcgtcactccccccgcgcccgcagacgcagacgcagagccagccaaagcaggagagctcccgcccggacgtgtgacgagagcgtgagggcgtcgatggggaagtggatcaggtcgctggtcggcctcaaggcgccgtcggcgtccgcggcgccgggaaagggccggaagtggagccggctctggcggggcgcgtccagggacggcgccgggggctgcgagacgtcctcgaccacgtcgtccgccaccgcgctcggctcggtcgtggcgcgcgcgccgcccgcggacttccgcgtgatcaggcaggagtgggccgccgtgcgcatccaggccgccttccgcgccctcctggcgaggcgggcgctgaaggcgctgcgggggatcgtgcggctgcaggcgctggtgcgcggccggctggtgcggaggcagctcgccgtcacgctcagccgcatggaggcgctgctgagggtgcaggagcgcgccatggagcgccgggcgcgctgctccgccgacgcgcagtcacaggacgcgcccggccaccgcgacggccgtgccgatccgctcagggaaaccgnnnnacgatggtgtgannnnnanngttctgtcaaccaagtaaaat

SEQ ID NO: 80129 - DNA, 398 bp, Triticum aestivum
  unsure (1)..(398): unsure at all n locations
  Clone ID: PAT_TA_80129
gcacgagggttaaagaaaagtcacaccttctcacgtccttccttccatccgagttccccaagttcttgaatctcacaagggatcgctgaagcatccagaatctcggggattctgtgcaagtaggtgtcagttccatcattggattgccatgctatgttctgctgtggagaatagagtggcgaggtgttaatccatctgatgatcacatggatttgttgaggagatggtcctatgagttgctgaagttcagatttcgtgtgtgttctatctacttgctgtgtcagtcttgttcgtttgcaaacttgtatgggaccccagtttcgttgggcgctaagagatatgggcttctgtagtttgatcaacttgataatggtgttttgaacttttattttcaaann

SEQ ID NO: 80130 - DNA, 638 bp, Triticum aestivum
  unsure (1)..(638): unsure at all n locations
  Clone ID: PAT_TA_80130
ttccaatctaatcgctggttctccgcccacaacgaacctagccagagatcgtcggagatggcgaccttccgcgtcgcggacgcgtcggagtacctggccatcaccggctggggcatcgacgacgtcaagctcgccaagaaggcgtgggtcttcgtggggcagcagtgcaagaagttcagcatctcgccggtcaactacgagttcgaggtgcacgccatgagcgccgagaagctgcccttcatcctccccgccgtcttcaccatcggccccaagatcaccgccaccggggcagaggcgtcagacaagagggaccttgaggcgcagctcctcctctacgccaagctcatcgccccgctgcacaggtcgaggagccacgtccacgagctcgtcaaggggatcatcgagggcgagacccgcgtgctcgccgccgacctcaccatggaggagatcttcaaggggaccaagaccttcaaagagaaggtcttcaacagggtgcagctggagcttaatcagttcggactcgtcatctacaacgccaacgtgaagcagctggtggatgtgccggggcacgagtacttctcctacctcgggcagangnnncagcnnnntgccgcgaannnnncnnnnnnngacgtgga

SEQ ID NO: 80131 - DNA, 234 bp, Triticum aestivum
  unsure (1)..(234): unsure at all n locations
  Clone ID: PAT_TA_80131
ctttcttttttttccttttctctttttgtcatcctgttgtttcccattcttcggctgctatgcatggcaccccacgcttttgttcctccacatttgttataaagatacttgctcttcctcccgtcctctcctcctcttcctcttcctctttctgcttccgctgcttcgcttgttttgcttccctttattccttttnccccaanatcgtcttcccagcccccanggcccccaccc

SEQ ID NO: 80132 - DNA, 621 bp, Triticum aestivum
  unsure (1)..(621): unsure at all n locations
  Clone ID: PAT_TA_80132
gcacgagggaaccgaggcaacgagggatcgcgcgagaaaaattcagaggaaatcggcagcgatcgagaggcgcggcgatgttcttcttcttcgtaggcggcgtggagcagggcgcggggcgggtgctcaaggaggcggccgggcggtgcgtgcgctgcggcggcgcggccgacctggtggagaccgagaaggtgctcaagctcttcttcgtccccgcgtggcggtggccgggcaaggaccccgcctacctctgccgcgactgcggcctcctcgcgccggggtcccacggcgccggcggcggggagctcctcccccgcgcgggggcggggcaatgcggcgcgtgcagccgcgccgtcgacccgcagttccgcttctgccccttctgcggctccgcgctgtgaaggcgccatggatggatgcgcgttgcaggccacggcccagagaggagcagaggtgatgatcctctctctctctctctgaactctcaagacagtagtagtactagggttgtgcagcagagttgtcagttagcttctggttctgnnnaagttgtgctaacctgtgtggatgtaaannnggtgaaatgtttgtaataaacgagncngatnnnnttcgtcgcaa

SEQ ID NO: 80133 - DNA, 572 bp, Triticum aestivum
  unsure (1)..(572): unsure at all n locations
  Clone ID: PAT_TA_80133
gccatataatctgccgggatgaccgacggcggcgaccccggcgtctgcgacgagtgcgtcgaggcgtgctggctggcgtgctgctgcgccttttttcctggacgccatcggcggcaaggcgctcacccgcgtcgcctgcgcgctcgtcgccttcgccgtcctcgccgtcggggtcacgctgctcgcccgccaccacgtctaccgcccgcccctcggcgtcaccgtcgaggacgccgccctcgcccgcctcgccctcgccgaccgcaacgccacggccaccgcgctcgcctacgacgtctcgctcgccgtcgccctgcacaaccaccactggctcaggcgcgccctgcacaccgcgccgctcgacgccgagctgctcttcgccggtgcgcgcttcgcccgcgtcgagctggccnnnnnnggggnnngcggtccgggcggggaactcggaggcgtaccgcgccgtggccgcggccgacagggcgggcgtcgcgctcgggagcgcgggggtggccgagttcgtcagggagannancgcnnngggtgttccggctggannnncaagttgtcggaga

SEQ ID NO: 80134 - DNA, 650 bp, Triticum aestivum
  unsure (1)..(650): unsure at all n locations
  Clone ID: PAT_TA_80134
taaaaatccagaataaacagattattcagaccgtgtacataggaggagtcacactggcgtaggccagccttgcttactcacaagtcagtcccgtcactccctgtcgcgcgcgagagaccagatcgccatggacatggcacgctacgttgcgttccaccagcagtggatcgcgggccagcaggcgggcctccgcgagctcgcggaggcggcagccaatgccgccgccgagcgcgccacggacgcggagctgagggccgtggtggagaggtgcatgcgcgggtaccaggagtacgccgccagccggcgtgccatggcgcgcgagaacggtgcggccttcgtcgccccgccgtggtgcacggcgtttgagaactccgtgctctggctcgggggctgccggccgtcgctggcaatccggctgctctactccatctccggcgaaggcctggaggaggacatcgaggagttcgtcagcggccgcggtcgcggcctcgcagnnnagatgggcctcatcgggatcacggccacgcagctgcagcagatcaatgatctccaccgctgcacgctgcgcgacgagggttacctgacggagcgcctcgcgagtctgcaggagaacatcgccgaccggccgctgcttccgatcgtncnnnann

SEQ ID NO: 80135 - DNA, 630 bp, Triticum aestivum
  unsure (1)..(630): unsure at all n locations
  Clone ID: PAT_TA_80135
gcacgaggctttctagcaaaggtatgtactattgttcaggtggtcttattctgatggctcaactgattgagtcacagctccgctttctcaggtcagcccaaaggcttggagtgagctattcagtattttgtttttttacttattaatcttcgatggtgtttatactattctatgaatagcttctggaattgaggtttaatattttaaaatgtactgagtaataataacaagccagttctcatggcagctttaaccctttgtcattggtctgagtaccctgagtaagaaagaaagcttttcctgtctaatccgtgatctgtcccttttggtgtggagcatattcctccacttgtttcatcaattggaatcctggtacatggcatgattatttctttcctagaaacgagttgaaatgaaatgagtagttagaatcactatttcagatgatccatctctgcttttcttggggatgcgtgttttgtatccttgcggctggatctattattctgatgcattagcacagcacctggagcggtgctgttcatcatgcaacgcttctttttcagtggctcagccatcggggatgccaatgacacagaaaaagcagctgcatacagatccannnagncn

SEQ ID NO: 80136 - DNA, 535 bp, Triticum aestivum
  unsure (1)..(535): unsure at all n locations
  Clone ID: PAT_TA_80136
gcacgaggggacgcgaaggcggcgctgccgccgacgtcgactcaggagcagcagaagcaggaggaaggaggcggtggagacggaagctacggcgtgctcctgtactacaagtacgccgatgtccccgacgcccccgcgctcgcggccttctacgagtcccgctgccgcgctctcgcgctcgtcggccgcgtccgcgtcggccccgacggcgtcaatgccacggtgagcatccgcctctttctagttctccccccgctaacggcgccgtgttttgcggattcccgtatgtatcgtggtgggtacttgaattcgtggcgacgttttgcgctggtagctcgggggaagaatggcggcgctggagaagcacatcgaggagatgagctcgaacagcctgttcgacgggaccgacttcaagctggcctcctgcgaggaccctatcgacgaganngtcgccagggagtgcggcttcacgtcactctcggttcggctcgtcnnnagctggttacgcnnngttccaacccatcgctgacaacgc

SEQ ID NO: 80137 - DNA, 525 bp, Triticum aestivum
  unsure (1)..(525): unsure at all n locations
  Clone ID: PAT_TA_80137
cgcgcctgcagccatggccacttcgtcgtcgagcagctggctgcgcgtgctcctcctcgccgccgccgtcacggtggtggccgcgaggcaccaccaccccgggttcgagaagatcttcgaggtgcaggaggcggaccgggtggagatgctgccggggcagacggagcaggtgggcttccggcacttctccggctacgtgacggtgaacgagacccacggccgcgccctcttctactggctctacgaggccacccacgacgtcgccaagaagcccctcgtcctctggctcaacggaggacctggatgctcgtccgtggggtacggagcgatgatggagcttggccccttcttgatccanaanggaaagcccgagattgccttgaatccccactcatggaacaaagaggccaacatgctgttcttggagtcccctgccggcgttggcttctcctacaccaacaccaccgccgatctcggccagttcggcgacaacctcaccnnncatgacgcgtactcnnncctcgt

SEQ ID NO: 80138 - DNA, 665 bp, Triticum aestivum
  unsure (1)..(665): unsure at all n locations
  Clone ID: PAT_TA_80138
aagttgtttgccatgttctgccgcaaaaaaccagatatcaaatactatgtctgcaccatcaacaaaacattcacaaagccatgcaaacggatggtaaactccttccttccacttcattgaaaaaagaatcatctttacttatacctcacaactaaactacttacttgactaatcatcagaagtacaacatgcggtatgcttttgattcaccaaattgactttattgcgaaatattgaaaaaactgtatacactgctattagcaccagcacaacaattctcatcaacttgctacgtgtaactttagaaactaatattcatatagtctgatatacatgttttctttctaccatacatacagaaacaaccgatttacatcttatgctccacgtaagaaggaatgtagcatgctctgcacccttcttttgctttctgccattatttactgataactgttctcactatctatatttaaaccttcttagtgtaagagtgacaagacactctccaatccattcaattaattccttttttctcaccagtattttcaggtcaactacaacgaaagcaaactaaaagattacatgacccagnnnatgatacgctcaacgtcnnnnntgcaaacagtgttctacacgccaattgtcgcatcatgctnnnnaccgnn

SEQ ID NO: 80139 - DNA, 639 bp, Triticum aestivum
  unsure (1)..(639): unsure at all n locations
  Clone ID: PAT_TA_80139
ttcggcacgaggctgactttgcccgagggctcgccgccgccgttctccctcaccggcaacgacatgaacgtgacgttctacctcagatgccccttcaacgcatctccttcgcacatggtggcttgcctggaggaggccgatggcgtgcaccatacgtacgcattcaaggacggcgactaccttcttccgtacgagttcaacagcctctgccaggacgtcgtggggatgccggtgctcaggtcgtcgctggggggcagcaggtggatccaccgcgttttccgggctctgcggagaggcttcgaactgaggtggacgcgggcgctggaagggaggtgcagagactgcgagaactncggtggcctctgcggccaccttggcgacgcgccgtaccagttcacatgctttacggcgcctgctgcccctgcccctgcccctgcactgccactgagcctttgagcaatgagcgtcagagagacctatgcgtcgcgctagttcttaatttacaccatcatatactcgctccgtatgagctacgatacttgattcgctatagtttctcacaagtcacaatatataagttgactgaatttgtaattttctaatttgggtaagtcaagtctgcgtgannnnnnacgnnnn

SEQ ID NO: 80140 - DNA, 597 bp, Triticum aestivum
  unsure (1)..(597): unsure at all n locations
  Clone ID: PAT_TA_80140
aatatttcttatcacaatttagcttcagtagagtacatttgcttagttccagtattgtcggaattactatctatcggaaagtgcatatttactaggcagtgtgagttgtgtcaccatcaaattttttttcctttgctcgaggacaagcaaagatttaagtgtgggggaacttgataagcacatttcttatatactatttgggcacacaaattcaccttttattgagatatatccatccattcttgctatgacttgttgaatatttgaatgataaccataaaagagaatgttgactagtgaattgtttattttgcagaaaagtgcgcaaatgcactataatcgtcaagacttctactatgtggctaacgagaagagagaagggcatgaaagaaatacgtcaaggcttgagcgtgaaggaaagaagtaatgtnnnngagcaaactaaaagaagnnnaggatcttcttgggaagaaagaagaaaggaggagggccaaagtaaaaaaagacaaaacagnnnnnnnnatcaaaaatccctagcgcagccgatccccatcngnncnngcatctcnccnnnnnccctcncncctccttcnnnan

SEQ ID NO: 80141 - DNA, 549 bp, Triticum aestivum
  Clone ID: PAT_TA_80141
gcaaatgtgactgatcagggtatccaactgatcaaggcacctaagggcgtgtttgatttcttgtgtggcacctgcctcgcacccgcatgcaaaatctactacgtttggtggcctgtgcggcctcctcagcttgacccaacatatacaaaagaggcctctcagccaggctgaggggcacgcaggaatcggccgtatctccaagccaggctcgcgtctgcagccgcaactctcgtcccgtgtctccttttcctcctcctctctcacatatcagattggattgtgtaatccattgccgctgccgttgcctgagatccctcgtccacaccagtccggcctctctagtaggcgctcctccacgtccacgctgagggacacgccgcccgccgccgatcgagctccgtcgccggtgctcctccatgcccacgctgggacacgtcgtccgccaccagtccgggctccctagccagtgctcctccacgcccacgcatgggacacgccgcttgccgccggctgagctccgtcaccgatgctcctccatgcccacgtcgg

SEQ ID NO: 80142 - DNA, 293 bp, Triticum aestivum
  unsure (1)..(293): unsure at all n locations
  Clone ID: PAT_TA_80142
ctattgggcactagtaactttgagatgtaaggagtttgctgcagtttgtagcttctcctcagtttcctttgaagccattgcagcttgtaacagggaaatgtagggaaaatataggctacggcctgaaagattaaatggggataaaattctggtcaccagtgtgttccactccttttgttccccacattctttagatgcgactttacgacgactcggtattgaatgtttttgtgttgttgggtactgtcagaaatgataccgtgtgatcagaactatagagttcttgccaagnn

SEQ ID NO: 80143 - DNA, 270 bp, Triticum aestivum
  Clone ID: PAT_TA_80143
cgaggaaagaattagccccacacgcgcgggcgcggctagaccacgagcagctcgtggttcaccgatcagtggcacacgatggtctcgaagcagtcgatcccatcgaactccggcgcgaaccgcggccgcagcgttggcggcgactgtgatttcctcgttcgatcaccgtacgatcggcgtgttcatttgttgttaacttgtgcttctaactgaagccgcctgttgtacttgtacagcatacaaagctagaaagaaaccaatttcgccgtg

SEQ ID NO: 80144 - DNA, 642 bp, Triticum aestivum
  unsure (1)..(642): unsure at all n locations
  Clone ID: PAT_TA_80144
gcacgaggaaaatgccgagtccagaaactcttatcagcgagcacatccttctcttccaagtagtgcggcaagtaagttccatgactactgcacaaaaaatgtcgattccagatactcttatcagggagcacatccttctctttcaactagtgtggcaagtaagtctatttgggcaagtaagtctactcgcgatgttctgaatatagatggcaggaagggtgtttccctagttgatgaaagaagcaagagaccaggttgtgcagataatgtttcacagcaacctgcaaagaggcagcttgttgcagacaaaccggagttaacaagttcgatgttcccatgcatggagaaatactcgtttggctggtcagtaaatgatacagttggcccgcggatgcttgacttcagtaacaaaaatagcaggacatgccacacaaatatcaaaaaatgaaaaaacaataacttaggggggatgccagttccagttgttgaagcaagatcaaggactgtaagcatgtttgcaggagctaaaagcacgctaaagaacgatcattcaaagatgccacattccactaaattttcagttggtaatagtggaatgtcagaaagaacnntngagtgttcctgttccacttattattnnnn

SEQ ID NO: 80145 - DNA, 659 bp, Triticum aestivum
  unsure (1)..(659): unsure at all n locations
  Clone ID: PAT_TA_80145
cctcgtgccgctagcttccacgcaccatgtccctcctccacgtccggctcgccgccgcggcgatcgccgtcgtcgcgctcgtggccggcggggacgcctaccagctcaccaaaccaggcaccgtcatctcgtacgaccgccgctcgctcatggtggacggacagagggacatcttcttctccggctccatccactatccacgcagccctttccacgagtggcccgacctcatcgccagggccaaggaaggcggcctcaacgtcatcgagtcctacgtcttctggaacgtccatgaacccgagatgggcgtgtacaacttcgaggggaggtacgacatgatcaagttcttcaagctgatccaggagcatgagatgtacgccatggtccgtatcgggccctttgtccaggcggagtggaaccatggagggctgccttactggctccgggaggtccccgacatcatattccgcacagacaatgagcctttcaagaagctcatgcagaagtttgtcactctcgtagtgaacaagctcaannannccaagctcttcgcatcacaannnnnccctatcattctagcgcagatcgagaatgagtaccagcacatgggaagcggcgttcaaagaaaacggcaccaggtacatcgaatgggcagctaa

SEQ ID NO: 80146 - DNA, 594 bp, Triticum aestivum
  unsure (1)..(594): unsure at all n locations
  Clone ID: PAT_TA_80146
cctcgtgccgaattcggcacgaggaccccagcgagcgacgcaggaggaaaccccacccccacgtcaccgccatggacgtcacccccgtcgccacacgcctccgccgctccacccccgagcacgacgcctacaccgtccgcgtcgccgaccgccgcctcgtcgccctcgccaccggcaatccggccgacgcgcgccgctggatctacaccacccgctggctccaccaggccctcctccgctccgaccgcctcatcgtcggcctcggcgtccagtggacccccgtccgcggccgcggggaagggccgcaggcgccgccgccggccaccctgcagctctgcgcgggccaccgctgccttgtcttccacctcgcccaggtcgacgccgaagccgtccccgccgtgctctaccgcttcctcgccgacccgcgcgtcgtcttcgtggggtacggctcctcgtacgaccgccggatgctgtgggatcactacggcctggacgtcgcgtcttcgtgcgacctgcgcgcgctcaccggcatggggaacgccnnngtcgagctaatggcgcagcgcttcctcggctaccnnnggatcagcaagc

SEQ ID NO: 80147 - DNA, 540 bp, Triticum aestivum
  unsure (1)..(540): unsure at all n locations
  Clone ID: PAT_TA_80147
gcacgagggtccctcgcgtcgctctcgcgggcggcggcgggggaaccctagcctccactccgcgcccgcctcctacaccatcccctcccctcgccgccgccagaacgaagcccggtgcgcgtcggcggcggcggggcctttcttctcctcccggcgtgcggctgtagcgcgagatgcagcggcgcggcggagtcttggtgctgatgcagagagggcacgtcgggcggcgcgagcgggcggccaggctgtggcatctacgcgtggggttggctccggggcggcggcacgggcacggatccatcgcggatctggtcctgcgggcgcggtctcggcctttcctgctcggccggccggtttcggtggggggacttctccttgctgttatctggccgcggtggcctggatcattcagatcccggcagngnnnggcggcggcccgtgcacgagagatggaggtcttcgaacagatctgggtgaaaacctactattggctattgnnnaagccggcgacggcgacgctctnnngcgtcgttcccttcc

SEQ ID NO: 80148 - DNA, 597 bp, Triticum aestivum
  unsure (1)..(597): unsure at all n locations
  Clone ID: PAT_TA_80148
gcacgaggcttcttgatcctccggaagaggtcagtgctgaatatgacgagcctttaagaatagaactccttcagcttgccacattacttctgaagtatcttcagaatgaccttgttcaccatcgaaaggaactcataaagtttggctggaaccatcttaaacgtgaagacaattccagcaaacagtgggcctttgtgaacgtgtgccatttcttagaggcatatcaagcccctgaaaagataattctacaggtttttattgctctattacggacatgccaaccagaaaataagttgctagtgaagcaagctcttgatatccttatgcctgctctgcctagaagactccctcctggggatactcgcatgccaatatggatcagatacacgaagaaaatccttgtggaggaaggccattctattcccaacatgattcacatattccagctaattgttcgccatgcagaactgttctatagttgcagagcacattttgttccccagatggttaactctcttagtcgtcttggattaccatacaacacaactgctgannnncgacgtcttgcaatcgaacttgctggattggtagtggcgt

SEQ ID NO: 80149 - DNA, 290 bp, Triticum aestivum
  unsure (1)..(290): unsure at all n locations
  Clone ID: PAT_TA_80149
gcacgaggcctggacgcctgcaacgccatcgccgcccgcgtcgaccgcctccgccgccgccgcctgctctcccgcctcgcgctccacctcgtctcctcgacgcccccgnncccgtcgtccctcagccgcgcgcgtgccgcgctcgccgatcgcganngccgcggcgcggggggcactccctcttctgctctgccagcgctcccttccatcccgttcgtcgnnncgccccgcgnnnnnnnngggcagcagctcaccnnngncgcgcggntcgnnntcgccnnnaacgnnnn

SEQ ID NO: 80150 - DNA, 630 bp, Triticum aestivum
  unsure (1)..(630): unsure at all n locations
  Clone ID: PAT_TA_80150
cgggattattatgattcatggtactatgggcaagcattttgtagctttgatgatcaacatggttatcttagtcatcctgaaggagttcaagaccctgatgttgagaccactttgggacacataccacacaatacaagaaagcttgcaaggccaagttctgatgagtatgatagaatgttcttcaattccagcttcatcggctcagcagcagatgatgtgtttcctcgtcagcatactgagacaagacacacttcaaagagaagacctgagaagagaaaaggtgccaagagcaggaagggtcgcactaagaggcgtcggggtcttgaacccgcgagtggtttccaaggcattgaatcaagatccactcattacaggcaagagttcttgatggaggagtgtgctcagtctgttgtctgtgctaccttcagggggcagaagaagaaacgtagaggaaaacagcacaatgtaatttctgctagatcttctgaacatcctaccacagattttactgggccaaagaccctagctcagataaaagaagngaattgtgtatctaagtcacgctttanccactctgctgctcgcatgcctcatgggggnnnctttctcaaatgattttgaaggcccnnn

SEQ ID NO: 80151 - DNA, 623 bp, Triticum aestivum
  unsure (1)..(623): unsure at all n locations
  Clone ID: PAT_TA_80151
cgcaagtgccacgcaatccggggtcgtagatcgttttgtgtctgctcctccgccactcgtctccaccagggcacccggccggctcctctgatcgccggccgcctctgatcgccgccttgcctcccgccggccgccgctcgaccgcaccgccggatcatccgccaaggtacaggcgcaaccgacctggcctcccggaccctctctggctccggctgctgctccatcgtgcatgcgtcgcagacggagaaggaagaaggacgaggcggccaccacaaagccatgaagaacgcatggcaggcaaactccggcatgagcacaatcagcagggagccggtgctgtccaagaccacggagaggggggagaatgacaggctcgagtacgccgtgtcgtccatgcaaggttaccgtgccaacatggaagatgctcatgcagctgttggagatcttgatgtttccaccgccacatcgttctttggtgtttatgatggccatggaggacctgctgtatcgatgttctgtgcgaaacacttccatcttgnnntccagaagcatccacacttcaatgacagtcttcgtattgcggtggagagcgcgttcttcagaatggatcagatgatgatgan

SEQ ID NO: 80152 - DNA, 617 bp, Triticum aestivum
  unsure (1)..(617): unsure at all n locations
  Clone ID: PAT_TA_80152
gcacgaggcctcgtgccgaattcggcacgagggtcgtttgtcttctcggcatcgaagattttggcgccgctcgtgcgcaagtctggcggcggcaggaagaannggccgcggcgacaacaaggcatcgtgagcacgctccgcgggagccagcaggccattgagccgccgcagaaggttgtcaagacgtacgcctcggtcaccgccggcgagacctcccgctcctccatccagtccgggtcatcggccaggccgtgctgcacgttcttcacctcgccggcgaaggccactcccgcgaatggcgagacatcccgctcctctggcaagcaggaggccaggaaggcctgcagtgaggcgtccagctcgacttcgccatgcgggtcgggctccacgttcgtcccagcgccggcgaagcattcgtcagctgggaaggcgagcaagcagcatcgggaggtggaagtatccagcgttgccacaccagccgcgccagcagcagcctgcaccggcgccgaagtggtggtgcgcgtgacctgcgcttgtggtgtnnnannnagttctgctttgaccaccgccactgaataatcctgnnncnctgtttttgctttatcgacngatcnnnn

SEQ ID NO: 80153 - DNA, 593 bp, Triticum aestivum
  unsure (1)..(593): unsure at all n locations
  Clone ID: PAT_TA_80153
gcacgaggccagcgcctcccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcacgcgcagnnnatcctcgccatctgggcctgccnnntggtgctcatgggcgccgtggnnngctaccgnn

SEQ ID NO: 80154 - DNA, 621 bp, Triticum aestivum
  unsure (1)..(621): unsure at all n locations
  Clone ID: PAT_TA_80154
cttttatatttgtctcatgcaagcttataatcgctcaaagacaagacgagaagagcaagaagagaagcatatgacgcagatggaggagctcgtgcaccagtgcgacatggaggtcatgaagatggccatgctcaagcacgagcagacattcaggcagcaggtgcatgatctacaccggctgtaccgagtccagaagcagctcatgggcgaccagagcgggcgcccgtcggtgccaccctgccatcaggtgcagcggcgcagggagcacccccgccggccggagctgagcctgcagctccctgtcgacgacgacgagtacgccgtcgtcagcggcggcacaggccgcctagcgacgccgccgtccatggagagcgaggacgagctggagctgacgctggccgtcggcggcggcggcgggaacggcggcagcagccggagccagaggaggaggcgggagagtgcgacggactgctccggcagaagaagcccacagacgccgtcttcgtcgaccgactccgacgacgcgctccgcacggtgccgcaccaccagnnngcgacggcgtgtgatctccggggagnggnngatggtgtnnnnncagccgcaatggctggtgcgctgtc

SEQ ID NO: 80155 - DNA, 622 bp, Triticum aestivum
  unsure (1)..(622): unsure at all n locations
  Clone ID: PAT_TA_80155
gcacgaggctctctcgccttccaacgaaaccctaatcctcgtccccgtcgtctcccatgccgccccctggaagtcgcggacgcggacgccacggccggcccagcctacctgcggagcagcgtcaggatcactttgcccgggacggcgcaccacagacccgtgccacgggcaggccgttatggggagtctctgggtctggccgcgccggccacgcctgcggcagcgccgaccatggcctctcccgccctggccgctccgaaggacgctcccgccgtcggcttggctctgcaccgtgtcaggaacatggacctgcacaattgcgacgagaaccgtctgtctcgcacttaaataagttgctgagcactacaacatttatggaatcctcgactcttgggtcgccaattctggcccggacacctactgattggccgatgaccttctatatcagaattgatcgcagggggtctttccatacatatcctgatgtgggtgggccatttaggaaattgcaagaagttcacaatgctattgatcgctatcttgaggaccgccggcatccaacaatgttcaaggagcaagatgnggnnttctctaatggacattgctatacgagnnnctatgn

SEQ ID NO: 80156 - DNA, 517 bp, Triticum aestivum
  unsure (1)..(517): unsure at all n locations
  Clone ID: PAT_TA_80156
ctctcatcagatcagccacagagtcacacaagcactagcttcagctagccagcctcagccactccgggcattttcttgcatccacgacggcaatggccaccgctgatgtccagaacccgacggccgcgctgacggaggaggcgcccgcggtggagacgccggtggccgccgaggaggccccgaagacggaggaggtccccgcgccggcggaggccgaggtcgaggcgtctgcccccgtcgaggttgaggcgaccaaggaggaggcgccgggcgccgctgagacggaggaggccaaggagaccgagccagcagctgcggccgagccggaggccgaggcgcccaaagagccagaggcgccagccgtggtcgagacagagaccaaggaggccgtggcagaggccgagccggcggtggtcgaggaggtgaaggaggaggccgcgcctgctgccgagccagaagcaccggccgtcgccgnnnnngcaccggctgcagcgnnnnnnnnnnnngnggccgtgnn

SEQ ID NO: 80157 - DNA, 645 bp, Triticum aestivum
  unsure (1)..(645): unsure at all n locations
  Clone ID: PAT_TA_80157
ttcagacttcaaaatattgcttgctgtttctgatgctgtcattctttaacgagaaaaacaatggtttttttttaggctaagaagattggtaggtccaacggtggtttgtagtaaatgggcttgccggtccacattagaccagaatcttggctgagacggcccacatcgtgtatctccttctgtcccgtcataacgacatttgacttgtgggccttgtacctgtacaaatacctctggtcgcaccgatcgcgagatgaagtagtggtatagattccaggattactgcagctcgggctcacatgggcattttcccttttgcttgccctaaattttactccacacacactttggtgccctaaaatagagaagctattggagatgctctcatcctggcacggtcttaaaagagtagggataggacgttgttttttcaaacacatttcgtcattatgcatgactacaaaggcaaatttcgagataataaatgtagaaaggttgaaggagtatacagttaaggannnnntgtcttcactgtagctatgatggagtcacggagatcaagctacgtgtagctatattagctctggtggannnccaacttgccgctgcgccgtcgnnnnnnnnggtctgtcgctancnnnnnnn

SEQ ID NO: 80158 - DNA, 400 bp, Triticum aestivum
  unsure (1)..(400): unsure at all n locations
  Clone ID: PAT_TA_80158
aaaaaaaaaaaaaaacaataaaaaagacnagggaggccaaaaacaaaaaaacaaacggcccttacacaaaaaaacacaacgggggggggcaccacacccaccgcatctgcaaaaccaaataacaaaaacaaacaaaaataaccaaaccaaataaaaaaaacgaagcagaggcggggggaaaggcggctcagggaggggaggtgatgttggctaccaccgggttgatcactctggcaccggggggcgggggggcgcccgggcaaatgcaaaaagagttgggtagctatgcgttggaaaaaatatgctatttcatcggcgtggaacctactaaannncncaaaaatggggtggcctgagctggggtcctgggcggccgatgnnagccaaatcagnnannaaa

SEQ ID NO: 80159 - DNA, 545 bp, Triticum aestivum
  Clone ID: PAT_TA_80159
gcacgaggattttagtagtagctagctccgcaagtaagagttgtgggaaactgaactcttctcccatgtccccagacactcatttcttcacgagttcagttttctccaacatcttatcttcaacgctgtctggccctcgcaacttggaaaattttggcagatgaatttgagtgttggatgggaccaaatcttaccgccgggtgtggcaagatttggtttcctccaatatcttatgttcatatgtcagacactgagtgttagctacaacaagtgatagttggatggacacctgggcctgtctcaagaaccaaacctcgcaagctgaatgtgagatttggatggaaccaaatcttcagctatagtgacacaagatttggtttcctccaatatctcgtcttcaactgtccctgatgaaacctacagcatcttcagttgagctataggtgaacctgaattcctttggtctttggtcacccgagtcataaacttatttccctttgtcttttaaaaaatagattcaaactgcgcaaaacaaaaaaaaaaaa

SEQ ID NO: 80160 - DNA, 238 bp, Triticum aestivum
  unsure (1)..(238): unsure at all n locations
  Clone ID: PAT_TA_80160
aaaaaaaaaaccccccccggcccaacccccttttattttatattccccccaccaaacaaaaacccccagggttnnacgggacctaacccctaggaaccacctcctccccccccaaaaaaaaagggaaccccacngaattacccccctaattcnannnnnncataatccatcgggccaggccccgaccaggggacggntannncgggggggccttggggcccaccccttccccggggcc

SEQ ID NO: 80161 - DNA, 627 bp, Triticum aestivum
  unsure (1)..(627): unsure at all n locations
  Clone ID: PAT_TA_80161
ctcgccgacctgctcgcgctccacgcagtcctcgacttcctcgaccaggagaggctcgacgcgctgcgccagggccgaacgggcgacggatccatcgtcacgacgatgctccaggggaccggagccggcgcgcggggccgcggcgtcgggttcgtccgcgtgtccggaggcgacaccagccgcatcacgttctcctctggcgcgccgggcgggggcgcgcgacgcaactccacgcttgtcaaggtggtcacctcgcaggcgttcagcgtgctggtgctccaggtgagcgacctcatcctcccgcctggcatcgtcgcgcccgcacccggaccgcagatcccgagggctaggcacatgtcgctgcctcccaccccggccccagcgccgatgcagcaggtcccgtccccgggcatgccggagcctgaaccggaagtgccggacaccacgccgccgccatctacggtcatcccgataccaagtgtgcacggcggcgtggcggccaagataccagaagccgcggccggacgcggagcggtggggagctggtggagcggtgccggtgcggcgttggggatcatggcctgcctgcttggacgtttgtatgactnnngcagtttttgctnnnnn

SEQ ID NO: 80162 - DNA, 619 bp, Triticum aestivum
  unsure (1)..(619): unsure at all n locations
  Clone ID: PAT_TA_80162
gcacgagggccgctcttcctccgcctgtcccggaggccttactcgacgccctccaccgaacagccgccgcactcgtcccgccctcagcgccgcacctccaccgccatttccgctggctcatcgccgacgcctccgccccttccccgtccagcggcgacccggcggcgcgctacctcctccccgcgccgctcgggaacgagaactggaaggacctggtggtcgccgtccgggatggcgtgctcatcccgcggcccgagacggaggccgtcgtggagggcagctcccgccgtgtcctcgcctaccctgccctccgcgccgccgtgatctattgcaccgccgtgctccccgacgtgcccgcagccgtgggcccccatccgccgccgccgttcgcgggcctccgggcgaggtccatggccaccttcacccgcacgtaaggaaagttgacatgcttaacggtgtgacaatcccacggtccgagaaagtaaaggatgagatcgtcctcgatggcaacggcatcgagctcgtctatcactctgctgcccttatcaaccaggtactggcggaggccgggagcgccannntggtggcgttcgacgagatcgaccttagtgcttgctgc

SEQ ID NO: 80163 - DNA, 588 bp, Triticum aestivum
  unsure (1)..(588): unsure at all n locations
  Clone ID: PAT_TA_80163
gcacgaggccgctcagacgcaccctcctcctcctccccgtgtactaaactcacgctacctgcacggacgccggcgttcaaacttccaaggtgctccacttctcacctgatcatcatcctcatggacgccatgtcgtgcctagcgccgccgccggcggcggcgtcgttcctctcggcctcctcctcgctcggccctgcctactacaccgacgccgccctcgcgcgcgcgctcaacttctccgccatgcccgactacgagtacgactactcgccggccgcatcctcgccctccaactccgcctccgcctccgcgctctcctcgtcgtcccttctcgcggacttcccctgcagcgcgggcggcagcaactggttcgcctccacgtccgcgccgcccacgggctcgctctcctgcgactccgtgctggtcgcgtcggacgcggcgccgcggccgccgtccacccccgtgggcgccgcgacgaacaagaggcgggcgggcctggggccgaacacagcgggcgccgggcgggccgggaagcggcgcgcgcgggcgtcannnngcgcgcngancacgtacatcnnnaccgacccc

SEQ ID NO: 80164 - DNA, 597 bp, Triticum aestivum
  unsure (1)..(597): unsure at all n locations
  Clone ID: PAT_TA_80164
cggtaggctgcgcggaccgtgctgcgcccgcgccgcgttagcgctagtcccttgtcccctgcctcctcgggttgcggcaccgccggccgcgcgcgcgtccccggccggcctcatctcccctctccggccggtcgttccgttgcgcctctgctggccgcgctctctcccgtcccggccatgggtccgtgatgcggtcccatacatttggtggtgtggtggcttctcgcgttccgtgaggcgcacgcggggacgggaggaggagccgggcgctcggttggctcggcgcggcgagatggtgcaggagccgagcaacagcagcagccaccacctgcagcagcagctggccaagtacggcggcgggaccgggaccggcaacggcaacggcgcggccaccggcgtggcgcgggcgtcgaggaagaacaagcccaagaagatcccgcagcgcggcctcggcgtggcgcagctcgagaagctccgcatcgaggagcagannnnnntgggaggaggcccctccgcggccacgccgtcgtcgcacgcgctcaacggcnnggnnnctatgccaccnnnccacgnnngccctgctccatcatccgccgc

SEQ ID NO: 80165 - DNA, 633 bp, Triticum aestivum
  unsure (1)..(633): unsure at all n locations
  Clone ID: PAT_TA_80165
gcacgaggtgcaaaagcggcatcacactcgcctatttcctgaaaatcatcgtgcgcgggatctgacggatagaagtgggaatatcctacctggtactgttgtcgacacaaagatctgccatcctacagagtttgatttttacctctgcagccatgctggtattcggggaacaagccgcccgacacactatcacgttcttctcgacgaaaaccgtttcagtgctgatgccctgcaaaccttgacctacaatctctgctacacctacgcccggtgcacgcgatcggtctctatagttcctccggcgtactacgcgcacctggcggccttccgtgcgcgctactacatgcaggacgagttctccgacgggggctcgtcgtcggccacggccaggttggcgcctacgaggcagctccccaagatcagggacagtgtcaaggagttcatgttctactgctgatggctgatcccttgcttgcgagaagtagtggtgtccacaccttttgcttggctgtgctgctgatggcctgctcgaaccacagcagtctcatcgttgccgtttgtggtttatgtatggaacttgtcatggtttggtnnnncgtgttgcctgcaagaacnnnnnccttcggttagcnn

SEQ ID NO: 80166 - DNA, 597 bp, Triticum aestivum
  unsure (1)..(597): unsure at all n locations
  Clone ID: PAT_TA_80166
ggatgacatggatgctgaatgggcacatggtagttttcctttggaggagtacattaaagccctagaccgtgctaaaggtgaactgtactataatcattcacttggtatgcaatacagcaagattactgagcaaatatatgttggatcatgcatacaaacacaaaaggatgtgaagatgttatcagagacggtgggtattactgctgtcctgaatttccaaagtgaaagtgagcgcattaattggggaataaattctgaggcaatcaacgattcttgtcgtcagaacaacatcttgatgattaactaccctatccgagaggttgattccatggacctgagaaagaagcttcctttttgtgttggtcttcttttgcgcctaataaggaagaactaccgtatatatgtgacttgtaccactggatatgatagatcaccagcatgtgtgattgcatatctacattgggttcaagatacacctcttcatattgctcacaagttcatcactgggttgcattcatgtagncctgacagagctgcaattgtttgggcaacttgggatctcattgcattagttgaaaatggaagacatgatggcac

SEQ ID NO: 80167 - DNA, 562 bp, Triticum aestivum
  unsure (1)..(562): unsure at all n locations
  Clone ID: PAT_TA_80167
gcacgaggatcgagcgagcgagaaatccccaatccccaccaaaccctaacccaaaccctaaccctgattgaaacgaccaggagaggagaggagaggagcggatccggcgatggccgtcgagaagatgcacttgtccatgccgttgcccgccggcttggagggtttccccttcaccacgttccaggcggagctggaggccttcaccgtcaagttgagggcggaggcgaagaaggccaaggccaagccggaggtcaaggaggccaaggccaaggaggagaaggccaagccggaggtcaaggccaaggtgaagaaggccaaggcgaaggaggccaagccggaggtcgaggccaaggcaaaggaggccaagccggaggttaaggccaaggcgaaggaggccaaggcgaaggaggccaagccggaggtcgaggccaagtcaaaggaggtcaaggccaanntggagttgaggaccctcaccaannannaggaggaggcgctcatcaagttcgtggcgctgctggagaannnnnnngacttcctcgacgccnnggcgnnnnnngnnnnn

SEQ ID NO: 80168 - DNA, 613 bp, Triticum aestivum
  unsure (1)..(613): unsure at all n locations
  Clone ID: PAT_TA_80168
gtcctcagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaacgaggacaagtacacctcagacgttaacattgtctcaaatgctagctgcaccactaactgccttgctcccctagctaagatcattaatgacaacttcggtattattgnnngtttgatgaccactgttcatgccatcactgc

SEQ ID NO: 80169 - DNA, 314 bp, Triticum aestivum
  unsure (1)..(314): unsure at all n locations
  Clone ID: PAT_TA_80169
gcacgaggattctgtttttggcttgcagtcatcctgagaatagaaccacaatgaccacaattgcagaatggccagaatggattttagaggttttgatttataatcatgagaagggtagtaaaaaatatgtcgatggtgtaagcattggtgagattgaagaccttgtacacaatttcctgattatcatgttggagcattcaatgcgacaaaaagatggatggatgggttatcaagcaggcagggtgctgaaattttaaccttgctgttgagatggtttcatccaatatggtagttgaaagtaaacttaaannnnn

SEQ ID NO: 80170 - DNA, 640 bp, Triticum aestivum
  unsure (1)..(640): unsure at all n locations
  Clone ID: PAT_TA_80170
ccaagtagttaaatttatgtgcaccttctcatgtgtttacttgtttctgcatttatggtatggcttggtcctgttgtggaaaaagatcgtgatatgtttggccattctgttttttcttaatccaatgacctattaatgtgacaattgtttcctcactatcttagattagcagtaatccttcttttatgtttctgcaatttcagttcgtgatgtttgccctttgaaatttcctttgcattctgtatctgcacatcccctcttgtggtctgttgtaatggtctactgaacagccatatcatcctatgattgcatcgttgcattataatgtaccatatgctcatgcatttcttttcttaccgacattgtcctgatgagttggctggcttacatgtagtctgttgtgcaggtctacttgctttnnntagcattgctttctggaatacatcattggaacctggtaacattcactgcttacagtcagcaagaccngaagaacatgattgtgtatgagttcatgcacaacgaaagcatcaccttagctgatgttaaatttgctttgtggaatcaacaacacgctattgtatatacacatatgnnnncnnncgcagcaaaannntgtccgtgcggttgtattnnnnnn

SEQ ID NO: 80171 - DNA, 639 bp, Triticum aestivum
  unsure (1)..(639): unsure at all n locations
  Clone ID: PAT_TA_80171
gcacgaggaaatcaactctgcagctgccacagctcctcccgatccaaaatccatccccatcaatcctgcccgagcacctcgccaccaaccctcgccggccatcggagccctcgccgtccgagaccgacccgcagtcacccggaaccgcgcccattctcttttcttctccctccatttctccctctctctgctcctcaccagtgacgccgccctacaggaaccaccgccgccatgggcgttcaccggagtggagctccttcctcgacgccgagctctccaagccccaagccgcgccggatatggaggggataacccccgccgcgcctcttcccgacccccacgaccttctccggccccgttcccgtcgataggccgccgtagtcgctctggttcggtgtgactagttcgacaaaaacgcctattgctgcacctgcatcgccccattaccgcgtctgcaccgcccggagccgtcgcctcccgccgccgcccttgcctcggatctggcnnnttcccgtggcctctcgccccgctaagttcctctactgctactctgctagcccgccgtcttcgnnntccctctgcatgnncnncagcccgccgtcgctgctcctctgctcccgctgcgtcgnannnnngcag

SEQ ID NO: 80172 - DNA, 428 bp, Triticum aestivum
  unsure (1)..(428): unsure at all n locations
  Clone ID: PAT_TA_80172
gcacgagggggatatgatggctaagaacttgtatgcatatagttgaaaatgaaaaatgttatcaggaagctaagcagcgaagcagtgacaagcatttgctaccaactggcaatcaacacactcaaaggaacacactgcattataaactaactatctagatttcgggaatgggaggcattggcaaagcttcttcgggcgagagccctgcagattagaacctcacaagggaacatcgtgcaccagccaccggcacgctaggtggagcagcctgactgctcgttttctttgacatagtttttttttgcgaggctaaaaaatgatttttagggttgtgccatgccaaattttcttccccaaatgacttttgtgaactaaagggttatttatgaagtctttcctagaaataaccaccaaaagtttattggtnn

SEQ ID NO: 80173 - DNA, 637 bp, Triticum aestivum
  unsure (1)..(637): unsure at all n locations
  Clone ID: PAT_TA_80173
cggcggcgcgcaggcgaatcagcagcggagccaagcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagnnnctgaggttgctgctgctgccacagaggaagcaaagaagagcaacaatgtccagnnnaagcttgagaagcgccagcagggacgtacactggactcgcacattgaggagcagttcagtggtggnnnnntgctggcctgcatttcgtctcgccnnnnnnngngnnnn

SEQ ID NO: 80174 - DNA, 630 bp, Triticum aestivum
  unsure (1)..(630): unsure at all n locations
  Clone ID: PAT_TA_80174
gcacgagggctccctcccctcccccgcacacctctccccatggccccgtcgcccgtcgcccccgccgctccacgcgacggaggccatctctcccctatttccctcttctcccatcccacagggcaagtgcgtggcagagcaaggaaggacgaccgacatctctctcttctccctcgccccgctgcacctcaccacagcctcacgcttccagacgctcgcctcgaaggaggcagccgcctcaaccgtctccacgcccagtggggcgcggggagcgggctgctctcgctgctcgaccgggcgcttaccgtcgaggagcagtactgccgccagcccgcccaggtgcagcgcaagggcatggaggcggaggggtttggcatagaggggatctcgacgggcgggcacgagacctgcgtcactgcgccgtccccattctgtggcagtggttgattcagcaacgatatgtacactgctgacatttttttgtttcaggagcttgagtattatcttcatctaattgcttgtcaagttgctaattggagtcttcagnttcttagtcacattgtnnnncaagtaaatctgatgtgtgacacctttgagttttcacnnnncatcttaaagttgaatctagnn

SEQ ID NO: 80175 - DNA, 587 bp, Triticum aestivum
  unsure (1)..(587): unsure at all n locations
  Clone ID: PAT_TA_80175
cccccctgtctgtccctcctcatgctcaccaccttcagaccagccatggccgcctagctggctaagctaagctctgctagtacaagcctaggtagaagcgaggaggacggtgcaggcatgggctgctgcgtcagcaagaagcgcggcgagccgccgggcgcggccgatggggggaaggccgtcgaggcccgcgacctgccgccgcccgaggaggagaaggtcaaggaggtgctctccgagacgccgcgcgtcaagccgccgcccaggcccaggcgtgtcgccggtggcgctgtggtggcgccgtcggcggagaaggccagggccaaggacggcggcaccgccagggcgaaggacggccgtggtgtcggcggcagggtcggcaggcccgcgcgctccgtcgaggagaagtcggaggccgcgtccgagtcgtcggccgcgaccacggtggccgggcccgagcggtccccgtcgtcgaagccgcccaggtgccggcagggaaggcccgcgcccggtggcgagcccaggcgcgccaggcgggaccgggaccngggcgcgnnnnnncccgnnnngcgcnnnngcgcgtcccc

SEQ ID NO: 80176 - DNA, 375 bp, Triticum aestivum
  unsure (1)..(375): unsure at all n locations
  Clone ID: PAT_TA_80176
gcacgaggcctcgtgccgaattcggcacgagggagagagagagagagagaactagtctcgagttttttttttttttttttttttttttttttttttttttttttttttttttttgggtttaggggggggctttttagattttttggaaatttacccgttccttttccaaaatttaactcctggtgggacctttttggaataacttgcttactngccgaccgttagaaccgcctttgngattaaagccattttttgggggagccctttaattttttggttccttttaacccggccccaaagtttcccttcccaccttttgggccaaattttccaaggggaccgccttcgtttcttccccattggtgggggggtttt

SEQ ID NO: 80177 - DNA, 623 bp, Triticum aestivum
  unsure (1)..(623): unsure at all n locations
  Clone ID: PAT_TA_80177
gcacgagggagagagagagagagagagaactagtcatctcgtactccatacgccaagcatagagtagccatgaagtccgccatggatcgtcccttgctcctcgcagccatagtagcgttgataattattgttcctgcagcgcaagcagacgatggtggctgcgggtccgggaaggcgggtaccaaccaccgcagtgctaattcgctaaagattgccgctttcttctcaatattaatctgcggggcgctcgggtgcggcctgcctgtgatgggacggcgtgtgccttggctgaacgctgatgccgacgccttctttctgatcaaggcgttggcagcaggagttattctttccacgggcttcatccatattcttccagatgcgtttgaagaccttacatcagattgcctaccagtcagcggcccctggaaagaattccccttcgctgggttaggcgccatggtgggagctattggcgccctcatctttgacaccgtcgcaacagcgtacatcacccgcgtgcagttgatcannnnnactgcccatgcagtcgcatgcagcggcagcgtggtcggcgtnnntgnnnnnaatccggctggtgctgcngnnnaaggncgtnnnnnnga

SEQ ID NO: 80178 - DNA, 625 bp, Triticum aestivum
  unsure (1)..(625): unsure at all n locations
  Clone ID: PAT_TA_80178
cgtacccttgctgactacaacatccagaaggagtccacccttcaccttgtcctccgccttcggggaggcatgcagatcttcgtcaagaccctcaccggcaagaccatcacgcttgaggtggagtcttctgacaccatcgacaacgtcaaggccaagatccaggacaaggagggcattcccccggaccagcagcgccttatcttcgcaggcaagcagctggaggatggccgcaccctcgcggactacaacatccagaaggagtccaccctccaccttgtcctgcgtctgcgtggtggcatgcagatcttcgtgaagaccctcaccggcaagaccatcacacttgaggtggagtcgtctgacaccattgacaatgtcaaggccaagatccaggacaaggagggcattcccccggaccagcagcgcctgatcttcgccggcaagcagctggaggatggccgcacccttgcggactacaacattcagaaggagtccaccctccaccttgtgctccgcctccgtggtggtcagtaattgccctggcgttggacctgctggtttatgcttggtcgttcgttgtgtccgtttcatttgaactgtttcattgttcgcatcagtcctatgnnnn

SEQ ID NO: 80179 - DNA, 623 bp, Triticum aestivum
  unsure (1)..(623): unsure at all n locations
  Clone ID: PAT_TA_80179
gcacgaggacagcacacaacacaccagaggcccagacgaagcggcggcagcagcctgcggaagcgagcgagaggagagaagatgctgtcgtcttccacggccccctccctccgcctccaccaccaccaaccggccaggccccaccgccgccgcccgccggccccggcggcctacagccaattccagtcgcccgccgcggcctcccgccgccacctccccgccggggcggccgtccgcgcccgcggctccacaatccgcgccatcgacgccgcccagccgttcgactacgagtcccgcgccgcggggctgctggaggagcggcagcgcctcaagatcgccatcgtcgggttcggcaacttcgggcagttcctggcgcgcaccttcgcgcggcagggccacacgctcctcgcccactcccgctccgaccactcctccctcgccgcctccctcggcgccgcctacttccaggacccgcacgacctctgcgagtgccacccggacgtcgtcctgctcgccacctccatcctctccgccgannccgtgctccgctcgctcccgctccaccgcctccgccgcagcaccctnntncgtcgacgtcctctccgtcnnngagttccccaaga

SEQ ID NO: 80180 - DNA, 629 bp, Triticum aestivum
  unsure (1)..(629): unsure at all n locations
  Clone ID: PAT_TA_80180
gcacgaggatcgatgagtcccacgtcgcctcggcagcccggcttcggcgccggcgggcagcgccagcaagccgccgcctccgccggcaccactccgttcaagatccacagggactcccacctcatacacaagggcgccgcggccggcgcatccgcgtcctcgccgccctcctcctcgtccaccaactcctccgtctcctcctcccccggcgtcggccagcagcggccggcgccgaggctgaagcagcagcagcagcagcagcctgtcatcatctacacgcactcccccaaggtgatccgcaccagcccgcgcgacttcatgtccatcgtgcagaagctcaccggcctcgagagcgccgccgcgtcagccgtcaccggcgccgcgcaggacgagtcttcgtcctcgtcgacggagagctgcgccaatgcccacgccagtgccgtgccgccgccgccgcctccgccccagtacatggatccacctcagctgatgccgccgccggcgcagctggatcacgcgcacttcatgccggacatgccgctgttcgcgccctcggagcatcagcagcacatgctctgcgcctnnnnnggcgnnntctacggccacttcccgcccacnnnnnnngnnnn

SEQ ID NO: 80181 - DNA, 609 bp, Triticum aestivum
  unsure (1)..(609): unsure at all n locations
  Clone ID: PAT_TA_80181
tcatccgctccaaagccaacacagcagcagcagcatcagtcagtaaccagctcgggaagcagacagagcggcagcaatggggagcaagagatcgccgcgcgcgccggccgtggtggtggtagtggtgctgctgctgttcgtcctcatgccggacgaggcggacgcccaggtgttctgccggtcccagttcaacctggccaacgaggcctgcagcctgcggacctaccccggcgccaacccggcggtgccgccgcggcggccactgttgctcaacgcgtcctcgtccgccagcggctacgagctgcaggcggccggcgacgagcacagcgccagcggcggccatggcggcgagcacgggagcagccacggcagcgagcacgggggcagccacgtgaggcgccgccacgggcaccagcaccacgtagggggcgcggacccgtacgacacggcgtgctgccggcgcctcatgggcatcgacaacgcctgcatctgccaggccatgtccttcctcccgcagttcatgagcagggtcaagcactccatcaagctcaccccggtnnnnggctgcgacatctccnnnnngtgcgccggcgtttactgaccacgccn

SEQ ID NO: 80182 - DNA, 599 bp, Triticum aestivum
  unsure (1)..(599): unsure at all n locations
  Clone ID: PAT_TA_80182
gcacgaggatcacttgctttctcacctgtactctgaaaccttcctctcctacaagtaaagctaccctccttcttcctgcatctcatcccctttccctcccgtgcgatctgatcttcattgggtcatcacactaccacgcgtcactactgccgctccggcgtcaccccctgccgcctaaggtcacaatccgttcaaactgagtaaccaggccgttcgtcgccaccaccaaagcccattcagttggcgttgttcgtgcagctgccaatgtggtcgctggggctagtcaacttgaagatctacaagtcatcagtccaacttcttgctctgccgccagtcactgaagaaagagtcgcgtgttggccaccccatgctcggccccctgatgcggcattttgtgtatgaatntgatgaatcttgttatgtctgttcttattcatctnnagatnnntgttcttatggactnnntgtattgcttgtaccnntttcannnantnnaagagactcaagtccaactcgcaaaccaatagcagtccacggtccactactacagcnnntatccgagtgagttgcagtncaacttgagctcgatgagnnnnnna

SEQ ID NO: 80183 - DNA, 633 bp, Triticum aestivum
  unsure (1)..(633): unsure at all n locations
  Clone ID: PAT_TA_80183
gcacgagggccaattgaatgggaagagcattatgtgggcacggaggttgatcccagaacacagagcttcttgacatgggaaagcctggagtcggtgcgcaggaacaaagttggcttgaaaggccccatggccacacccatcggaaaaggccaccgttcgctgaatctcacgctgaggaaggagcttgggctctacgccaatgtcaggccttgcaacagcctcccggggtacaagaccagatacgatgatgtgaacctggtgacaatccgtgaaaacactgaaggggagtacagcggcctcgagcatcaggtcgtgaagggcgtcgttgaaagcctgaagatcatcacccgccaggcgagcctgagggtcgcggagtacgccttccactacgccaaggccaacggcagggagagggtctccgcgatccacaaggctaacatcatgaggaagacagacgggcttttcctccagtgctgccgcgaggttgccgccaagtaccctgagatcaagtacgannnnngtcgtcatcgacaactgctgcatggagctcgtcaaggaccctggcacgtatgatgtgctggtgatgccgaatctgtacggcgacattatcagtgatctgtccgctggtttgan

SEQ ID NO: 80184 - DNA, 632 bp, Triticum aestivum
  unsure (1)..(632): unsure at all n locations
  Clone ID: PAT_TA_80184
gcacgaggactcattgtaggtgtatctctcaagctttttaaacaactgattggtaaaaggtaaaagggactaagattcacacagctacgccgcaggtaattgtccatcttccacaaggaaagtagttattctattcatcatgatattcaatgaatcttagagcatggtaattaatatgtaatcattttatatctaacttgacttctccacggagtaatccaaccaaaggttttaactaaaagtgattgtgatggctcgttactacgtatatccacataaatattaacaaaatagaaattatcacattaataaaaatgattaatctcaagattcatgatgttgtccatcgagattatatgttattcttataacatgttcctataacatcagtatttcatgtcattggataattgtagcttagnnnccatggtttgttcatacagaaatctgagctcacttgcttctacaattaactttcaagatgtaattttccattagtgagcatggtcattggaaaacgttgtctacttataaactaactactaactgaagaatattatattctttannnntaattgaagaatgattaatacatgaaacaagnnctcaccgggaccatgctgttgggggat

SEQ ID NO: 80185 - DNA, 612 bp, Triticum aestivum
  unsure (1)..(612): unsure at all n locations
  Clone ID: PAT_TA_80185
gcacgagggtctcctcgctcctcccttcctccccctccccccggcagcccgaggagctctgccatcgatgagatccagcgcctcccaaggtccttatccaccacagctcgcgaggaagctgcggtaggagatcaaccgggcattcgccggccggagaaggaggagaggcgcagatgccagccaggaaggtggatcggttcgcctccgctgtgccgtgagcaccgccgccgcctttgcatccaccttgctccgcgtagcagcatgtgtgcggaagcatggacaggtgaccacgagtagatggcgtcggcggcaacagcaacacgcacggtgtgatgggcgcggcctgcccgcaggcattctaggcttgcgtgcccgatggctcggaacgcgcgcgcccggcgcacaggaggtatatgccttggagcacgccggcggcaacgtgcaccgcgaggtcccggagcagcccggccagtacagagcccctccgtattggacggaccctgcgactccatcctcgcctccactcacaggtctatgccgatttccacaacaacactgccttcaacnnnctcatttccccggctctgcatacnngnnncnnnctnnnnatgc

SEQ ID NO: 80186 - DNA, 373 bp, Triticum aestivum
  unsure (1)..(373): unsure at all n locations
  Clone ID: PAT_TA_80186
gcacgaggcctcgtgccgaattcggcacgaggcatgcaatttactcaaatgatcacacctggtcacatgcatgagaccaggctcatgcaatttactcaaatgatcacacctggtcacatgcatgagccttctgctgtgaccaggtgtgatcatttgagtaaattgcagtctgtactacgacgactgaatttgcgcgtcttcagacagaggcaactagtgtgatcatttgagcgtgattgaggcctcatttttggatgtaccacttttatgtcatgcacaatctttcgactgaattttctttatacacatataaattcagtgtgatcgaagcctcatttttggatgtaccacttttgaattttgcacatcttnn

SEQ ID NO: 80187 - DNA, 270 bp, Triticum aestivum
  Clone ID: PAT_TA_80187
gcacgagggtcactcttgcctgtaattatgggctgttgttagcagggagtagtagcctggggtagagaacgaatagaagctttgcttctgcttctgcttcttctccggtgtacgcatgtgtatcgcgtagatcaagaaataatgatcttctcttcacaggaggagtcactaaggtagttagttaggagcttaatcaggtgtaaattattatgcatcgagaggtagtcttgaataaaccaagatgaataccttgtgcttaaaaaaaaaaaa

SEQ ID NO: 80188 - DNA, 620 bp, Triticum aestivum
  unsure (1)..(620): unsure at all n locations
  Clone ID: PAT_TA_80188
ccctcgaggacacggcgctcctctcccgaacgaggtcgatccgctcctcctcctctcccgaggatacgcagccgccgccgccgatccgggcagacgctgccatcgtggatcacgtgaacgccgccgccgactgccgccgcggacctcccagggcgcacgagatcgccgccgccgacctcacgggggaggggcgagcgatctcgccgccgccgacctcacagggaagacgccctctcatctcgccgccgccaacctcacatggaagacggatctcgtcgccgcggatctgacatgacaggggaggaccaactggtgaaatagctgcagaattacaggtacggtgatggaaatcctgtggcaccattcctatcttaagatgggaattactcagtggacatctggatgaccgaacgaaaccaattctcttctccatggcaagacttgaccgagttaaaaatatgacaaattgtgaccaatttttctgtctctgctctcttgcattattttcatattcatatgtttatctccagatcaaagccagagtgaaggcgaagatctggcgaannnnntagtatccgcctcttcggagacttactccgctccgtcctgcaacacgtgnn

SEQ ID NO: 80189 - DNA, 568 bp, Triticum aestivum
  unsure (1)..(568): unsure at all n locations
  Clone ID: PAT_TA_80189
gtcagtccggcagtgtcatccaagatctagctcagctcaagatccaggcagggtaagccacagccagccatgtgctgcagcgagtgcggctgctacgatgcattctgcgactgctgctgcccctgcgtctcctacgacgcgcgcgagaccatcctctgctgcgcggcctgcctcgccgtgctcgccgccgtcgtcctcttcgccgtcctcctcgcggcctacggcttcatccgccgccccgaggtcgccgtcgtcgacgcctccctcacgcggctcgcgctggccacgtcccccgccaccgccttcgcctacaacctctccctcacgctcaccgtccggaacaagaactgggccatgagcgtcaggaacacccagccgctggaggccgactacagcttcgacggccagcgcttcgagcgggtcaggctcgccgacgaggggtccacgcaccccgccggcaagacccaggtgtaccacctcgtctgcggctccgacagcgcctacatcgggctcggctacgccnncatgggcnnnntcnnnnaggagaacaaaacggggatgtcccnnn

SEQ ID NO: 80190 - DNA, 592 bp, Triticum aestivum
  unsure (1)..(592): unsure at all n locations
  Clone ID: PAT_TA_80190
ccagcgcctcccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcacgcgcagagcatcctcgccatctgggcctgccnnntggtgctcatgggcgncgtgnnnnnctaccgcgtcgccgg

SEQ ID NO: 80191 - DNA, 546 bp, Triticum aestivum
  unsure (1)..(546): unsure at all n locations
  Clone ID: PAT_TA_80191
cctcgtgccgaattcggcacgaggctcgtccctattcgcgctcctctccctctcgctgctcctcctccggctgctcctccgcctccgcctcgccgccttccgcgacgccgcgctcacgctccacctcctcgcgcgcctccgcatccgcccggtcaccctccgcctccccggcccgcacgccaccacgctccgcgtctggtgccccgcctcgccgtccggcaagccgccgctgctcctcctccacggcttcggcggcgacgccaagtggacgtgggcgcgcaacctcgccgcgctctcccgcagcttccacctctacgtgcccgacctggtcttcttcggctcccactcccgctcgtcctcgccgctccgctccgtggccttccaggcccgctgcgccgcggacgccatgcggctcctcggcgtgagccggtacgacgtcgccgggatcagctacgggggcttcgtggcgtaccggatggcggnngtggnnncccgggacagcgtggccagggtcgtcatcatgaccnncggcgtcgcgncnacggt

SEQ ID NO: 80192 - DNA, 217 bp, Triticum aestivum
  Clone ID: PAT_TA_80192
gcacgaggcgcctccccgccaagggtgacatgctcctatgaccattatgtaaaatctttcttcttctttttgcatagagttaattgcatatatattcactactactacactgcacaatcgatcactttctgtttgtgtgatcagagaatcatagaaataaaaataagagaggatggaatggagtggatagatactctgaacattcaaaaaaaaaaaa

SEQ ID NO: 80193 - DNA, 402 bp, Triticum aestivum
  unsure (1)..(402): unsure at all n locations
  Clone ID: PAT_TA_80193
gggggccaaaaaanncccngttttttttaggggaaacccgggaaaattccccttttcctttagggaaaattaaaccttttcccaggggccgggatttattccaaacacacaccccccccccctttttccgatgggatccaaaaacccccccttcctttttttttacaggaaaattgcttccccttccacttttgttttattttnccccccccccaaccccttttaagggaaccggacccggaaggggttggggtttttggggtcggggggggggagcttttttacggggacggggaacaccccctcccgggaccccggggggaattttttcctggggggggtttttggnngcacnaaatttggcattaaattggcnntggggggcttcattcccaggngctt

SEQ ID NO: 80194 - DNA, 342 bp, Triticum aestivum
  unsure (1)..(342): unsure at all n locations
  Clone ID: PAT_TA_80194
gcacgaggcattcctcctcccctccacggcggctctccattggtaatggcgatggcggcgtcgtggtgggcgctgctgatggcggtggtggctgcggcggcggcggggtgcggcgaggcggcgccgacggcggcggccgaggcggcgcacgacgtgctgcagtcccacggcctcccgcgcgggctgctccccgccgggatcgcggcgttcacgcacgaccccgccaccggccggttcgaggcggtcctggagtccccctgcacggcgcgcacngnnnntggcctgcggtacaacgtgaccgtcgccgggcagatcacgtannnnnnnatcgcggagctctcg

SEQ ID NO: 80195 - DNA, 626 bp, Triticum aestivum
  unsure (1)..(626): unsure at all n locations
  Clone ID: PAT_TA_80195
cggcttcccctcccgtaaccctacctcctcctctcctctgagccgccgccgccggtcctcctcctctcctctgcgccgccgccgcccgtcctccacctctcctctgcgctgccgctgcccgtcttcctcctctcctctgcgtcgccgccgcccgtcctcctcctctcctctgcgccgcctccctccgccgctcgtgccgccgcttccttgtcgagcttgacgtcctcaggaggagaggaagctggcgctgctcttcccgaggaacgcgccgttgcgccatcgataggagaaagccaggcggagcgcgccgtcgccaccggctggcgcgtcgacgggaggaggccaggcggggtgcgccgttgccaccggccgcgccgtgggtgactcctctgccacctcacttctcctcctcatcctctccccgtcacggcgcagctcggacatgccgcgggtacatatcaagaggggatggaggagccggacatggatgtagagaanncggccagacccgagttcgtccacccctgctatgctaaagttgatgactagcnnnaattgcagcattgtaaatccgctgaattgatcagataatacggatggacgnnntcacacaagccgttgaaaan

SEQ ID NO: 80196 - DNA, 630 bp, Triticum aestivum
  unsure (1)..(630): unsure at all n locations
  Clone ID: PAT_TA_80196
cccgcaagtccaccggcggcaaggccccccgcaagcagctcgccaccaccatcgcggcgaggaagtcggccccgaccaccggcggcgtgaagaagccccaccgctacaggcccggcacggtagcgctgagggagatccgcaagtaccagaagagcacggatctgctcatccgcaagctgccgttccagcgcctggtgcgggagatcgcccaggacttcaagaccgatctgcgcttccagagccacgccgtgctcgcgctccaggaagccgccgaggcgtacctcgtcgggctgttcgaggacaccaacctctgcgccatccacgccaagcgcgtcaccatcatgcccaaggacatccagcttgcccgccgcatccgtggcgaacgcgcctaaagcctggatcggagatcctatactatcttgcccttcgttgtaagatagctagttgattcgcttgtggtttctagacgtgttatataccatgcatagtacctcgtgatnnncaactttaatttcgctgtaaatatcatatgtagtccaaaacaaataagtgtatgctgctttttcttctggttatgtttctgaaagaactgcaatattggcgtatcattatctgttcaaaaaaaaaaaa

SEQ ID NO: 80197 - DNA, 581 bp, Triticum aestivum
  unsure (1)..(581): unsure at all n locations
  Clone ID: PAT_TA_80197
ccaccatcgatctactctcccttactttctctctccctgctcgactagatcgctcgatcgatcatcctcttcttggttggttgatttcatcatcctctgtgacgaaagtgccgtcgttgattgattgatggattgatcgatcgatcaagtgttccaacaactggtcaatagttgggatcttcggtcgtctgctcatcgccatcgccttcaattccactcgttttcaagctcccgtcgcccccgttgatcggatcaaagggattgggattaacctaacctaacctcgcgaccaaattcccctccccacttgacgttggtccaccggccgattccttttgtctatcgcgacaaggaattcttcttttctttgcacctcgtatcctacatagcgcgtccacgcgggctcggtggcggttcgcctacgtgatcctcgggagaattgacagttgtgatagcgcgcgcgcgggcgcgggcgtgggcgatcgacgcgagcgcggcagcatgggggccggcaaccactcgccgtcgtccgccaagacgtcccctcgcggctctggcgccggaggtggcggagannnnnn

SEQ ID NO: 80198 - DNA, 621 bp, Triticum aestivum
  unsure (1)..(621): unsure at all n locations
  Clone ID: PAT_TA_80198
ggcaacaacacgctccacggcggccaccgcgggttcaaccaggtgttctggtcggtgcgggagcgggccaccggcgccttcccctacatcaccttctactaccgcagcggcgacggcgaggagggcttcccgggcgcgttggacgtgctcgtcacctacaagatcgacggcgactactcgtacagcgtcaccatgtacgcccggcccgtggacaagccgacgcccgtgaacctggcgcagcacacgtactggaacctgcgcgggcacgggcggggcaccatcctcgaccactccgtccagatcttcgcgtccgccgtcacccccgtcggcggcgacctcatccctacgggcgccgtcacgcccgtcgccggcacgcccttcgacttccgcgccccgacggcgcccggcgcgcgcatcgcggaggtggaggggggctacgacatcaactacgtcctggacgggcgcgacgcggacgggcagggggtgcgcaaggtggcggtggtgagcgaggccacgtccgggcgggtgatggagctgtggggcgaccagcccggcgtgcagttctacaccggcaacttcctcnnnnncgacnnnnnncaaggcggcgccgtgtacnnnnnn

SEQ ID NO: 80199 - DNA, 600 bp, Triticum aestivum
  unsure (1)..(600): unsure at all n locations
  Clone ID: PAT_TA_80199
gcacgaggcaggctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgctttctcaagggttggcttctcctccccactcagtcctcggttcccggcccggttcggttcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacnnnngcaacatcaccgtcaacgnnncccaa

SEQ ID NO: 80200 - DNA, 565 bp, Triticum aestivum
  unsure (1)..(565): unsure at all n locations
  Clone ID: PAT_TA_80200
gcacgagggcgtagcagcgatcaatcgctggtcgaagaggacggccgcacgttggtggaggtggagtccgaccccgggcaagaagagggcggcggagacgacaaggcagccgagtcagagcacaaggaggacacggacggcagcggtgccggctcggtgaaccacaacgtcgtcgatacgctgcaaggcgaggactcggccgtcggcgccggaggagaccagagcgcgtgggcaacgcagcgcgatcagtcccaccgggagaaggaccggcggcaggaagacgcgggcgacggcaacagcacggacggggaggagcagcacgagtggcggacgtgcaacgtcaaggctggcgccgactacatcccgtgcctggacaacgagaaggccgtcaagaagctgcggccggagaacttccggcgctacgagcaccgcgagcgccactgccccgacgagggcccgacgtgcctcgtcgcgctcccannnnnctaccgccggcccgtcgagtggcnnnagagccgcgacaggatttggctgnnnnatgtgccacacacgaagctggtccnnn

SEQ ID NO: 80201 - DNA, 626 bp, Triticum aestivum
  unsure (1)..(626): unsure at all n locations
  Clone ID: PAT_TA_80201
gcacgaggagaagaagaggaggaggaggaagaggaggacgacgaggaattacgcatgactgttcaagtatccttcttgtgcgaccagatcagcgacctggtactagaacttctgaagatggttccagacgaagagccggaaaatcaaatgctgtccttggtcaaaaggctaaatagattgcagtggatcacagacagcatcaacaatttcgtctcagaaattgcggtgagggtgtcgagggaacaaatgatagagagagcacgcaaagagaaagaggaacagaagagattcctccaacagggccaggaggtgaggagctcggacaagaaacaggagcaggagaggaccttggaggagagggaaatcaacggacaagcggtggtcgccggaggcagattagtcactatggcaacggacagaggcttggaggccaaagatatcgaggctgaagcggtgatcagcgannctggggagtatgannaggaggcttttgctcgcttccgtaaggacnnnggagtgtcgccannntgccaacagcttcgaagacctgactttgttgagtcccatgctctttacacactgtacaccgggattcgagccagtagacgctgtcctcccnnnnncnn

SEQ ID NO: 80202 - DNA, 634 bp, Triticum aestivum
  unsure (1)..(634): unsure at all n locations
  Clone ID: PAT_TA_80202
ctcgaggactgcttgacacttctttgctattgtccgatgggatggaaatgtgataactgttccaaggttgttgagctgccgagaacaaatggaagtgaaaatggtgaaccgatgatagcaagtaccaatgtaaatcgagcagttgaaggagaccagactgaattatcagacgggaaaacatgcccaagtgaacgatctaatgatttgaatagcttgtcggtacattgtacttctccaaatagacaaacacatggttcagatgcacatcatcaagttattctttctgaagacagaattagtgaagaaatcacttcagggatgagctatgatgaaaagaactcggcctcttgcagcactaccaataaaaaatctaaaagtcatgaagttgttcannaagctacacctagttcctttccaactgataaacagactgacctgctgagtgcccaggatagtcaggataccagcgaccaaaatcaaggcagtgggaagcaggtaaagctggatgatcatagtgcgcaacaagtggaagaaaaccgaattgagcagaaacatgagacnnnntggttttcaaatacaattgattgctaagctgccacctgtgttaaccantcaactgaagnnnttcaccnnn

SEQ ID NO: 80203 - DNA, 353 bp, Triticum aestivum
  Clone ID: PAT_TA_80203
gtcgaaattttgtgtgaagcttttcatcaggatctgcccagtgctggatgctgagtagagtgttgcgtggtatgctacccaggcatcgaagaaacagcttttgcgatgttgtattgtaggtgatgactgttggcactgttttttcttgtaccagtaatgtaaattttatgtgatgggttgagcgagcgactgcgcagtgaatttaaccacaatgtatcatttttttagcagagattactacacttgttttgcagaacatatatctgttcaatctgggaaaatgtttcacgtgccttgacccatcactatcaaccggtggattagcaacatatgtgtaaatcaaaaaaaaaaaa

SEQ ID NO: 80204 - DNA, 581 bp, Triticum aestivum
  unsure (1)..(581): unsure at all n locations
  Clone ID: PAT_TA_80204
gcacgagggcgcattggagccatgcgacggtgcttctcaagtcataaagggcggtaacctcagccccaggccctttatatccctttctaggctttggaatgtgccacatgaatcttgagaagttggtctacgcaacttctgctaggcatctgctttgatgaggaaaaatacagaatgcattagatgttaggaagagaagtgctgcagagaagattgcactgaagattgttaacgatgttggcatctgtgtcctctgcagaaaatcatactctcataccttccataggagctgttaggttaatttagacaaaagagaagccatgttcatgctgtttttctaggctaacaacacactgaggatgctgaattgattattctataaccaaatgcaaggtagctccaccgacttcgtgaaatccagtagtatgtatatcccgtgaaatccctacatacatacatatgtatgaactctgtagccattgatgtcatgtgtgtaaaactttgagagaaatgaaactctcttatctgtgaagttctcgnnnnnnnnnnnnnnnnnnnnnnnnnnnnnnnnnnnnnnnnnn

SEQ ID NO: 80205 - DNA, 561 bp, Triticum aestivum
  unsure (1)..(561): unsure at all n locations
  Clone ID: PAT_TA_80205
nntttttttttttttttttttttttttttggggggaaaaaaactgtttttttttttttttttttgggatttggccaaccttaaaattgggaaaaattaaatttgtttttttttaaccccaccccaatttttggttttttaattgatttttacccctaaagggggcccggaacccctaaaaaaattttttttttggggggccggtttaaggaaccccctttttgcggtttttttgggaaaatccccccccctttttttttttgggggggaaaattacaattttttcctggaaatttttgaattggaatccccccctttaaaaaaaaaaacctttgggggggcccccctttttttaaattttttttggggggccgataaaaaccccaaacccggttttnggggcttttccctgggaaaatttttccaggggcttttttttttaaaggggccccccccttttggggttaaaaggcccttccctttgggggggaaaaaaaaaaaaaaaaaagggggggggggttttttttgggggggnttnaaaccccccgggggttntttgcnn

SEQ ID NO: 80206 - DNA, 519 bp, Triticum aestivum
  unsure (1)..(519): unsure at all n locations
  Clone ID: PAT_TA_80206
gaaacgagggcctcaaagccaagtagccaatttttccacgatgtcgttcttcaacctgcgtctctttgcttccatggcaatggcggacatcctccgcttcccaggagaagacctggaccatcacgcgccccggagctgcccgaaagaagcaacggcggaactcccgctgccggtcggatcgtcccgtcaagagcccctgcgcgtcgtggattgctcggaggcctacttgactgtcgcggagaggaggagctccaccagcgtttgtagaactagatgacccggttgcgccaatggtgcaagaagcgaattagaagcgatgatggtagtgagtagtcctggccatgggcagcccggtatagatggccaagtatagtagtgagtaagtaggagatgtagatggaagttaatggaatgtggattgtattacaaatagtgtatattaattaacgatcatatacggagcaatataaatgggaannnctnnncnnnnnnnnnnnnnnnnnnnnnnnnnnnnnnnnn

SEQ ID NO: 80207 - DNA, 606 bp, Triticum aestivum
  unsure (1)..(606): unsure at all n locations
  Clone ID: PAT_TA_80207
caactgtgcagtgacaccactgccatggcctttcccaagccatctctagtgctatgctctgttcttactttactgagcctaaatcgcggtccatctcatgtatctgccaaggtttatatggtggtgatggaggatgatccagttgtttcctacaaggcaagccggaagggtgtaatgagaggcgaggaagctcagaagtacaaggaaatggccacaacaaagcacgacgtcttcctggaatcattcctcaccgtaggatcttacaagaaactgtacagctacactcacctgcttaatggctttgctgttcatgcaaactctgaaaaggcagctaaaattcttagcggcgcaaaaggagttcgactcgttcaagaagacatcaaaatggcgaagatgaccacatacactccaaagtacattggagccagtggggtatggccactgcttggtggtgctgagaattctggtgatggaatagtcattggcatgattgatactggcattgaccccaaaaacccaagctttgccagcttctcgaaccaatcaaagcagcnaccnnncaatttcaannnaatgtgccgctctgnnnatnnnnncccnnntgat

SEQ ID NO: 80208 - DNA, 559 bp, Triticum aestivum
  unsure (1)..(559): unsure at all n locations
  Clone ID: PAT_TA_80208
cctcgtgccgaattcggcacgagggccagctcccccagcaggccagaggcggagagagatctccaccgcaagggaaagaatcacgaaaaggggcagggaaagggcggaggagctgcccaagcacaaacctttcctcccgagggcaccaaaccctaccaatccgccgcgtaatcccccgggaattcctcccccattgctccccggagccgagcgcgccgccggagcggagcaatgccgaggaggctcgtcaatgccgtcctcttcgcggtcctgggggtcgtggtcgcgctcttcctctgctactccgtccgctgctaccgccgccgccgccgcgcggtgctgccctcgcacggcgccagggccgaccgcctccaggcgggcgggtccagcgcctacggctccggcgtcggggaggagctgctcacgttccccggcggcgaggggctcaccgtcgccgccatcctcgaggcgcccggcgaggtggtcgccaagtnnncgcacagcacgctctaccgcgccgggctcnncgccggcgnnnnngtggcgctgctccgcnnnc

SEQ ID NO: 80209 - DNA, 191 bp, Triticum aestivum
  Clone ID: PAT_TA_80209
ctgttttttcagcatttgcccagtaggtgaatggtcttagtttgctccgttgatttttgtgctctctggtagcaagtctttgttctctccctccgtctgttgcaataaataatgatacaccagttggctgtagatctatgattctattagctggggatgacagcagccaaagttgtgataaaaaaaaaaaa

SEQ ID NO: 80210 - DNA, 623 bp, Triticum aestivum
  unsure (1)..(623): unsure at all n locations
  Clone ID: PAT_TA_80210
gcacgaggagtaattgtgatcatcacaaatgagagcaatgccactaacagggtatatatcatcatatccaagcaaatgagttttcaaatcaatcttaagtgatggtatcatgtaatgcaaggtggtagcaaagaaatcacaaggcatcatgtcatcaagaggattgagtaaacctgacacatcacgctctggtatgacaataggcaaatgaatctcatgttcttcatcttcatctacagcagcttcttgtacttcttcaggagtaatagatgatgagtcttcaacttgatcacttgggaattgcagctcttgaccatcttgttccttgtcttctagttcatcttcttcaatctgaggtatctcttgctcaaggcacttgctatcttgctcaacgaaatgtgaaggtgttggaacctcacatgtatccatggatatctcagccacactcaactcaaggagggaagagatagtactgccagcgttgatgttcttctcaatcttccttacttcttccactagctcttttccactcttgatcttcttcatttcatctagtataaccttcctaataggatcatcctcggcactccaagtgaactcgagnctcaaaagtgtgagcttgt

SEQ ID NO: 80211 - DNA, 618 bp, Triticum aestivum
  unsure (1)..(618): unsure at all n locations
  Clone ID: PAT_TA_80211
gcacgagggcgccccatcacacttcccaaccctttggggacaaacaaattcgtttgatccgtttgcgaggtagcagatcggacagagggaccccccgaaagcacgcaagaaggcacgcagacgcagctagctcgtggatcgatcggcccaggcgatcatcgatccaagatgaacgatgccgatgttgggaagcagatccagcagatggtccggttcatccagcaggaggcccaggagaaagccagcgagatctccgtcgccgcagaggaggacttcaacatagagaagctgcagctggtggagtcggagaagaggaagatcaggcaggagtacgagcgcaagcagaagcaggtggacatccgcaggaagatcgagtactcgatggagctgaacgcggcgcgcatcaaggtgctgcaggcgcaggaggacatcgtgggcgagatgaaggagaacgcgtccaagacgctcgtccgcgtcaccaaggacaccaatgtctacaggaagatcctcaagagcctcatcgtgcagagcctgctccggctgcgcgagtcgtcggtggtgctgcggtgcnnngnnncggaccgcgtccacgtggagccggtgctnnnnncggcnnnn

SEQ ID NO: 80212 - DNA, 621 bp, Triticum aestivum
  unsure (1)..(621): unsure at all n locations
  Clone ID: PAT_TA_80212
cctgaaccagctagcctcatggtggagcgagaagcccgccgagctcgcggggcagaagaacaaggggtctattctgccggggtaccatgccgacatcgtggtgtggaaacctgaggcgcagttccatctcgacgacacccatgccgtatatcacaaacaccggaacatctcagcttacctagggaaggagctatccggcaaggtcctgtcgacgttcgtgagggggaacctagtgttcgccgaagggaagcacgccggggccgcctgtggcgccaccatcctcgccaagtaaaactgtagagctacaatatcgtcgctgatttctagcgtatatgatcgtgtgcgctgtgtagtatgtagtatgtatgtatccagattcgtagccgtttctctgtgtataattggcccatcgcatgcatccattccccaccattgttgtatatccatccattcattggacaacacagtgtnnnttatttctctgaaatattcagatgtactagttttgaacttctgagttgtgataatatctacagtatgagaggaatgtgaattattctgctactcttataactttccgacgaattttcagctgcaaaaaaaagtcttcctggattaann

SEQ ID NO: 80213 - DNA, 622 bp, Triticum aestivum
  Clone ID: PAT_TA_80213
ctgcagaggtatacatcttgcccaggcgttggctcgggcgatgaaaattatccgcgtgcttaccgctgttgctgctctcctgtctactagtgcctcctacgcactccaggattgtccaagcatctggaatgatgccaagctccggaccaacaccaccggcgcgatccggctgacgatgctgcacacacagcatcggtgctcgcccgtgcggcggcagaggggcctccctccgtcctggcatcagcatcactccacggcgctacaccgcgagcgccgccttctcttccgtcgccggccgcccccgccaaacatctccacgccagtgacgagcacgagcgccgccggggtggatcacgggttcatggcgcaagtcgccatcgggacaccgcccacgacgcagaccgtcctgatcgacaccgccgcgtccttctcgtgggtgcagtgcgccccctgcgcccgtaacggctgctacaaccaggacggcccgctgttcgacacccggacctcctccacgtacgccgcggtgccatgctcgacgcagccgtgcgtgtccgtcgacgcaaccatggcgcgtaccaactgcagcagcagcggggacaagacatgcctttacagggtagag

SEQ ID NO: 80214 - DNA, 513 bp, Triticum aestivum
  unsure (1)..(513): unsure at all n locations
  Clone ID: PAT_TA_80214
cttcgccctgtgttggagtctgactcctcgtccctggatccgattgatccaaggtgtgatggagtctgatccctcggtcaaaggtattacgtcctggagactggagtctgatcccttgcccctcggtccctggatcgatcggatcacagcacgaccggccgctgccgccattgacttcctccgctcctccgtcctctttcaaatttggattgatcggtgaccgactctagcctccagggatcttcacttcgttagagattgcttcttacttctcggttaaagatcacaggacccagaattaggtgagttagacgcttcgtctaaatggaaaacattgatgcatgatatccaattgatatatgctactgtgtaactttaattttattttattcatcttctttatcttcttatataagacattatattatatacatacaattttttctgcgatatatacatatatatatatatatatatatatatatatatatatatatatatatatannnnnnn

SEQ ID NO: 80215 - DNA, 220 bp, Triticum aestivum
  Clone ID: PAT_TA_80215
tttccttgaagtgccaattttgcattcaaagttgtgacagatcgtcacaattttttacaattcagacgcaatcacacaggtgcactttcgaatacctgccacataaccatatataattcagggtagcaaagtattctttcatggcagctcctattacatatttaagggcattgcagtcatagactcacagtacacaaattaaatttttaaaaaaaaaaaa

SEQ ID NO: 80216 - DNA, 286 bp, Triticum aestivum
  unsure (1)..(286): unsure at all n locations
  Clone ID: PAT_TA_80216
gttcattacncaggtgttttctaacaanatgaaatattctccnaatgacantnaccaacanantgngagtgttanaactnanccgccacatcacgataangctgngtcaacanttnaggggtangttctcncttganaacccntcncacagnaatctctattccctanatatcntctcatcatgggacttaatgtaaaacaatgcaagcctantgtngttggaacagaaccaaattgcangagtcccctcattanggtcncggtattccacgtccaacaagctgac

SEQ ID NO: 80217 - DNA, 410 bp, Triticum aestivum
  unsure (1)..(410): unsure at all n locations
  Clone ID: PAT_TA_80217
gtatccccgtgtccagaatctaccccccggctccaatggcggcnaaggaaccgatgcgcgtgctcgtcaccggcgccgcaggacaaatcggatatgctcttgttcccatgattgccaggggagttangcttggtgcagaccagcctgttattctgcatatgctggatattgaatttgctgctgaagctcttaaaggcgtcaagatggngttgatcgatgccgcatttccacttctcaaggggagtttgttgcnacaactgatgttgttgaggcttgcactgggtgttgaatgttgcggttatggttggtggattccccaggaaangaagggaatggcaagggaagggatgttatgacgaaaaaaatgtttncaaatccaacaaaagcctcaaagcaatcctgctccttng

SEQ ID NO: 80218 - DNA, 494 bp, Triticum aestivum
  unsure (1)..(494): unsure at all n locations
  Clone ID: PAT_TA_80218
gcgccggcgcctccacttctctgctccctcgtctcctctcgcgcagggcccggcgaaagggaagcaagatgtacaccgccaggaagaanatccagaaggacaagggcgtcgagccctccgagttcgaggacaccgtcgcgcangctttctttgacctggagaacggcaaccaggagctcaagagcgacctcaaggacctgtacatcaacactgcaatccacattggatnttgttgggaacangaaagccgtngtgatncatgttnccataccgtctgcgcaagccccttcaaggaanatnnatgtcaagtcnncgtcaaggaagctccganaaaaaantttaaacgggcaaanggatgtttttcctttgntngcaacaangaaaggattntttgaanggcnccccaaaaaaaagggtttctnnctggttcaaacgccccntcngcaaccanggaacccntgaacaaacnngttcaaanaattgggantccttng

SEQ ID NO: 80219 - DNA, 209 bp, Triticum aestivum
  unsure (1)..(209): unsure at all n locations
  Clone ID: PAT_TA_80219
gagcaaatctagcccatctcaccatctccagctganctcaacaccacttctactgcaaactcgatagggatggcccncggtgcanctactcaagctcgttgctggtccgcaatggtgggccgtnatgctcctcgtagcctgcgatgccggcgatatccttgcggtcaggtgacntctgccttgagcccctgcatctcctatgaacncgg

SEQ ID NO: 80220 - DNA, 401 bp, Triticum aestivum
  unsure (1)..(401): unsure at all n locations
  Clone ID: PAT_TA_80220
ggaaacacagagcaagaagagaagagagaagcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggcccgcccgccgccgctctccggtggactcccccggaacggacaactccgacgaggcaagggacttcgacctgcccctgaaagaaacggttctanctgcaagccgcttgccaaccggcgggaggccggtgttccggggccna

SEQ ID NO: 80221 - DNA, 490 bp, Triticum aestivum
  unsure (1)..(490): unsure at all n locations
  Clone ID: PAT_TA_80221
gcctcgtgccgaattcggcacgagggtcaactcaaaaagtcgagagacttcatcgcgtcggccatctttcgtgtcggataaagttacaataaataactgcagcaaccatgcgatccaaattcaaggacgagcaccccttcgaaaagcgcaaggctgaagccgagcgtattcgccagaaatacgcccgaccgcatcccggtcatctgcgaaaaagtccgagaaatcccgacatcgcaaccatcngataaagaagaaaataccnttgtncccgcaagatctcaaccgtncggtcaanttcggtgtacgtcaatccgaaaaggcgcatcaaagnttgtcanccccgannaaaggngatcnttcancctttggtcnaatgaaggttccttccgccctaacgggcgggggctttangaggtttgtnncntaccgaaaataagcnataangggtttangggtggggttccctaaaanatttaaanaacnccngggg

SEQ ID NO: 80222 - DNA, 428 bp, Triticum aestivum
  unsure (1)..(428): unsure at all n locations
  Clone ID: PAT_TA_80222
gcctcgtgccgcaagaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccancggcaacccacaaggcgagctccggcggcatggagatggcggcggagaacggcggctgcggctgcacccagttgcaagttgcggcacaagctgccggctggctcctggctgcaagctggctaagatncattaatccgaaccaataatgcaatggcaacccgttgcccgttgcgtggcaatcaatccgattaatatcngatnctaactaactaaccaataaccaatgttaaaccgcca

SEQ ID NO: 80223 - DNA, 491 bp, Triticum aestivum
  unsure (1)..(491): unsure at all n locations
  Clone ID: PAT_TA_80223
tcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcaagcacggaggccctcctcaagcaggtcgactacctgatccgctccaaatgggtgccttgcctcgagttcaacaaggttgggttcatcttccgntgagcacaacgcatccccctggggtactaacgaatgggccggtactggacaatgtggaaagctggctatgttcgggctgcaaccgacgcccacaacaagggtgatcnaacggaaggtgggnnanaaggtcaangaaagggagttacccctgancgcngtt

SEQ ID NO: 80224 - DNA, 469 bp, Triticum aestivum
  unsure (1)..(469): unsure at all n locations
  Clone ID: PAT_TA_80224
gccgaattctattttcccttccaccttcccctctctttgccccgtgggcttagcttgattgctggccgccatgatgaagcggaagatggtgatgagggtggcgctgaaggacagcagccaagcagcggaaggcgctcaaagcagtctccaagtctccatggtatcgacgcgattgctgcggacttgctggacgggaggatcacggtcaccggtgtctcgacccgtcgatgttgtgggcaaantgcgaaggttgttttgggaaagccgagatngtctcccgtcgggcccgccttccgaagggcaaaaaaggacgggnaacaagaaaggagcctcctcggtcctnctcctcctcctcctncgtcctcctcccaaaaataantggnaatgttcccatcccctaataaactaacccctaacccctttccctggcccctatcctccnnctccncctccanccatntncgtgctt

SEQ ID NO: 80225 - DNA, 452 bp, Triticum aestivum
  unsure (1)..(452): unsure at all n locations
  Clone ID: PAT_TA_80225
gaaaacatcaaaatgtctgaagacgttcaagcactcgtagtcgataacggatctggtatgtgtaaggccggttttgctggtgatgacgctccaagagctgtcttcccttctatcattggtagaccaaagcaaaagtccatcatggttggtatgggtaacaaggatgcctatgttggtgatgaagctcaatccaagagaggtattttgactttgaagtatccaattgaacacggtattgttaccaattgggacgatatggaaaagatttggcatcacactttctacaatgaattgagagttgctccaaaagaacacccaatcttgttgactgaagctcctttgaatccaaaggctaacaaagaaaagatgactcaaatcatgtttgaaactttctcaattccaagctatgtttgtccccattcaaacctgtcctgtccttgtatgcntctggg

SEQ ID NO: 80226 - DNA, 450 bp, Triticum aestivum
  unsure (1)..(450): unsure at all n locations
  Clone ID: PAT_TA_80226
gcgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcaattcgaggtggccgccgggcaatccggcgaaggctgcaactgcggcgacaactgcaaagttgcaaaccctggcaaactgttaaagctgcatngcaactccgtacgttacgtttttttggtgttgagaagtataacgttgaataaacgaagcgtcctgattttgaattgggagtcccaaacnaaagggttccnttttncccttgttncctngttggnttttgcnttgcccccccnccccccaa

SEQ ID NO: 80227 - DNA, 332 bp, Triticum aestivum
  unsure (1)..(332): unsure at all n locations
  Clone ID: PAT_TA_80227
gctagcttcagctatgccagcctctgccactccggtcattttcttgcatccacgacggcaatggccaccgctgatgtccanaacccgacggccgcgctgacggaaagaggcgcccgcggtggagacgcccgtcgccgccgaggaggttgccaagacagaggaggtccccgcgccggcggaggccgaagtccaaggcgcctgcccccgtcgaggttgaggcgaccaaaggaggaggcaccggcccgccgcccgaaaacggngangncaaaggagggccgaaccaancaantgcnggcccanaaggganggcnaagggnccaaagaaccaaccc

SEQ ID NO: 80228 - DNA, 412 bp, Triticum aestivum
  unsure (1)..(412): unsure at all n locations
  Clone ID: PAT_TA_80228
gcccgatccccttctccaccctccggccgccgccgcggccaggccggcgtggcggtgcgccatccatcnagccaccactccatcatccactccatctccaccacccgccgctgccagcgccccatcaccacctcgaaccaccgcgccatccatcaccatctccagcaccgccagccacgaccatcaccaccgcgccaccacctcctccgcgcgactccactccttctccatctctctctgctgcctttcttcccttaacctcccgctggctccctgctgtttccctcgccttcctcaaccttctgctgctcctcccatcttcaaacctggcaatttcttctanngcccnttcggctcccttggctggttgtttcctcntccctcttncctttcaacctgnttgcgnatctct

SEQ ID NO: 80229 - DNA, 474 bp, Triticum aestivum
  unsure (1)..(474): unsure at all n locations
  Clone ID: PAT_TA_80229
gctcatccatcgcccgaattcctccgtctccctcccacccattgactcccccgcgcgcgctcggagaagagaaaggcgtcgaccggatcgggatgaagcangagaagggtcanggcggcggcggcgggaagaanctggggcggtggctgggcgcgccggtgtcgggcgctgtcgcgggcgtgcgactcgtacgtgcgcaagatgtctgcgtgcgcgggcgccatgcccacgcagtacgcgggcgccgtgggccgcggcggggccggngccatgcncatgcaggcggccaccttcanctctcgctccactcgccggcgtgggacgacgacntctgcgaagctggttccgcgccatntnccatcgccaaccaggggcagncgnggccttccccccgcgnncccgccgtccgtncngccccaaggatccnggtncgttggnggtngggccggatttactaaggatctcgccctttnt

SEQ ID NO: 80230 - DNA, 297 bp, Triticum aestivum
  unsure (1)..(297): unsure at all n locations
  Clone ID: PAT_TA_80230
ggtgcgccgggccccccgcatccgagccccggaggacccatgatcgacggcgcactcgtctcccactacctcgcgtggttcatcgcggcgctcagcacgctcggcggagtactggtcgtcggcgcattcttcgcgatgggccgggccggctaccgcaaggactgagcgcccctcgcggggccgcagggggcgccgagcgcctantcggctctcgcgcgggcaaaacggccaacgaccaactttccccgaaggcctgcggaagtcctttcgcgaancggcgaaattaaatntttttgc

SEQ ID NO: 80231 - DNA, 394 bp, Triticum aestivum
  unsure (1)..(394): unsure at all n locations
  Clone ID: PAT_TA_80231
gcacagcttccccttcaacccccttccatcggtcccagatcccctcccctcacaaccctaaatccgagttagccctcacttatcatccgttcgacatggaaaagtcccgtcaacttcgtggtccgtcgcccgccgacgattcttaccgccaccaccagccgtccgccgagaagttcgcgtgctctcggattccctgggtgatgctggatcggttcgcccaccgcaccaagggggatggggatggcgttgtttcggatgcggtagctgacggcacgctatcagagatctcagccacctgcaccggtaaacccatcgccatctcccttcgggtcgctgaacccccggaggtgtcccgtctctaccttcactggccaaacgggttgaggccgggana

SEQ ID NO: 80232 - DNA, 398 bp, Triticum aestivum
  unsure (1)..(398): unsure at all n locations
  Clone ID: PAT_TA_80232
ggtcatcctttcctctccgccgcgacgccgtctatcaccaccatagtcgtgccacggctcgatctgctgctcccgagcgcagctaccttgtcctcgaccccgagctccttcttcgccgacgatgaagccaccgaccaagggccccgtcgcccctgccttcttttcccatcatctcnctcttcccttctttgtttctcccgttttactctcatcttcctctatctctcttgggtcttgctctctgttacaggggaagcngccatgggcngcctgaaggtctncagctccngacccacgnccccggnggtcctgccgaacntcgtcggcctaaggaagaatnacantnccggttgcangggagcttcgaacccgaacccngcaangaatnaaaganccgt

SEQ ID NO: 80233 - DNA, 476 bp, Triticum aestivum
  unsure (1)..(476): unsure at all n locations
  Clone ID: PAT_TA_80233
gagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcganacngccggggagaccggcggctgcgactgcaccacctgcaattgcggcaccgcgtgcgggtgctcctgctnncaactgcaattgagccgggcgcccaangaggccgggcggcaataggccaatcaccaatgattnangaangacaaagcaaagcaagcaacatcanccaccanttcaaccaccaaccnaancgtttcatcaccaagnccgcccgcatnccgctcgccgggncgcgccgcngcttnatnan

SEQ ID NO: 80234 - DNA, 373 bp, Triticum aestivum
  unsure (1)..(373): unsure at all n locations
  Clone ID: PAT_TA_80234
gtcgagtttttttttttttttttttttttttttttttttttttttttttttttgaaacactgaacagtgcctctacacggaattcatccattcaaggtcaacgtgcatcaaatcgatctcttaaacatgaacacagctatatacacaatgtgcaacaataggtgtcacaaccctgtacagatttcagctgttcgtgttcgacaaaaatgcatggganatgttcanccttaacaaggaaccgatttcaaccnatngttctcctcaaggcgaaaaaaaaaagcaattcaaataacccaagttttaagnatnggttnaangaagaacccttncnggctctggtttggggttttaaaccgtnaggnccccccgttat

SEQ ID NO: 80235 - DNA, 326 bp, Triticum aestivum
  unsure (1)..(326): unsure at all n locations
  Clone ID: PAT_TA_80235
ggagagagagagagagaaccacagagcaagaananaagagagaagcaaagcttgagatggcgcanaccatggcgtccatgaccggcctgtcgcagggcgtgcgtctcccaggcccggccggcangcgcgccagcaggttcatcgtgagggcgtcgtcggnggangcggaggccgccggccgccgcncggtcctttggcctcatggngcatcngnagtcgtcngcagcggngttcgctcaanggtggttgcacngccgggnacccgtcncgggccaatcaaggtttggncccncccgcncgncncttcttcccggtgggtctccccc

SEQ ID NO: 80236 - DNA, 452 bp, Triticum aestivum
  unsure (1)..(452): unsure at all n locations
  Clone ID: PAT_TA_80236
ggttaaggacgtcaacgcccacgcctttatcaaggcctatgctgcttatctcaagcgtaccggtaagctcgaagtccccaagtgggtcgaccttgtcaagactggtactttcaaggaattagctccttatgaccctgactggtactatgttcgtgctgcttccgtcgcccgtcacatctacatccgtaagaacgtcggtgttggtgccttgaacaaggttcacggtggtactatcaaccgtggctctcgtccctctcaccacgttgatgcctctggctccgttaaccgtaaggttcntcaatctttggaaaagattggggtcttggnaaagggacaaagaagggtggtcgtaaagattactcaagatggtcaacgtgatttggatngtattgctaatgancctcgctgaagaatctggacccaaaaataaatgantcncctttaatataaaa

SEQ ID NO: 80237 - DNA, 392 bp, Triticum aestivum
  unsure (1)..(392): unsure at all n locations
  Clone ID: PAT_TA_80237
ctggaaaaccacattgcacaatacagctacggccagagcctgtctcccgcctttgcgccatcaccgctcacgttccttccccatggcatggcttctgcaccgacgtcaccgtacctcgaagtcccgcgatctgggcaccgtcgacacgtatggcacagctagcaagctacgcatcgtcgagcaactatgcgtctcccgctggggtcgcctgcaagcgctgctggcggcatactcggccccacaaagaagcaatnattccgcaattcgggantgcnatctggtttatnccaaacggggttnggtgggctacaacctaatctggggcntnaacganccnggcttganngatnccccaaggaaaacaaaatggactactccngaatncagaattt

SEQ ID NO: 80238 - DNA, 406 bp, Triticum aestivum
  unsure (1)..(406): unsure at all n locations
  Clone ID: PAT_TA_80238
gcaactcttcagtgtatcactcatactgtcccactttttaagaagctccgctgcaccgaccactctactccatgctcatatgatgaagatgggttctgttccttttgcgcccttaaagaacacatcgaagaatcagttcgaaggtctggagctgttttagtgccagcaaggttcaaggataatttaagcaaattatcgtcagattttagaccaggacagcaagaggatgcacatgagttccttcgttgcttgctggataacttgcacaaatgcacccttgatcccaagtcaaagggggaagccctcatcttttgatnagggaaagtatttgtcaaacaggtggtttgggtggtccgggttaaaaaagccaattttgacatgcccgtggattngtgggtcacctgtt

SEQ ID NO: 80239 - DNA, 410 bp, Triticum aestivum
  unsure (1)..(410): unsure at all n locations
  Clone ID: PAT_TA_80239
gcacacacacacactttccaaccaacccaaaccaaccaatcaaccatcttcaaaatggccccctgcaactgccaatcttgcaactgcgctggtgactgctccagctgcaactgcggatcttgctcccactaaagcatcccctaaatcactcatcacaccctgaaacaacctccggcactttcttttttccaccccaacttccgacaatcagcgcttcatccgaccgagtagcaagatggacgtcatgacaaagagcttttaagttgggaagggaacgggagggcggggggaacttgttccgacctaattaaagttnacgttgtccgaatnggggggtggttgattttttgtnctaacgggctngggcaatggtnatgttaacnaaaattaatgaatttttttattgaata

SEQ ID NO: 80240 - DNA, 415 bp, Triticum aestivum
  unsure (1)..(415): unsure at all n locations
  Clone ID: PAT_TA_80240
gatcatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaaagctgcatgcactccgttacgtacgttgtgtttggtnttgaagaagtataacggttgaaataaccaagccgtntggattctggaattgggagtccnaagcaaagggttgccgtttng

SEQ ID NO: 80241 - DNA, 485 bp, Triticum aestivum
  unsure (1)..(485): unsure at all n locations
  Clone ID: PAT_TA_80241
gcccttgcgcaattacctctgatccaagaacagcaaaagttacttatggatatgcagcagcagctgtcaagctcccattcactttcccaacagcagatgatgcctcaacaaagcacaaaaattccatcacaggtagcatcactgccaccacccatgcagccaagatactacacaccaagaaagcttccacaagaaagcaagctctgcctgcagacaacttaagaaagctggcaattcctaacgaaccaacatcaacaataaaattcaattnaagcaaaattggaaagnccttttgaggattgcctgggtggctaacaacaattccngttagttnacggggaagaaatcccctcctggccaaaaatccccttncaatggctaatggnnatcaaccntccaaaaacaatccctggtaaggaacaattctccancatngtnaacaacggggaaaggnactcnatcnaatggtccnangtnaatttcaa

SEQ ID NO: 80242 - DNA, 406 bp, Triticum aestivum
  unsure (1)..(406): unsure at all n locations
  Clone ID: PAT_TA_80242
gcagcgagcgatctcaccactgacccgctccctcctcccgcgtcacgtgtccccccactctccccccatctcccccgcctcacagctcaccccgccggcggccgcagcggcgcgcccccgaccaggcggagccgcgccggcggncagggcagcggagatggtcttcgtctggctcgccgccttcttcctcgtcgtcacgctcatcgttgctcgtcatcttccaagttgatgtgcttggcaaatctggagttcgattatatcaacccgtttgattcatcctctccgaatcaataaagtnggttatgccaagaatttataagtgcaaggaacttctnaaggtgcaatantnctcttannttggggaattgggggcgaatgttcttgcctttntggccccaaatggggg

SEQ ID NO: 80243 - DNA, 450 bp, Triticum aestivum
  unsure (1)..(450): unsure at all n locations
  Clone ID: PAT_TA_80243
ggcaagctatatacctacatagtacagccatggcccccaccgtgatggcctcgtcggccacctccgtcgctcctttccaggggctcaagtccggcaaggccnaaacagctcactcacgacaggccatatataaagtgccattgcagttttgtcaactctgacattgctttgggttttccttctccatttatctttcttatttgttcctaanaatatgtgtatgtccatgttcatgtaccaacatngctcgagaaagcatgctcgtatgtgaatgctatcggtggctatgtatatgcacggacgcataatattatacaatatgtcaactanatacgttttaanggtaaccaannntcccctaagatcggnntgnttaacnncccttaaaancncnagggggggnccggttcccaattcnccccaannggggtccgcatncgncgccgcnca

SEQ ID NO: 80244 - DNA, 208 bp, Triticum aestivum
  unsure (1)..(208): unsure at all n locations
  Clone ID: PAT_TA_80244
gccactcctaactgacacagcgagggagagaggggagggcgagtcgtcgtcggagcagatcgaccgggtangcctcccggcgatggggaacncntcgtcnatgctganncagtacgacatcgnngaggtgcangagcactgcanctacctattctcgcagcangagatcgtgncnctgtacnagcgattttgccagctcnaccgcaag

SEQ ID NO: 80245 - DNA, 488 bp, Triticum aestivum
  unsure (1)..(488): unsure at all n locations
  Clone ID: PAT_TA_80245
gatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggccccgtccctgcaaggttgttgaggtctccaactccaaagactgggaaacatngtcaacgcaaaagtgtcaattttgtttgcaattgacatctttaatnggaaagaagcctngaggatatcnttcccttcatcccaanaactggtgaactncccccaatgtttgaaccggccaaagattatcaagctggatttggacatnactggattgatnggatatgttaacccttcctaacttgnagaagttggcaacaccgaaagggatggacctggaancttcccaactgatngaagttctng

SEQ ID NO: 80246 - DNA, 369 bp, Triticum aestivum
  Clone ID: PAT_TA_80246
gctaacataaaatgccgccagtacgcaaccccatcctgcccggcttcaaccccgacccctccatcgtccgggtcggggaggattactatattgccacatcaactttcgaatggtaccctggcgtccagatacaccattccaaagatttggcgaactgggagctagtcgtgcgcccattgaatcgaaagagtcagttggatatgcgaggagacccaagatagttgcggtatctgggcaccatgtctctctcacgaaggcgataaattctggctccgtctacaccgatgtcaagcccaagggatggctcctttaaaggattgcgcacaatttacatcgttaccgctcccgaaagattgaaaggaccaatgg

SEQ ID NO: 80247 - DNA, 325 bp, Triticum aestivum
  unsure (1)..(325): unsure at all n locations
  Clone ID: PAT_TA_80247
ggcttcccttccgtccgcaataaacccaccccgccccaccccggccgcggacccagtcccgaacggctactcctcctctgaccaccaccacgcccacgcgaaccgccatcgccatgccgccgaancgcgcgtgccggctggccctgatgctcgcggcggcggggtacctctgcttcctcctcttcctcgagctcccctctgtcncgtcggcgcncctcgacancgctcgtaccgnctcgcgccggccgcgaagctcgatggncaagctccctccggccttcctcccaaagaaattcgcncccgntcccggngcaanaaaaggcng

SEQ ID NO: 80248 - DNA, 492 bp, Triticum aestivum
  unsure (1)..(492): unsure at all n locations
  Clone ID: PAT_TA_80248
ctcccccgtcgtcgcggctccagcttagggtttctcgcccccgccctcccgcctcaccgccggccccgtacgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaangcaggccaaaagggtgcgctgggaggatctggtctcaaagaaagagtggggaagaaatgagtctgccaaccttacgtaatgcccaanaaaatgataatctatctatctaactaatctgtngtcgcgcctcaataatctntgggtngttaaaagaactaccttcaagtttgtgtttgagcaattaaacattgtccgcaantccggttggcttgaaaacctnatggnaatttgagcaagcctccttctngcttaactngtggatncnaaatgggtccctaancct

SEQ ID NO: 80249 - DNA, 487 bp, Triticum aestivum
  unsure (1)..(487): unsure at all n locations
  Clone ID: PAT_TA_80249
gctgagacgaaccaagatcgcctcgccgctccccttcccgcccgcccatccactagcgagctgagctgatggatcaccggaagcagcagcagcagcggagccccagtccccggagcggcggcagctcgggcaagcacggcggcaaggggggcancaaggcgggcggcggcggcancaaagaagccgatcaaggtggtgtacatctccaaaccccatgcggggtcaaagaaccaacgccggcgggcttccccngcccctccgtccaanggagctcaacggggcggcaatggccgaaccctccaaagttaaataaccgaacgaacgggcttccgaacgaacggngggaacgggcgcaaaggagctcaaccctcaanccccnaagggaaccccgggcnggtccaacccttgacgcnggccgcccccgggccccgccggcaattgggagggaaccnnggagctccccggggncgggttcngccaacgggaa

SEQ ID NO: 80250 - DNA, 486 bp, Triticum aestivum
  unsure (1)..(486): unsure at all n locations
  Clone ID: PAT_TA_80250
gcgcagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacgggcgccaacgtcgacgggctacagcccaatctacacgccgggagggaatggtcctgaatctgggtgaaccgctaacnccggggggnaacgaaccggggcnttcntaatcttggggcgttaaccctccgcccgggcttcttcggggggnggggggtcctnctcccttctaaaaanaaacaaacngntctnccccngggctaaaaaaaaagaatcctaacgtgttaanaaaaagggcn

SEQ ID NO: 80251 - DNA, 488 bp, Triticum aestivum
  unsure (1)..(488): unsure at all n locations
  Clone ID: PAT_TA_80251
gctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaaatgggtgctttgcctcgagttcaagcaaagggtttgggttcatcttccgttgagcaacaaacgcaatccccctggggttactaacgattggcccggttactgggacaatgtgggaaactgcctatgttccgggttgcaacccgacgccaacacaaggtnatcaaacgaagttgggaagaaggtcaaagaaaggaattacccctgaacgnctg

SEQ ID NO: 80252 - DNA, 367 bp, Triticum aestivum
  unsure (1)..(367): unsure at all n locations
  Clone ID: PAT_TA_80252
gcctcgtgccgaattcggcacgagggccttcttcgcatgagatgtttgcaaagagagaacgcaaacaaagaaacagagaagatgagcagtggtagagattagagaagcagctggaggtgactgaccaccctctgagagacagaggagggaagaacacgccagttcttcctcagttcaagtttaaaatttaggacataagattagtgctccccctccttcacccccattcttttttccccatttcctttttgccaccagggcgttgcattgtattatattgttatgtcaaggaaaataaaaatctgtcgttggtgttctgcannaaaaaaaaaaaaaaaaaaaaaaaaaaaaaaaaaaaaaaaaaana

SEQ ID NO: 80253 - DNA, 437 bp, Triticum aestivum
  Clone ID: PAT_TA_80253
gcatggccccagccgtgatggcttcgtccgccaccaccgtcgcacccttccaggggctcaagtcgaccgccggcctcccagtcagccgccgctccggcagcgccggcctcagcagcgtcagcaatggcggaaggatcagatgcatgcaggtgtggccaattgagggcatcaagaagtttgagaccctgtcttacttgccacccctctctacggaggccctcctaaagcaggtcgactacttgatccgctccaagtgggtaccctgcctcgagttcaagcaaggttggctttgtcttccgtgagcacaatagctcccccgggtactacgacggtcgatactggacaatgtggaagctgcctatgttcgggtgcaccgacgccacacaagtgctcaacgaggtggaggaggttaagaaggagtaccccgacgcctaagt

SEQ ID NO: 80254 - DNA, 439 bp, Triticum aestivum
  unsure (1)..(439): unsure at all n locations
  Clone ID: PAT_TA_80254
gcctcgtgccgattcggcacgagggatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaacaacaggacatcaccagagggaagggcatcgtgggactccctcttccaagcgcccactggcgaagggacccacgaaggccgtcctcaactcatacgaatacgtcanccanggactcaaagaagtacgactttcacaacaacat

SEQ ID NO: 80255 - DNA, 444 bp, Triticum aestivum
  Clone ID: PAT_TA_80255
gcctcgtgccgggtcttcggatgttgcacttcctcctccagcacatcgtccgccacgtccctctgtacagcattcagaaccacgaccctctgtgcaacgttcacaaccacgaccttctgtgcaccgtgcagaacctcatccttcacagccagggagctcttccaggcatgagccacctccttcacagccagggagctcttcctggaatgagccacctccttcacagccagggagctcttcctggcatgagccacctccttcacagccagggagctcttcctggaatgagccacctccttcacagccagggagctcttcctggaatgagccacctccttcacagccagggagctcttactgggcatcaagccacctccttcacagccagggagctcttactggcatcaagaagatggaactaggcgggaacctgtcgcaaccggt

SEQ ID NO: 80256 - DNA, 442 bp, Triticum aestivum
  unsure (1)..(442): unsure at all n locations
  Clone ID: PAT_TA_80256
gctccaccccacaatgcagccccttctcgggctagccctcctcgccctgctgctcctggcctcgccggcgccggcgctctgccgccaccgcgcgcccgccgcggccaccaccgagacgctcgacgtcgaggcctccctctcccgcgcccgcgccgccgtctccaccgacgccagccccctccaccaagtccctctccgccaccgacaccaatgttctccccgtggaggagcaccccagcgggccgaagcggccggctcgcgctgcggctccactcgcgcgacttcctcccggaggaagcaggggcggcacgagagctaacggtcgctggtgctggcccgcctgcgccgcgactcgggccgcgccgcccgcgctgtttgcccgcgcttcgctgggcgccgaaggggtctcccgcgccgaactganggcggggaatgccaaccc

SEQ ID NO: 80257 - DNA, 436 bp, Triticum aestivum
  unsure (1)..(436): unsure at all n locations
  Clone ID: PAT_TA_80257
gcttcgatccagttcaaaccgagcgacaccgatcaacttgggcatggctggaggagctgcgacggggctgcgagggctgtggaggaggtacgcaccgcacaacatgatgatcatggtgcagctgtgctacaccttgatgtacttcgtcaccgaggccgccttcaaccgggggctcaacccctacgtctacgtcacctaccgccacctcctcgtcgccgtcctcctctggcccttcgcctactaccacgaagaagaagttgaggcccaagatgacctggatgctgttcctggagatcttcgtgctctcacttctaggggtgagcttgaccctgaacatgtacttcgcgagcctcaagtncacgtccccgaccttcgtcacctccaaggncaacaacgtgggctccatcacattcgtcatcgccatcccgctccggna

SEQ ID NO: 80258 - DNA, 418 bp, Triticum aestivum
  unsure (1)..(418): unsure at all n locations
  Clone ID: PAT_TA_80258
gcggggttggcttctcctccccttccggttcgggttctggttcggttcgggtccgagagtagctagcctagtctagggtttccgtanttcggagaggagagaaagggagagatccatggcggagacggagtaccgctgcttcgtgggcggcctcgcctgggccancgncgaccacaacctccagcaggccttcagccagtacggngagatcctcgacgccaagatcatcaacnancgcgagacgggcaggtcccgtngcttcggcttcgtcacgttcggcaagcnanggantcgangcncccaggccatccacgganatnaacggcaaggannctcgacgggcgcaanatcaccgtcaacgaggcccaagtcccgccggtccggcngtgggggccgctngcggcggctaacgcggtca

SEQ ID NO: 80259 - DNA, 319 bp, Triticum aestivum
  unsure (1)..(319): unsure at all n locations
  Clone ID: PAT_TA_80259
gctctctctctctctctctctctctctctctctctctctctctctctctctctctctctctcaatatcatnctctcatanacagagtatccgacnacggantagtacttnccaagctagntcggaaatccgacgnaatggncaccgtatngagnagactntgcttgccattctccgtctgncccgccgccccttcggcgccnatggtatcncgcgtatngcncccgccgtcgtngacgggcgncaggggnatgaggctncgggcacaggggangtanaaggtgaaactgattacgccgagaggganaantgganctcga

SEQ ID NO: 80260 - DNA, 450 bp, Triticum aestivum
  unsure (1)..(450): unsure at all n locations
  Clone ID: PAT_TA_80260
gttggcaagcgcagacagacagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccagttcgttgacaagtacggcgccaacgtcgacggctacagcccaatctacacgccagaggaatggtctgaatctggtgaccgctacgccggcggaacgaccgggcttcttatctgggccgtcaccctcgccggcctcctcggcggcggcgtcctcctcgtctacaacaccaacgctctcgccggctaagaaancatctacgtgtaacact

SEQ ID NO: 80261 - DNA, 448 bp, Triticum aestivum
  unsure (1)..(448): unsure at all n locations
  Clone ID: PAT_TA_80261
gcctggcgtctgctccgccgcgtctgcgtccgcgagatgctcagccctgctggcctgcanaacgtgcacggcctccgccgccgcgagttcagggccacgctcgcgcacctacactccatggccagcgccggcaagccggttgacgtcggcgcgcagatgttcctcaccaccatgaacgtcatcaccggcacgctgtggggcggcaacataggtaccgagagcgagcggacggcggtgggcaaggagttccgggagcttgtcgcggagatcaccgaaatgctcggcgcgcccaacgtgtcaagacttcttcccggcgctggcgccgttcgacctgcagggaatccggaanaagtcggacgcgctcaagggacaggttcgacnagatctttcngcaggatcatanaagaaanagggtccanggcgggaccggggccgggcggctaaacgn

SEQ ID NO: 80262 - DNA, 442 bp, Triticum aestivum
  unsure (1)..(442): unsure at all n locations
  Clone ID: PAT_TA_80262
gccactgctgcagctgccgaccgcgtgtggcgccgctgcggcgtcggcgtcggcgccgggccccttcttgctctcacggccgccgccctcgcggctgcgcgcgtcgcacgtcctcttcgccttccctcgcctgaggaaatacggccgccggagccgcgagccggtacccaccaccctcgacgacgacgacgaggaggaggcggatgaggacgacgacgacgacatggaggaggcggttgacgaggacatcttcctcaagaaccggcccaagccggccggtttcggcgtggggaagacctacaccaccgacgtcgaagagcagcttctccgggagatgggcatcggcggcgccgggcgcaagancaaatcgggctccgcccaagagcaacaaaaccaacggctcggccacagaaaccgccgcagattgcagtaattgatggcn

SEQ ID NO: 80263 - DNA, 390 bp, Triticum aestivum
  unsure (1)..(390): unsure at all n locations
  Clone ID: PAT_TA_80263
ggagaactagtctcgagtttttttttttttttttttttttttttttttttttttttttttttttttttngncaaatttttggcgtgtttattcantccaaatagcaaagaanataatggngcatanaacgatntcncggtctcattttctcnactagtatgtcntcgtcgtcnnacccgccgcccgccaggtcgtcttccaccttctccnccacgtcntcctcgaacttgtcctccangtagctcgccccttccgccnacnccgttagtgattcggaatgatttnattccnggggtgtaattttgttnctaattgtccgtgccaangtcccccngcnttttggtnntanaaaaaatattgggtttnggtanaanccaaaaccgaancttt

SEQ ID NO: 80264 - DNA, 444 bp, Triticum aestivum
  unsure (1)..(444): unsure at all n locations
  Clone ID: PAT_TA_80264
ggcaccctcttccgtcgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccaacgcctggtccgcgaaatngcgcaagacttcaagacggacctccgcttccaatcccacgccgtgctgggccctccaagaaggcggncgaaggggtncctcntccgggctgttcgangacaccaaactgtgcgccatccangccaagcgcgtcaacatcatgcccaaggg

SEQ ID NO: 80265 - DNA, 238 bp, Triticum aestivum
  Clone ID: PAT_TA_80265
gcctcgtgccgaattcggcacgaggcttcactcttggttctgaataccccagatctgttgccatgtttccttgaattatttacatgtaaagaaatttcattccgttatggaagcagtgatacaataatgtctatgagtcaccaaaagtatagaaaatgatcctttgtagtggaatggtaattatctaccacaaagtttttgtgaaaaaaaaaaaaaaaaaaaaaaaaaaaaaaaaaaa

SEQ ID NO: 80266 - DNA, 438 bp, Triticum aestivum
  Clone ID: PAT_TA_80266
gcaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctaagctctgcccttggggtccttgtgtgtatg

SEQ ID NO: 80267 - DNA, 438 bp, Triticum aestivum
  Clone ID: PAT_TA_80267
gtgtaccacacaccacgcctgcctcatctctcggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgaaatcttcaacggccggacggcgatgatgggggtggtgggcatgatcgccccggaggccctgggcaaggtgggcctggtgcccccgggagacggg

SEQ ID NO: 80268 - DNA, 452 bp, Triticum aestivum
  unsure (1)..(452): unsure at all n locations
  Clone ID: PAT_TA_80268
gcaaccctcccagcgctcccccctcctcaacaacctcccggcgcatctccgacgacatggcccgcaccaagcagacggcgaggaagtccaccggcggcaaggcgccgaggaagcagctggccaccaaggcggcccgcaagtccgccccggccaccggcggcgtcaagaagccccaccgcttccgccccggcaccgtcgcgctccgggagattcgcaagtaccaaaagaagcaccgagctgctcatccgcaaagctacccttccaacgcctggtgagggaaatngcccaagacttcaagaccgaacctccgctttcaatcctccgccgtctccgcccttgcaaggagggcgccgaagtcctaactcgtggggctcttccaagggaancaaactccggcgccatccangccaaagcgcgttnccaattaatgcccaaaggacatccaaactcng

SEQ ID NO: 80269 - DNA, 462 bp, Triticum aestivum
  unsure (1)..(462): unsure at all n locations
  Clone ID: PAT_TA_80269
gctcctcctagcaanctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcganggcatcannaagttcganancctgtcttaactgccancgtgtcaancacggacgctctcctcangcaagtcagannatntgatccgctcnaagtgggtgnccttgcctcgacattcangcaanggntgggntcatcttccgtnaagnacaaangcctctcctggggnactaangntggctcggtnattgggacaaatgtncgaaagctgccttaatgttcnagggtgcacttnacgcccacacaanggtgattnaacgnggt

SEQ ID NO: 80270 - DNA, 492 bp, Triticum aestivum
  unsure (1)..(492): unsure at all n locations
  Clone ID: PAT_TA_80270
ctcctagcaagctatatacctacatagtacagccatggcccccaccgtgatggcctcgtcggtcacctccgtcgctcctttccaagggctcangtccaccgccgncctccccgtcaaccgccgctccaaacggcgctagcctcggcaagcgtcaacaacggtggaaggattaaggtgcatncanggtgtggcccatntganggcatcaagaagttcgaagaccctgtcctactttgccaccgctcaagcacgggaggccctcctcaagcaggtccgactacctgattccgctccaaagttggggtggcctttgccctcgantttcaagcaaggtttggggttcatncttccgtgagcaanaacgcatcccctgngttactatgaatggcccggtactgggacaatgttggaaagctgcctatgttcggggttgcaaccgacgccaacacaangtgatcaaacgnaggtgnagggaggtcaagaaaggagttc

SEQ ID NO: 80271 - DNA, 445 bp, Triticum aestivum
  unsure (1)..(445): unsure at all n locations
  Clone ID: PAT_TA_80271
ggcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgaagaccctgtcctacctgccaccgctcagcacggaggccctcctcaagcaggtcgactacctgatccgctccaaatgggtgncttgcctcgagttcaacanggttgggttcatcttccgttnagcacaacgcatcccctgggtactacgatggcccggtactgggacaatgtggaagctgccctatgttcggggtggaccgacgccacacaggtgatcaacggagggtgggaagaagg

SEQ ID NO: 80272 - DNA, 440 bp, Triticum aestivum
  unsure (1)..(440): unsure at all n locations
  Clone ID: PAT_TA_80272
gggcaagcgcagacagacagaacttgagagagcgcacgcgagatggcagcctccatgatcacctcgccgattgtggcgccgacgagcgtgccgtccctctcccgccggggctcctccttcgccgtcgtctgcagcggtggcaagaagatcaaggtcgataagcccctcggactcggaggcggcttgacagtcgacatcgacgccaacggcaggaaggtcggcaagaagggcgtgtaccaagtttgttgacaagtacggtgccaacgtcgacggctacagcccaatctacacgccagaggaatggtctgagtctggtgaccgctacgccggcggaacgaccgggcttcttatctgggccgtcaccctcgccggcctcctcggcggcgggcgtcctcctcgtctacaacaacaacgctctcgccggctaagagagcatctan

SEQ ID NO: 80273 - DNA, 449 bp, Triticum aestivum
  unsure (1)..(449): unsure at all n locations
  Clone ID: PAT_TA_80273
gatcaggaacacccccgtccaggccgcccccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccctcctactgcaagaacaagtacgccggtgttggattgggcatcgaatacgccgtctgttgctctcaaaggttgaggtcatccttggtgaantgggccaacaagcccctggcgggtgggaatcaaaggntctggtncccaactcaaagggattggcgcaaaaanaatnccttcaacttcntcaagggan

SEQ ID NO: 80274 - DNA, 436 bp, Triticum aestivum
  Clone ID: PAT_TA_80274
gcatcctgcatgccgcttgttgagttgtagcttgcaagtcacacgcatgcctgcaatgaagcatgcatccttccttcagcgcttcctcctcctcctgttcggtcttatcatcacaaccttggcctccagcgatgatcaatttctcttctccggcttcaaccaatccagcctaaccctcgatggttgtgccgtggtcacagacgccggcctccttgatctgtccaatggcacaactgctctcaatggtcatgccttctaccctactcctctgcaattccgcaagtcgcccggtggtaaagttcaatccttctcagtcaatgtagttttcaagcatcttcaacgcaaaccaagacttgaagaactggaggcatggccttcttcatcgcccccgcaaagaatttctctgatgcacaaggagccaagtactttgggctac

SEQ ID NO: 80275 - DNA, 238 bp, Triticum aestivum
  unsure (1)..(238): unsure at all n locations
  Clone ID: PAT_TA_80275
ggagagagagagaactagtctcgagttttttttttttttttttttttttagtaattgcatgcaccatgcacgcannatctttccaattactgacncgaantacaacnatcaagtatcaacanaacacatttataggggagatncatcatntnacatgagatccatggtanacaancacgaggcnanacnagggaataagaangatggcangggggncccgggtaccnaatttccccct

SEQ ID NO: 80276 - DNA, 182 bp, Triticum aestivum
  unsure (1)..(182): unsure at all n locations
  Clone ID: PAT_TA_80276
ggagagagagagaactagtctcgcgttttttttttttttttttcacgttaacacagacgaaacattacatgccnagcgccgcattcntgnacatcaatgaactcaacttccngcagcctgtaccttttccacactccccttggttcaaaccagaatcagncncgctantccaatccgatgtt

SEQ ID NO: 80277 - DNA, 436 bp, Triticum aestivum
  unsure (1)..(436): unsure at all n locations
  Clone ID: PAT_TA_80277
gcacagccccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcagcccgtggtacggctccgaccgcgtgctctacctcggcccgctatccggcgaccccccgagctacctcaccggtgagttccccggcgactacggatgggacaccgcggggctctcgggcgaccccgagaacttcgccaagaaacgggagctggaggtgattcaactgccggtggggcatgctgggcgcgctcgggtgggtcctcccggagctgctcncccgcaaagggg

SEQ ID NO: 80278 - DNA, 337 bp, Triticum aestivum
  unsure (1)..(337): unsure at all n locations
  Clone ID: PAT_TA_80278
ggctgctataagactactcctgctataaatgcacctgtttcttgtatccagttatatgtatacagtctatggaagaagagaaaccttttcattgcatatagcatcacattttgaggactcgggatctggtactacgatgtanacgactctttttctatagctgatcaaacctgaaacacacatctcctgaatctaaacaacctanatagcgatctgaatagttaaagatctangatggcatatccgcanggtgcancaattgtttcaaaanggcaatgcaanagtccatntgttccgggaatgatacaaagccaacggccccaaaaactattccccc

SEQ ID NO: 80279 - DNA, 435 bp, Triticum aestivum
  unsure (1)..(435): unsure at all n locations
  Clone ID: PAT_TA_80279
gacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttctccatttatctttcttgtttgttcctaaaaatatgtgtatgtccaagttcaagtaccaacatgtctcnaagaaaacaagctcctatgtgaatgcaatcggtggctatgtntatgcacatgcacataatatatttaaacaatctgtcnaactaatgtnttccggtnat

SEQ ID NO: 80280 - DNA, 460 bp, Triticum aestivum
  unsure (1)..(460): unsure at all n locations
  Clone ID: PAT_TA_80280
gcctcgtgccgattcggcacgaggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaacgtcgcggccatcaaggtttggccgccgccgccgctctccggtgggactccccggaacggacaactcccgaacnaagggcaaagggaactttcgaaccttccccttgaaagaaaccggtttctaacctggcaagccgctgccaaccgggcgggangggcnggcnggtccggggccaanggantccggccaangaaatnctcaaacttaangccgttaaccnaaaaaaacaattggncgttcnt

SEQ ID NO: 80281 - DNA, 440 bp, Triticum aestivum
  unsure (1)..(440): unsure at all n locations
  Clone ID: PAT_TA_80281
ccgaagccaacgcagccgtccatcacgacgagttgcctgaagccaacgcggccatccaccacgacgagttgcctgaagccaacgccgccgctggtcaccacgacgagttgcctgcagccaacgccgccgtcgtcaaccacaaccagccggctgaagctgacagcgacgacgacgggatggacgtggacatggagccaagctcttcaaacgtgtcgaggagcaagaagaagggcaagggcaagaagctggacgggttcgcgccggacttctttgcagatctgtagcctgcccaggcgagggcaaagaggccgcccttgagatgttcacttgtcaagggtcaagttttgatgttgtctcaatataacnggttgtangaggaatgttttantttaattataagcgtgaagagtgttaacttggctatcaaaataacgtttant

SEQ ID NO: 80282 - DNA, 381 bp, Triticum aestivum
  unsure (1)..(381): unsure at all n locations
  Clone ID: PAT_TA_80282
gataaaatctccgtcgatccaccacaccctgcaatggcgtccgcgctcaccaacgtgagcctgtctaccttcgcgcccacggccaggggcgacgtcctcgccaggcctcaggtggccgccgcccgcgtcaccttcccgacggcgtaccgtggcaacggtgccctctcctgcagggcgggtgggccgggcacgccgccgggcatctcccgacaagatgtccgggacaagcatcaaaggagggccaangagaacttctcggaggaacccnccaacnggggaaatgccccgggcnggcgtntggaacaaggtgganggactcaancgnccgcccgccaagcaangcccgggaaaagctcaaaggctncgaaccgctccaaaaat

SEQ ID NO: 80283 - DNA, 448 bp, Triticum aestivum
  unsure (1)..(448): unsure at all n locations
  Clone ID: PAT_TA_80283
gcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcaagcgcgttcgctcaggtggtgcacgccggcaccgtcgcggccatcaaggttggcccgccgccgccgctctccggtggactccccggaacggacaactccgacgaggcaagggaacttcgacctgcccctgaagaaacggttcctaacttgcaaccgcttgccaaccggcgganggcgggggtccgggccaaaggagtccgnccaaagaaatcctcaaactcaaaccgctcatcaaaaaaaacaaatggccgttacctcaattaaacaacn

SEQ ID NO: 80284 - DNA, 440 bp, Triticum aestivum
  unsure (1)..(440): unsure at all n locations
  Clone ID: PAT_TA_80284
gctgctgttcaacctcacaacgccgcatacccgcacacaacgccgcacgatatgtttccagttccaggcaacacatttttccgttgaatcggacaacacatttccggcggaaggaggatgtctccgtacgccgtcctcgtcgcggtgctcttgaccttctgctacgtcgtttggaaggctcgaggcagcagaagtggcaagctcccgccctcgccgccgtcgcgtccgctgctcggccacctccacctccttggccgccaaccgcaacgctccttgcgccgagctgcacgctcggtacgggaccgatggcgggctcctgctgttgcaactccgggcgcaagggggacgctggtggtttccaacngggggcgccggggggggcctgtnaaaaaaacaagaactnccctttgcctccgcgttgccaagcgcgcccggcgaaa

SEQ ID NO: 80285 - DNA, 459 bp, Triticum aestivum
  unsure (1)..(459): unsure at all n locations
  Clone ID: PAT_TA_80285
ccttctctcctccaacaccatggcccccactgtgatggcttcctcggccacctccgtcgcacccttccagggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgaagttcagcaaggttggcttcgttttccgtgagcacaacagctcccccggggtactacgatggtcgatactgggacaatgtggaagctgcctaagttcggggtgcaaccgacgccacaacaagtgctcaaacganggtgggaggganggtcaaagaaanggagtaacctgaa

SEQ ID NO: 80286 - DNA, 445 bp, Triticum aestivum
  unsure (1)..(445): unsure at all n locations
  Clone ID: PAT_TA_80286
ggctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgaagctccggcggcatggagatggcggcggagaacggcggctgcggctgcacccagtgcaaagttgcggcaccaactgcggntgctcctgctgcanctgctaaattgatnaatcnaacaatatgcaagcaaccgtgccgtgcgtgcatcaaccgatnaatatccaatntaataataacaataccatgtnaccgcaacctgatnnaangggctttatctaagcacctgacctgcatcancantcaagtgccatgcc

SEQ ID NO: 80287 - DNA, 309 bp, Triticum aestivum
  unsure (1)..(309): unsure at all n locations
  Clone ID: PAT_TA_80287
aatttcatatggagaacagttcattgttggaagaagtagctggtgctgaaaggatctccaggagccgatgcatctcttcatatttttgtgtactacaagtagttgggggcctgctaaatctcagagaaggctctatctgcatcagggaaggctctatctcaagagaaggctctatctagcagctgctggaatccttgttctctatcttccatttttacatctatattttcatatttgacacctcaaatttcaaataactataatttggtatttgacctgcacaananaaaaaannanaaaaaaaaaaaa

SEQ ID NO: 80288 - DNA, 275 bp, Triticum aestivum
  unsure (1)..(275): unsure at all n locations
  Clone ID: PAT_TA_80288
ggattaatcaagcctgtttggctttctctgcgtggttctgtaaaaataatgccgtctatcntaatganaaggcagattttgagcacaggaatagaccntnatttgtaaaaattaaacccaacgattttgctggantattanataaaacgtttcataaatgttaagtaacttttctgtgtttgccctgaacatctaagtggctgtaggtttagtggtgaaaattccacgttgtggccgtggagacctgggctcgaatcccaacanccacacctcaa

SEQ ID NO: 80289 - DNA, 471 bp, Triticum aestivum
  unsure (1)..(471): unsure at all n locations
  Clone ID: PAT_TA_80289
gcggacgtcgtcaggatgatcgaggagatcggggccggccacgggcagaccaccacggaggagagcgcgcgggcgaccacctccgaggaggagcgctccaggggcacgcccccggccgccccgacgccgtaggtagctccggcctgcccacggacatctccggacatctcttgattgttttgttggatgatgaattgtatttttttttctctcactctccctctatcaagtctcatgtcacgcaggtttcattctttcttccgagtaaagtaaatgtttcttcttttctttttaagctgtacgcctttgttcaaccccttttgaccttctttgtggtacattgacgctcccccatgcatcattaatacttttcttttttctaaacatcaacggtgtcctccttattcataaaaacgcaaggaatttctgcctgagaagagcgtgcaaagataaaatccggncggctcaaat

SEQ ID NO: 80290 - DNA, 653 bp, Triticum aestivum
  unsure (1)..(653): unsure at all n locations
  Clone ID: PAT_TA_80290
gaagctatatacctacatagtacagccatggcccccaccgtgatggcctcgtcggccacctccgtcgctcctttccaggggctcaagtccaccgccggcctccccgtcanccgccgctccaacggcgctagcctcggcagcgtcagcaacggtggaaggatcaggtgcatgcangtgtggcccatcgagggcatcaagaagttcgagaccctgtcttacctgccaccgctcagcacggaggccctcctcaagcaagtcgactacctgattcgctccaagtgggtgccttgcctcnagttcaacaaggttgggttcatcttccgtgaacaaaacgcaactcctgggtactaccatngncggtatttggacaatgttggaagctgcctatgttcgggttgcactgaccccacacaaggtgattaaacaaggtggangaagtcaaanaaaggagttacccctgaacgcgttatgttcgcaatcaatcnggatttcgacaaaaattgcgtcaaggtgcaantgcgtcaanctttaatccnccttcaaaaccaacccgggctngcgaaaggaantcccggcaaaggcctnaaaaaagntcaactcacgaaaagggcaaaattatnaaattgncaanttcaantttttttcaaacncng

SEQ ID NO: 80291 - DNA, 529 bp, Triticum aestivum
  unsure (1)..(529): unsure at all n locations
  Clone ID: PAT_TA_80291
gctcctagcaagctatatacctacatagtacagccatggcccccaccgtgatggcctcgtcggccacctccgtcgctcctttccaggggctcaagtccaccgccggnctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgaatggncggtactggacaatgtggaagctgcctatgttcggatgcaccgaccccacgcaagttatnaaacaagtggaggaagtcaaagaaaggattaccctgacgcctaatgtccgcatcaatcggattcgaaaaaaatgcgtcaaggtgaattgcgttaaacnttaat

SEQ ID NO: 80292 - DNA, 445 bp, Triticum aestivum
  unsure (1)..(445): unsure at all n locations
  Clone ID: PAT_TA_80292
gcaaacccagaaaatccccttatcccctctccccctgcttctcgaccgtccatggcgatggcctcctccgtcgccgcggcgtccctccgagcgctcgccggcgcctccccggccccgctcccgaagccgttcctcgtgctgctctccccggngnccccgcnccgcctcggnctnggnctccgcgccgcccgcccgcgcggnccgctcgccccgctcgcctcctctgactcctttttcgaaacctccgcgggcgttgacgtcgccnanccggaggacgaggccctggaagncgtcgcggaggaagagcccgccgtggcccgaaggacgaatgaaggatttggcggcctaagaaagacnatgtggaggaatgtccggggaantacgtgggaagcccgccggaagganggcaaaggttgtacnttcgggnaancttgccctaccgacg

SEQ ID NO: 80293 - DNA, 361 bp, Triticum aestivum
  unsure (1)..(361): unsure at all n locations
  Clone ID: PAT_TA_80293
aacccaccanagagcatggnggcagcagcgacggnggcgccgccgccggnggtcnccaccgcgctctccgcgctcctccgccgcggcncgagncgaatccattnccncntggtctnctcccgccccaggtgcgtctcctcngacgncgtccccgangttgagccnncacaggcgtcgacncgnaccgtcacnccnggacccgnctnnatgaggnagtncccnccacgtggnggagattccgtctgcatcatctaaactccgcaacccctggtcnattgtngagttnaccgtgcccgttgtttcccttcaaatattccangnagtgctaccnaaacaattntttntccaanggggggggccc

SEQ ID NO: 80294 - DNA, 661 bp, Triticum aestivum
  unsure (1)..(661): unsure at all n locations
  Clone ID: PAT_TA_80294
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcaacaaggttgggttcatcttccgttgagcacaacgcanctcctggggtactacgaatggncggtattggacaatgtggaaactgcctatgttcgggtgcactgacgccacacaagtnatnaacgaagtggaggangtcaaaaaaggagtacctgacgcgtatgtccgcatcaatcggattccaaaaaatgcttaaggtgcaatggcgtcaacttcattcnccttcaaaccaaccggggctngcaaaggaatcccggcaaaggcctnaaanancttaactccacgaanagggcaaaatttaaaattgccaattncaantttttttcaacnnccgaaaaattgcttttggggtttt

SEQ ID NO: 80295 - DNA, 625 bp, Triticum aestivum
  unsure (1)..(625): unsure at all n locations
  Clone ID: PAT_TA_80295
gaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcaacaaggttgggtttatcttccgtgagcacaacgcatcccctgggtactacgatggccggtactggacaatgtggaagctgcctatgttcgggtgcaccgacgccacgcaagttatcaacgaagtggaggangtcaanaaaggagtaccctgacgcgtatgtccgcaacatccgattccacaacattcgccaagtgcaantgcgtcaagcttcatcgccntcaaaccaaccgggctgcgaagaatccggaaggctaaacagctaatcaacaangggcaaaaataaattgcaattcnggtttttcaactctaanattcctttggtt

SEQ ID NO: 80296 - DNA, 689 bp, Triticum aestivum
  unsure (1)..(689): unsure at all n locations
  Clone ID: PAT_TA_80296
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcaacaaggttgggtttatcttccgtgagcaaaacgcaacccctgggtactaacaatggcggtactgggacaatgttggaagctgcctatgttcggggtgcaaccgaccccacgcaagtnatnaacgaaggtggaggaggtcaaagaaagggagtanccctgaacgcgtatgttccgcaatcaatccgattccgacaaacatgccnccaaggtgcaantgcgttaagcctttaatccgccttcaaagccaacccggggcttgcgaaggaagtcccggcaaagggcctaaaacaagcttaactcaaccaacggggncaanaatatnaaagtggccaanttgccggntttttgttcaaactcctgaacnanttgcnttttgggttt

SEQ ID NO: 80297 - DNA, 651 bp, Triticum aestivum
  unsure (1)..(651): unsure at all n locations
  Clone ID: PAT_TA_80297
cgcaaatcctccagtcctcccaccttgcgcccccaaatccgatctctcgtctcctcctccccgctcgaaacagccatggcgcccaaggccgagaagaagcccgccgcggagaagaagccggtggagacggagaagaagcccaaggccgagaagcgcgtgcccggcaaggacggcggcgccgacaagaagaagaagaaggccaagaagagcgtcgagacgtacaanatctacatcttcaaggtgctcaagcaggtgcaccccgacatcggcatctcctccaaggccatgtccatcatgaactccttcatcaacgacatcttcgaagaagctcgccggcgaatcggccaagctcgcccgctacaacaagaaagcccaacatcacctcccgggagattcaaaccgccgttgcgcctcgtcctccccggcgaagctcgccaagcacgccgtctcccgangggaacaaagggcgtcaccaagttcanctcctcntaaattgccgtccctgaatctcntantccctttgttccgaatgtttccatgtctcnatcaatangggggttagattcccctttacanacagtgtaaaaatgagtcaaantttgctaaatcaaatgaatcantcaattggntgttanaaaaaaaaaaaaaaan

SEQ ID NO: 80298 - DNA, 218 bp, Triticum aestivum
  unsure (1)..(218): unsure at all n locations
  Clone ID: PAT_TA_80298
ggagagagagagagagaactagtctcgagtttttttttttttttttttgaatgattcattcctatatgtatgcatcatggtacnggaacaccncgcatgacttcntcaagcnacaaaancgaccccgccccntanaccgtntccgcccggtggcntgggacaacaacgtnngcaagtttncncaagactgggcggcgcaacgcgccnggcaantgcct

SEQ ID NO: 80299 - DNA, 557 bp, Triticum aestivum
  unsure (1)..(557): unsure at all n locations
  Clone ID: PAT_TA_80299
gtccacatccgctcgcagctcgagatcggcagccatgtccgggcgtggcaagggaggcaaggggctcggcaagggcggcgccaagcgccacaggaaggttctgcgcgacaacatccagggcatcaccaagccggcgatccggcggctggcgcggaggggcggcgtgaancgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccaagggcgcaccctctaagggttcgggggctaagcccggncgacggtcgcatgtttctctcgccgccctgcaagattcnaaaaagcntgatgggaaccccacctgtcctaatttgcttttcctgttgtaactcccaagtttttgtttggaaaataaacnttcctctgcaaaattgccncgtttctgaanttntttcccccttttgggccccgtttggtccaatantnaaggggggaataattta

SEQ ID NO: 80300 - DNA, 669 bp, Triticum aestivum
  unsure (1)..(669): unsure at all n locations
  Clone ID: PAT_TA_80300
gcaatctttcaagcgttcatcttgctctattagcacgcaaatttttcagcccatcccatcctcctgacaatantttcggttgatttagatcacnctgcttttcaaagcttccaccaccaaagtcaacagatttagttcactatgcaattcaacatgctcccagttttgatggccgtcggtgccgttttggcagtcgccaatgccaaccctatcccgatcaacattttgccggtaaatgcactcaacttgaagtcgctcgcaaggatcaccaccaagtcaagtcaaccaccggagcaaccaccggcaacaaagcaaatgggcaaagggttcggttggtangcgaagtaaatcggcancaattctttaactaagcccaacaagcccttaatgtccggatagttatcttancttgcccaanctcctaaccgtttccttccgcctaatgcaattaagttgtnagtttttctccaaaccaaaactttgactaaaagcaaaccaattaagatttttttttcaaactggacaatccaatcctccaaaatagctgcctaantttggtntgggaanaaaatcccctaaatttttcccctcaaccttccctttcttaaanggaacgtncccngtttaaatttttaaccttaaattccaaaacccggtnaccaaagtcaa

SEQ ID NO: 80301 - DNA, 513 bp, Triticum aestivum
  unsure (1)..(513): unsure at all n locations
  Clone ID: PAT_TA_80301
ggaagcacacacgaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccaagctgcggctgctcctgctgcagctgctagatccatcatcgatcatgcatgcaccgttgccgtgcgtgcatcatcgatnatatcgatttactactaccataccatgttaccgcaacctgattganggcctttatgtacgcancttganctgcaatcaacaatcanggtgccaatgncaattgatttgttaaacaagggcccccctnaattaaaacctccccttgattaacttaaaa

SEQ ID NO: 80302 - DNA, 636 bp, Triticum aestivum
  unsure (1)..(636): unsure at all n locations
  Clone ID: PAT_TA_80302
gccagaatcgagcacgggtgcgcgcggccgtcttgcccatgaccggtggctgcttcacgttcgtcgacaaattgcgacgctgctgctgctcgtatgggctcccggtggccgggccagcacgcggctcccancagtcggnctccccgcctcctccaacatcgcctggagaggagcccctctgtgcttccgagccgcctccttgagcagggcanccaaagggaagggagtcgccacatggaacacaactgaaacgccccgccttggagctctctgcctccggcaacctctctgtangcctcgtgctcctccgtctcgaacaacccctcctggccgccgtccatctcttgggggtgcctgttaagcaaggcgttnattcttaacctcggctctctctctgtcagctgtctccttcaagacgaagaaggatgaatggggctctcncaacttgggcaatgcgggccgaattnaacttaagggggaattccccccgtccggggcaaaatnggcccgccttngcgccttcggtcctggtcctcctctcgcccgggnaacgttcccgcccgcgncccttaatgtggtcccccgcaatcancctaacccccgatttggntttggaaccncccaaactccgataaa

SEQ ID NO: 80303 - DNA, 653 bp, Triticum aestivum
  unsure (1)..(653): unsure at all n locations
  Clone ID: PAT_TA_80303
gccgcccctcgctgccgctgcgtctcgtctccaccaccccacttgcccccggactcaggaggatcgtcggagatgtcggacaccgatnagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatgggaaagaagcttgaggatatcgttccttcatcccacaactgtgacgtcccccatgttgaccgccaagattatcagctgattgacataactgatgatggatatgtcagccttctcactgagaagtggtaacaactaaagggatgacctgaaacctcccaacttaataatttctgccttggccaaaattaaaaactgggattttgcttgatnggaaagggacctgattcctgttctgtnaatntcccgncaatnggttaaanaaaaaaattntgcncctgttnaanggaatccggtgggnngggaaaattaancaaactngtgngttgggttgcccaacctcngaaaacttgggaaccaaangcctnccggggttttt

SEQ ID NO: 80304 - DNA, 478 bp, Triticum aestivum
  unsure (1)..(478): unsure at all n locations
  Clone ID: PAT_TA_80304
gtctctctctctctctctctggaaacgcnacgccacccggagaaacnctcctcccgcacctcgcntcccacccngccaaaancctcgcccctcctcctcctcctcctnttacaanggacgcgcngacgcntccgnccgccgncgcccccgccgcggngcnaggaacgacgccgccggcgcaagtngtnggcaacgccttcgttcagcaatantaaaaaatcctccaccaatcanngggagctcgtcttncgcttctatcaagaagnaagncgcaatcggtcgccccnccancaaacggggggcgacatggataacggtcantaccatggaaggngattaaacnaaaaaaataatntccatgganatccctccggggccggaaattaaagngggtggggnggcgcaangaattcactantgtttggngggtttgaccgtnccttgtcaacgngggccaacctcaacaaaggnaaaggaa

SEQ ID NO: 80305 - DNA, 239 bp, Triticum aestivum
  unsure (1)..(239): unsure at all n locations
  Clone ID: PAT_TA_80305
gcctttatactgggttggtactgtacaaaggctttgtgcaaactgtgccttggttgctgtgcggagcaacttcaaataaaaaaaaaaaaaaaaaaaaaaaaaaaaaaaaaaaaaaaaaanaaaaaanaaaaaaaaaaaaaaaaaaanaaaaaaaaatcaaaaaatgcnaaancntaaaaanccttnncccnggggggggcccaanncnaaattcccccaaatctggaacgntatccccc

SEQ ID NO: 80306 - DNA, 621 bp, Triticum aestivum
  unsure (1)..(621): unsure at all n locations
  Clone ID: PAT_TA_80306
gcgatcttgttcttggctgcgttgttgagagctgatagtctccattccagaaattgtcgggttcaattggatcccaaccccactcctcaggaggtccgcccgccatcgccatgggcagccggtttgtgaatctgttggccatgagctgcaacggcggccccaagacacttcagccttcactgcttgaacccggcaaacttatttcgcccagcccggtcacggccagcgcttcgagcaattcatcgacggccaacggacgccccgctgcctccgccgtccctgtcattcgactggccctgcaagaagggcgaagaggcgtggattnaatttcatggctttcngccccgggcgggaaaacctcctcgcccgtggaccaaatcggcangagcttcttgtacaaacacgaactcccgcttgctccccactgggaatgcccaaagattgngcaaagcccaatttcngaaccccaatnctccgttngccgttgggcgaaaagcctaataccgtcaatgaagcggggaaacccctggcccgggtggcccnantttggggggtggccttcaaagggtcctccctcaaaaaaacccggccttgccttggntaacccaaaccccnaaaaaa

SEQ ID NO: 80307 - DNA, 664 bp, Triticum aestivum
  unsure (1)..(664): unsure at all n locations
  Clone ID: PAT_TA_80307
ttcccacttagctagctagcagccatggccgccctctcctctgcagccgtgtccgtcccttccttcgccgccggcgccaaggtggccgctccccggagcagcaggatggtggtgcgcgcgtccctgggcaagaaggccgccagcgcggccgtggccatggccgcgagcgcgatgctgctgggcgggtcggcgatggcgcangacgtgctcctgggcgccaacggcggcgtgctggtgttcgaacccaacgacttcaacgtcaaggccggcgaaaccatcaccttcaagaacaacgccgggtacccgcacaacgtggtgttcgacgaagacgcggtgccctccggcgtcnacgtctccaagatntcccaagangagtanctcaacgcccccnggggaaaacttctccgtnaacgcttaacgttccccgggacctaacggtttctaatngcgaaccccaacnccggaacccggaattgtccgggaaaggtcaaccgttcaactnaaanctgtcaanctaaactctttgccaaattnttccgggtccggtttattnaatttggggcgtnntccatgnaangcaaaaantggaatnaaattttcccttacgtacnnccaaaangttaaaaagnttttcaacttttaaaaattanaaataagggtcctt

SEQ ID NO: 80308 - DNA, 490 bp, Triticum aestivum
  unsure (1)..(490): unsure at all n locations
  Clone ID: PAT_TA_80308
gcacactctccagcaccagcaggccggcggcaatcancgcaagcacagcagcaaatggctaccatcancgccgccgcngtnaccaacgtcgtcgcccntgccgccatcccnaggccgcaagncctatgtctgccccagctgangactangagcgagagggtgaggtgcaagctactccaaggacgccaaggaggcgaccccgtgcggccgccgtccgcggggccggngcgtccctgctcgccgcggcgggccgcggtgacccgcttcctnnngggccggcgctcngctctngtcgantagcgggttgtnnacggagggcaacgggcctancctggggcttgagcaacaacctgctangggttggattcctcntggggngtctttcngnctcatcttggtcgccttttcaccntttcttatacctnctggccttctaacaaggactanggaattccgggcnggntttnctctntnaaagcaatnattcctt

SEQ ID NO: 80309 - DNA, 665 bp, Triticum aestivum
  unsure (1)..(665): unsure at all n locations
  Clone ID: PAT_TA_80309
gctcctccttcaatcctccagcgaaaccccgccccaccccaccgtcagcatccatggcgcccaaggccgagaagaagccggcggcgaagaagccagtggaggaggagcccgcggcggagaaggccgagaagaccccggccgggaagaagcccaaggccgagaagcggctgccggcgggcaagtcgtcggcggcggccaaggagggcggcaaggcgaagaagaaggccaagaagagcgtggagacgtacaagatctacatcttcaaggtgctgaagcaggtgcaccccgacatcggcatctcctccaaggccatgtccatcaatgaactccttcatcaacgacatcttcgaaaagctcgccgggcgaagccgctaagctggcgaagtacaacaaagaagcccaacatcacgtcccgggaaattcaaaactccgttcgnctcgttcctccccggngaactcccccaaacacgccgtttcccgaagggcaacaaaggttgtcaaccaaagtttaactcctccctgaaatccncnttaattttncttttttgggttttntttgttggccntttttatcnttttaaaaatccncaanccccttttgttttctgggntttcccaaaaaaanattaaacgggggcccggccccaaaaaaaaaaaaaaaaaaa

SEQ ID NO: 80310 - DNA, 333 bp, Triticum aestivum
  unsure (1)..(333): unsure at all n locations
  Clone ID: PAT_TA_80310
ggaattgcacgtctcccctcctctgatcattcatcaaacaaatacctcttgtctcaatcatccatggacatggatcgccgtcgccatcaccacgccggagaattcgtggcggacgtggtgctgtggcgccgaggccgggcggacatcaacgcgctgctgctggcggncgccgtcgcctcctggatcctcttccacggcgcttccggatacacggnggtgtcgctggccgccgacgttctgctcctcctgctggcggtgctctacgcgtggtccaaggccgcgccgcctcctcggtcgccccgccccgcccattcccgtaccttggaancccgg

SEQ ID NO: 80311 - DNA, 393 bp, Triticum aestivum
  unsure (1)..(393): unsure at all n locations
  Clone ID: PAT_TA_80311
gcttctcctcnccactcantcctcggttcccggcccggttcggttcgttagggtttagtantggggaagaggaggaagaatggnggacntcgagtaccgctgcttcgtcggcggnctcgcctgggccaccgacgaccagtccctccagaacgccttctccaagtacngcgactgtcatcgactccaatatcatcactgacagggagacgggccnttcccgngggttcgggttccgtcaccttcncntcngacgatgcgatggngcnatgctnttcgaacgnccatgtaanncggccangtaccctntatcggncgncaaccatncacccgtcnaacgntggtcccattccncgccggcntcncgtnctgantgntgttcgcngngttttagtt

SEQ ID NO: 80312 - DNA, 601 bp, Triticum aestivum
  unsure (1)..(601): unsure at all n locations
  Clone ID: PAT_TA_80312
gcggacgcggccatctcctgcggtcaggtgacctccgccttgagcccctgcatctcctatgcccgcggcaatggcgccaacccgactgcggcctgctgcagcggtgtcaggagtctggccggcgcaacccgggagcaacgcttacaaacaaagcgggctgcaaagttcatcaagagtgctgccggnggggctcaaaccttggnaaggccccnggaatccctccaaagtngggggtnagggttccctaatgcatcaacgcaaaaattcaatggtctaaaaatcccttattaaacacttgccanaatggnttgcccctataaccccatncaatgggcncttaaatnttcttaaggtcaccaatncttttnaaaaaatgcncngatttgatttccaangttaagggaaaaaaagggtttgttttggnccanatatnctctattggggngggcaacaaattgtgccaaanaaaaaaagggtgcctttttnatttttccggggcgttttanaggaaacccccggntttttttttgttttttccaaaatnttcccncccctgnttttttggaatcttnaaacaaccctcttccncgggggtcccaaa

SEQ ID NO: 80313 - DNA, 718 bp, Triticum aestivum
  unsure (1)..(718): unsure at all n locations
  Clone ID: PAT_TA_80313
gccagactctcccacagttccacgtctccctcccctccaggcttcgctcaccgaaatggcgaaaccctcccaatcgcgcctcctcctcgtcttccccgtcgccgccgtcctcgcctctgccttcctcctcccgctcgcccgctccgacgcctccgggcccacccccaccgccaccgcctacgacgaagctccgcctccgttggnttcccgcgcggcctgctcccaagcaaantttcgggggtaaaanctcgaccttggctcggggaantncgccgtnaaactccgaacccaagttgccggaatccttgcttgccngggggggaagcttaccttcgccaaatttaaacgaacaacctcaaacngggcaaacttcgaacgaaacgtttgcaatctcccgggcctcaaaagcngggattccggcgttcaaggggcttttcttccggcttggtnggttccaatnccncccggggatttcggcgnccgaattggggaaacaancctcnttcctttcgaagggngggggtttccgttttcccgccaaaattttccttgcccggccaaattttnaaaggccaangccttcaaaatgggcccccccccaagggccgaatccttattatnataaaaaaggggaattnttgggtngccnaantaaaaatgggaaanacaantaaaatttnctnccaaatttanaaaatntaaaaaggggnaacctggg

SEQ ID NO: 80314 - DNA, 263 bp, Triticum aestivum
  unsure (1)..(263): unsure at all n locations
  Clone ID: PAT_TA_80314
ggagagaactagtcccgagtttttttttttttttttttttttttttggaaagaattacaaaatgagcttttcttatttatattctttctgttgggttgggacatggagctgccgctcttgtacaggcaacctcctctgctctgcatttcattcagcaaataactcatggccttgcttctggtaccctacaacctaaagactaccaactactactagtacatgcaacctccncctcaacctctacaaacaaggtaaaaaaaaaa

SEQ ID NO: 80315 - DNA, 590 bp, Triticum aestivum
  unsure (1)..(590): unsure at all n locations
  Clone ID: PAT_TA_80315
ggccatggccccagccgtgatggcatcgtccgccaccaccgtcgcgcccttccaggggctcaagtcgaccgcgggcctccccgtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccggctactacgacggtcgatactgggacaattgtggaagctgcctatgttcgggtgcaaccgaccaaacgcaagtgctcaacgangtgganggangtcaaaaaanggattaccctgaacgcctnatgttccgtnttcatccgggnttcgaacaaaaatgncgccaagttgcaantngttcaagcnttaattggccttcaaaggncaaccaaggcctgcgaanggaatctgggaaanggcctaaaagtgcaaagttnaaattaacaanatann

SEQ ID NO: 80316 - DNA, 557 bp, Triticum aestivum
  unsure (1)..(557): unsure at all n locations
  Clone ID: PAT_TA_80316
gagagagagttggcaagcaagcgcagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccaagtttgttgacaagtacggcgccaacgtcgacggctacagcccaatctacacgccggaggaatggtctgaatctggtgaccgctacgccggcgggaacgaccggggcttcttatctgggccgtcaccctcgccgggctcctcgggcggcggcgtcctcctcgtctacaacaccagcgctctcgccggctaaganagcatctacgttgtaacaaagggccgggtctctgcttgatgcacttctctgttatctaagttacctcctcctgtgaatgttntgtcaacaaccnatccaaaattanttta

SEQ ID NO: 80317 - DNA, 444 bp, Triticum aestivum
  unsure (1)..(444): unsure at all n locations
  Clone ID: PAT_TA_80317
gccaagttaaggattgaactggcatccggtggtattgcaccttccttgccaccggatgccaagttaaggattgaactggagctggtttcatggaagactgtcacaaaaaagggggatgacaagggtgcagatactgaagactcctcatgaaccatgaattaatagaggtggatcaggagaaccttgtgagcgcattacaatatcagtgcccgcttcaaacttgttaacatgttgagggtagttttaggaaaatattctaagttagttcctgtagcaagcatgatgaacattggctggtggttgtatatatggatcgtgtccgggcgcgccggccatgcatgggctangatttggagatttaggatcttgctccggctaggatttggccatttaggatccttcctcnggttaaattaancnacagatttttccttcccnggtttt

SEQ ID NO: 80318 - DNA, 471 bp, Triticum aestivum
  unsure (1)..(471): unsure at all n locations
  Clone ID: PAT_TA_80318
gcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaaactgttaagctgcatgcactccgtggtgatggtgtgagagtatacgtgaataacgagcgtccctctgatcctgatggagtccaagcaaggggtgcgttgtnccntgttgcgtnttggttttacttggctccgctcctcccgccttatgctcctgccccttggggntcccttgnagttggta

SEQ ID NO: 80319 - DNA, 566 bp, Triticum aestivum
  unsure (1)..(566): unsure at all n locations
  Clone ID: PAT_TA_80319
gggaattactagctcaattggcggcagaagaacaacgtggtcatgaactcacaaaaaaagttaaagaattactgcctactactaagaagaacgttaaaccggagaggccgccaccacgcanaagaaggagcaatgatagagcaaggatgtcgaaatgccttaccaaagaggccgagctatactttgaagatttcctgtcaaatgttgaagataccgatttttcatcgtttgatggtgaaagaagtgacacgagttcaactagaaaaagatgtggtacttcgtgctatggcggaaactcatgtagtccttccgaaagttgcaccacctgttgtgtcagatggtgttgtccttccctggttgcaatgggaaactagcaaccatntacatgcctccccaaccacaatcaaagacacaaggaccaagcactgcaatgcagcaacancaatcacaacatgagcaacccttgggancctggngcccctggaaaacaanatagctcaaactngctccgaaagnatggactaactttccaaggttccaacaaaggccncgacncncctaaacan

SEQ ID NO: 80320 - DNA, 566 bp, Triticum aestivum
  unsure (1)..(566): unsure at all n locations
  Clone ID: PAT_TA_80320
gtcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacngtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgnctccagttcancaangttgggtttatcttncgtgagcacaaancatccccctggggtactacgatggccgggttactggacnaatgtgggaaagctgccctatgtttccggggtgcaaccgaccccaacgcanggttattcaacgaanggttgnangganggttcnaaaaaaagaanaacccttnaanccccttcngtcccnccaatcnncccggtntnccaaaaggaaatccgcccaangntggnatttcgttcannctttnaatcg

SEQ ID NO: 80321 - DNA, 479 bp, Triticum aestivum
  unsure (1)..(479): unsure at all n locations
  Clone ID: PAT_TA_80321
gcctcgtgccgaattcggcacgagggcgacaaccaactccgcctcgacctcccgccgcatctccgacgacatggcccgcaccaagcagacggcgaggaagtccaccggcggcaaggcgccgaggaagcagctggccaccaaggccgcccgcaagtccgccccggccaccggcggcgttaagaagccccaccgcttccgccccnggtatcgtcncgctccgcgagatccgcaagtaccaagaagagcaccgaagctgctaatccgcaagctccccttccagcgcctcgtccgggagatngcccaaggacttcaagaccgacctccgcttccaagtcctccggccgttttccgccccttgcaaggaagggccgcccgaaggcctaacctccgttcggggctgtttcgaanggaaaacaaaatcctgttgcgccaattccaacgccaaaagncgnnttcaccaatnattgcccaaagggaca

SEQ ID NO: 80322 - DNA, 478 bp, Triticum aestivum
  unsure (1)..(478): unsure at all n locations
  Clone ID: PAT_TA_80322
ggtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtnccgcatcatcggattcngacaacatgcgccacggtgcactgcngtcaagcttcatcgccttcaaanccaaccngggctgcnatggagntccgggcnaggccctaaaacancccaactcaacggacagggccaatnataataaaagtgccaattggcagtttttgntcaacctcctgacattggcctttngggttttccctcccccaattaacccttccctaattgntccctaaaaaaantgtgttatngtccaatgttcaaggtnccaaacattggnttccgangaaaaccat

SEQ ID NO: 80323 - DNA, 579 bp, Triticum aestivum
  unsure (1)..(579): unsure at all n locations
  Clone ID: PAT_TA_80323
ggacagagttggcaagcgcagacagacagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccagttcgttgacaagtacggcgccaacgtcgaagggctacaagcccaatcctacaacgccagaaggaatggtctgaatctggtgaaccgctacnccnggggggaaacgaaccgggcntcttaatctggggncgttaacctccccgggctccttggggggggggggtcctcctcntctaaaaacaacancnctctcccccggntnanaaaagcaactaanttttaananaaggggccgggtcnctggccttgcaatgcaacgtttctnttatcccanaaaaacctaacctcctngtgaattttntgccaatccaacgaatgcaaaagttanttt

SEQ ID NO: 80324 - DNA, 581 bp, Triticum aestivum
  unsure (1)..(581): unsure at all n locations
  Clone ID: PAT_TA_80324
ggcgcaactccggcgccaccgccgcctcggcccctccggccgccgccatgtacggctcctaccccgtgccgcccgcctcctccgccggctacgccaagatccccacctacccgccgccgccctcctcctcctaccccaaccccagccccgtcccgcccgctgcgccctccgcctccgccccggccccgatccaggaccccacggngccgccctcctcgctcgccaaggcggccgaagctcgtcacgcggttccgggagcaaggccaggcgctcatcgccgcgcgccgcccctggggggaggtcttccgctcccccgcttctccaaagccgcccaaacgtcggcgaagccgtttnccggggatgcgccgcaacangggntantttccgcggcaaataaggngnttgnccgttctcngccgttnttcccccgccttncntaatcctgggaanccgggggnaaccttcntntggggnttcctcggggtttggggcggcctgggttnttcttctaatttcgcgccgcccccgccgaaggggggcccaaaccgctccggggtctttgggaancnaatttcaanaaa

SEQ ID NO: 80325 - DNA, 568 bp, Triticum aestivum
  unsure (1)..(568): unsure at all n locations
  Clone ID: PAT_TA_80325
gcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttggactgatggacttaccagtcttgatcgttacaaagggacgatgctntcacatcgagcctgttgctggggaaagacaagccaatgggatncngttntgttaccttaanccaatttanaccctaatttngaagaagggttccgttaactaaacaatgttttaacntccaattgtaagggttaacgttattttgggtttccaaaaagcccctnacgttgcncctancgnttggggggggttntaacnaaattccccccctancttaatncaaaaaacttttccaaagggccccccccaatgggancccaaatttntaaaanaaaaaanttt

SEQ ID NO: 80326 - DNA, 603 bp, Triticum aestivum
  unsure (1)..(603): unsure at all n locations
  Clone ID: PAT_TA_80326
ggcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctccnagttcagcaaggttnggttcatcttccgttgagcaaaaacgcaatctcctggggtacnacnattggccgggtattgggacaaattgttggnaagctgcctatgttccgggtggnactngacccccaacaaaanggtnattcaaaccaagggtggaaggaanggtcaaagaaaggaattaccccttgaacgcgntntgttccgcnatcatncggattccgacnaacaatgcntccanggtngcaatncgntccagctttcnatcgncctttcaangccaacccggggcttgcgaaaggantcccgg

SEQ ID NO: 80327 - DNA, 539 bp, Triticum aestivum
  unsure (1)..(539): unsure at all n locations
  Clone ID: PAT_TA_80327
gctcccgcgtaccaagccaccgaccaacatggcagcgtctctccaagccgcggccacgcttatgccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaagtgcgccgacgccgccaagatggccggnttcgccctcgccaactctgccctcctcgtctccggcgcgagcgccggagggggcgcccaaanangctgaccttccacgagattcaaagcaagacctacattgaggtgaaaggtaacgggaaccgcgaaacaatgcccgaacatcgaacggnggggtccaatccnttcccntcaaaggccggcaagtacaaatgaaaaantttgcctggaagccaactccttaacgtcaaggcganggcatcaaaaaaaacanccnccgccttcaaaaaacaantnataaccgttaactaaacctttanaaatggaaggcccncaagtcc

SEQ ID NO: 80328 - DNA, 553 bp, Triticum aestivum
  unsure (1)..(553): unsure at all n locations
  Clone ID: PAT_TA_80328
ggcagagcaccgcctcgtctcttcctcctcctcctccgcggccggccatggcgcctctctccaccgccgtccgcctcctgcgctcccccgcggctccggtcacgctcccttctccgtccgcccgcctcgccggggcgccagcgcgcttccggtgccgccgccggctccggtcggttcgcgcggaggcggccaaggaggcggaggtgggggaagctcagggccggggtgtccgtctacaaagcccgcgctcctaacgaggtgctcgtctccgacgccgcccgctccctccgccggccgccatcgacgaagggcaagganccgcctcgaaatngagttcccgcctctggccaacancatctctttcttaaaaaggggtcttcggacgaagttcatcgaattccaaacgtccaagctccgctctccgcccgtccgtaaaggggaacctcaaaaaaagcttnaagggggactcnggtccctngcaanagntgnttcccttgatnaaaccaanaanaagccgaaagggcctccccaaaattattcaaaaanaagcttt

SEQ ID NO: 80329 - DNA, 405 bp, Triticum aestivum
  unsure (1)..(405): unsure at all n locations
  Clone ID: PAT_TA_80329
gctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtncaatgcaggtgtggcccattgagggcatcaagaaagttccaagaaccctgtcctactttccaaccgctcaagcaacgggaggccctccctcaaagcangtccgancnaacctgaattcgctnccaaagttggggtggcccttgcctccgaatttcaagcaanggggtgnggttcaatcctcccgtnaagccacaaaagccanccccctggggttaataatnaatgggccc

SEQ ID NO: 80330 - DNA, 586 bp, Triticum aestivum
  unsure (1)..(586): unsure at all n locations
  Clone ID: PAT_TA_80330
gaagctaagctaaacagcagcgagcaatggcgtccacctcctgcttcctccaccagtccaccgcgcgcctggccgcctcggcgcgccctgcgcccgccgtcgggcgcacccagctgttcgtctgcaaggcgcagaagaacgacgaggctgcacctgacgctgccgtcgtcaccaagccggcgcgccgcgctgtccctcctcgccggtgccgccgccgtcgccgtcaaggtctccccccgcccgctgcccgcctaanggangaaacaaccgaaacgtgttccggcaaanggcgaaagaaanaaacaacggacnttcgtgggcataacancnggggaagggttcaaaactgaatgattccccggccaaattgggaacccaagcaaagggagcgtnagnttccctgggcaaggttgctncccgcctaccaaggaacaactttcgaacgcccaccaagcaaacctnctcccgttnataatcaaaccccgaccaaccaaagaaagnacaatccaccggnttaacgggttccccctgaagggggttccnccccccaaggttcgggttttctnccnccgggcaannaattcct

SEQ ID NO: 80331 - DNA, 561 bp, Triticum aestivum
  unsure (1)..(561): unsure at all n locations
  Clone ID: PAT_TA_80331
gcctcgtgccgaattcggcacgagggcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcagcccgtggtacggctccgaccgcgtgctctacctcggcccgctatccggcgaccccccgagctacctcaccggtgagttccccggcgactacggatgggacaccgcggggctctcggccgaccccgagaccttcgccaagaaccgggaagctggaggtgatccactgccggtgggccatgctggggcgcgctcgggtgngtcttnccggnggttgtcccccgcaacggngtnaaatttcggcaagccnttttggntcaaaggcccggctcccangattttcaaccgaggggcgggctcnantanctcgggaaaccccancctngtccaatgcncanaacnacctncnccatcctgggccttgcaagt

SEQ ID NO: 80332 - DNA, 281 bp, Triticum aestivum
  unsure (1)..(281): unsure at all n locations
  Clone ID: PAT_TA_80332
ccggttcgggttctggttcggttcgggtccganagtagctancctantctatggtttccgtatttcgganagganagaaagggaganatccatggcggagacggagtaccgctgcttcgtgggcggcctcgcctgggccaccgacgaccacaacctccagcaggccttcagccattatggcnatatcctcgacgccaagatcatcaancacccgcgtnngacggngcatgtcccgtggnttcggcttcntcacgttcggcagcgagngagtcgattgctcc

SEQ ID NO: 80333 - DNA, 576 bp, Triticum aestivum
  unsure (1)..(576): unsure at all n locations
  Clone ID: PAT_TA_80333
gaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgaagcacaacgcatcccctgggtactacgatggccggtactggacaatgtgggaaactgcctatgttcgggatgcaccgacnccaacgcaagtnatnaacgaagtggagggaaggtcaagaaaggagttaccctgaaccctaatgtccgcatcantcggattcgaaaaaaatgcntcaaggtgcaantgcggtcagctttcatccnccttncaaanccaaccggggcttgccaaggagtcccggcaaaggcc

SEQ ID NO: 80334 - DNA, 175 bp, Triticum aestivum
  unsure (1)..(175): unsure at all n locations
  Clone ID: PAT_TA_80334
gtgctttcacaacatgggctgacgaaccctacgatccaccgncggataattcngcgcaaatcgttacaccanggcaggttcgatcgctcgtataaaaagtangttcgccaaccatctnanccccactanttannacctaccactangnccaccanttganntctgtcccattgaa

SEQ ID NO: 80335 - DNA, 583 bp, Triticum aestivum
  unsure (1)..(583): unsure at all n locations
  Clone ID: PAT_TA_80335
gcgagaaagcacggcgcttctcttcccccaatgcagattgatggagctgcagggatcatggctttggacctttggttcgatgtgtgagtgatgattccctttcgccccgttccaatctcctagctcaagtaaagaatcgtcgcctcgccacaaggcacaagccaaggccggggacaatggctctgcggttcttggcggtcctggggtttctctccgcggcggcggcggctgcggtgctgcgggcctgagcccggagggtgaaagccaaagcgacacggacgcgctggccaatgttccggcacgcctgccgacgcgcacggcaatcctgggccggcaactggagcaagcctccgacgccctgcgcccgggccgctgggaccgggcggtgggggtgctcctccggacgggccgcccggggtcaaccttcgctctccctcgggttcgctccgaacctggcggggggctctctcngaacccgctctccaacctcaaacgnagctccgcggtgcnccgaacctcccnnggggaaacngccccnaanggggaaccctccnaagggccncctccnccgggggtccccnaa

SEQ ID NO: 80336 - DNA, 469 bp, Triticum aestivum
  unsure (1)..(469): unsure at all n locations
  Clone ID: PAT_TA_80336
gccaaccgaaccgaggatgtcttgctgcggaggaaactgcggctgcggcaccgcctgcaagtgcggcaacggctgcggcggctgcaacatgtacccggaggccgaggccgccggcgccancctcctcgtctccgccaccgccanccanaaggcgagctccggcggcatggagatggcgggccganaacgggggctgcggctgcaaccantgcaagtgcggcaacanctgcggntgctcctgctgcaactgctagatnatttgatcatcnattaatgcaagcaaccgcgccgtgcancatcnatnatatccgatntactactaccataacatgttaaccgctaccttgattcgaaggggccttatctaatgcaacctgaacttgcatcaacagtcaaaggtgccaatnccaatgccttgttnttaaaaaaaggcccccctnaaatnaaaancncccctgggntttaacct

SEQ ID NO: 80337 - DNA, 250 bp, Triticum aestivum
  unsure (1)..(250): unsure at all n locations
  Clone ID: PAT_TA_80337
gctttttttctccccctcccttcattcatgtaaagtatcctccaatgttactgtcaaagcgtacataatcgtatggcaaaagcatgctcccctgggaaatggttttatgataatcatagtgttttctctagggaaaaaaaaaaaaaaaaaaaaaaaaaaaaaaaaaaaaaaaaaaaaaaaaaaaaaaaaaaaaaaaaaaaaaaaaanccangggggggcaaaaaaaaaaaatncccccnaanaagaattc

SEQ ID NO: 80338 - DNA, 522 bp, Triticum aestivum
  unsure (1)..(522): unsure at all n locations
  Clone ID: PAT_TA_80338
ggagagagagagagacagagcccgaagccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaacggcgttgattccccgacttcaatgtgccaagggcgggcgacttcaacangggcaacggcaccgggaggcgaatccatctacggcgagaagttcgcccaacgagaagttcctccaacaaagcaaaaccaagcccgggatcctnctccaatgggccaacgcccggggcccaaacaacaaaccggctnccnagtttcttcaatcctgcaacggtccccctgncaatttggntnccaacgg

SEQ ID NO: 80339 - DNA, 450 bp, Triticum aestivum
  unsure (1)..(450): unsure at all n locations
  Clone ID: PAT_TA_80339
gagagtctccgccgccaccacccatgctcgccggcggcgccgcccctggacgacgacaacctgctctccgagatcctcctccgcctacccccgcagccgtcctccctcccccgcgcctccgccgtctgcaagcgatggcgcctcctcgtctccgacccaggcttctcccgccgcttccgcatccaccaccgccgcaaccctcccctcctcggtattttcgatgaacgctctggcgagatctccttcctacctactctgggntgccccaatcgtatccgcccggttgcttattctttgaaagttcgacgggcgggcnaccgctttcctgcccccctcggggatgtccgccantgggcctttggttnnctccgtccttccaacttcaaacgaatncttgggaaaacannattcctgggggtngtgaatncctggccaaccnncccgaaccaa

SEQ ID NO: 80340 - DNA, 526 bp, Triticum aestivum
  unsure (1)..(526): unsure at all n locations
  Clone ID: PAT_TA_80340
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgattgccggtattggacaatgtggaaactgcctatgttncgggtgcaactgacccacacaggttatcaacaagttgggngggaggtcaaaaaaaggagtaaccctnaacgcntntttccgcaatcatccgggnttccaacaaanattccnttcaagggngcaa

SEQ ID NO: 80341 - DNA, 563 bp, Triticum aestivum
  unsure (1)..(563): unsure at all n locations
  Clone ID: PAT_TA_80341
gcaagcaagcaagcagccaccgaagcagcctccgctcccctccccgaccccgaagcaatggcgcgcacgaagcagacggcgaggaagtcgaccggcggcaaggcgccgaggaagcagctagcgaccaaggccgcccgcaagtcggccccggccaccggcggcgtgaagaagccccaccgcttccgccccggcaccgtcgcgctccgtgagatccgcaagtaccagaagagcacggagctgctgatccgcaagctgccgttccagcggctgggtgcgggagatcgcgcaggacttcaagatngacctccgcttccagaggctccgccgtgtccgcgcctgcaagagggccgccgangggtaactcgtcnggctcntccaaggacaacaacctcctgcgccatcaatccaagcgcgtcacatcatgccangggnnatcangctntgcccgccggaatccgcagggaaaagggcctcaaccggnggtcngccttttgcttgcnttntnaaaaaagtcccgcnngttgatgttccnggtctaaangcttggggggtttancanaaaa

SEQ ID NO: 80342 - DNA, 486 bp, Triticum aestivum
  unsure (1)..(486): unsure at all n locations
  Clone ID: PAT_TA_80342
ggccaacactctctccccgacgaccacaaggcccccgacgaccactcgctcctccccgccctagatccctcgccgccgccctctccctctcgtcggtgtcttcctcaccgcagccttgctcctcaccacccctgaaactagcaacatgtctccccctcgttggttaaaggtgaaatttttaccaagccggggtgctcgatctgtgggcggcggtgctcgatctgtgctngagcaacgggaggaggagggcaagtgctgggactggagcatcgggaagaggggggtgggttcccggacgctcttaactttgtgttagtcctctctggctcctcgtcctngtcttccnccgccgaaggaanancgganaaccccggccggaggggaaggaacccccaatngnccggttttttgaccncctnccggtttnanaattcaagcctccaacnaatcantcccccttcttggttgccttgctctctcaaatta

SEQ ID NO: 80343 - DNA, 269 bp, Triticum aestivum
  unsure (1)..(269): unsure at all n locations
  Clone ID: PAT_TA_80343
gagagaactagtcgcgagttttttttttttttttttttttttttttttttttttttttttttttttttttttttttttttcccaaaaaaaagccaatacttcaanaccttttcctttttcgngtanngtaaanccccagggcttnanaatgttntcanaccattgnanaaactattttacaatnaaacnaagaanggggngcccattcaaaagcgttntaactcggntttanaaaaaaaagggggaatcttcccnaaaaanaaaggtga

SEQ ID NO: 80344 - DNA, 522 bp, Triticum aestivum
  unsure (1)..(522): unsure at all n locations
  Clone ID: PAT_TA_80344
gccctgcctcagctgaaaaaattcactggccaccagcgttaggataattttgctgcattgcgacagtgtaactaagttttcccaaataaacaagttgtggttatttgaggtttgtcccttttcaaaggcatactctggacgatgtacttaattaggacacnagctgactgtaatcatcgtaatcttgaaattttcanggacccagatatagatctcaatggtggtttgccttcaactttagtgtgcactanaacataaanaatttgaatgtttaagtagccggctagctgcctgtaggctatagcacatgttgtgagaaactgggtgaacatatacagggtgccacntgacagtgcaantggttatacncctgangtgatcccnaaattgggatttgagtttccccnggatngggtccaaggggattaanggttgnaaaaccgggngtaactattcccccggattaanataatggattctaatgtncaatccacaagtggccaaacggtgttnaatttcaat

SEQ ID NO: 80345 - DNA, 578 bp, Triticum aestivum
  unsure (1)..(578): unsure at all n locations
  Clone ID: PAT_TA_80345
ggatcgctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagagggaactcatgctgtcccaagtgaagggcaaggacatcaccgagctcttggctgctggtagggagaagtttgctgcggttccatctggtggtggtggtgtggcttgtttcanctgctgcccctgctgctggaggtgctgctgcccctgcaagctnaagtcaaaagaaagaaganaaaggtccctggagaaaggnaaaagagtgattaatnacattgggcttcaagtccgtttcgactaaanttgttgggggcatccttggggtcctgaatnatcccntgggccaagggaaacctaagaagtccaatngattnttttagcccctttaatttancccttaaatttgngnaaacccctggcaaannaaaaaatttttttgatatttntaattcaaaccccntg

SEQ ID NO: 80346 - DNA, 598 bp, Triticum aestivum
  unsure (1)..(598): unsure at all n locations
  Clone ID: PAT_TA_80346
ggtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactaccttgatccgctccaaagtgggttgcccttgcccttgagttcancaaaggtccggttcaatccttccgttgaagcaaaaatgcgtctnccccgggttaatnnanaacgggcggcttaatnggaacaaatgttggnaaaccctgcctnatgtttcgggggtgcaaccgaacgccaaaanaaggttantnaaacnaaggtgggggggaaggtcaaaaaaaggagttacccttgaacgccgttacgttccgcaatcaatccgggtttccaanaaanattgcccccaaaggtgnnanttggcttccaacnttaatttgcccttt

SEQ ID NO: 80347 - DNA, 557 bp, Triticum aestivum
  unsure (1)..(557): unsure at all n locations
  Clone ID: PAT_TA_80347
gccagcttcgctgcctcatatctcctcttccttctccatagcctctcttctcctgtccagtatctctgcgtcgatccaccccgccctcctcttcatcttcatgttcttcctangctaatcggtgaatccgcctcctcttagctaaccaatcgcccttaaacccgtcgacaaaataacgaaacgaanaacaagcaggccgcgtgcgtgtgcagtaggtgtagaccatcgatcgtatctaggtttgagttgctgctggatcttggatttgccggagttacgtgcgtagctagccgctggnggtgaggttaccgcatctttggggtgctttgactggttnatcgatcgggaaagcccgggcgatnnatgattggagggccagctcatccgatngcattcctgcatggactnccnactgggctcaanggtaaaaaatgtttgtngccgggaaaaattaacnggnanttacgaanccgggaggggangattttnagcaacanttatttncaattangaagttagaatttgccttttttttaatggganaanttgnctttgaa

SEQ ID NO: 80348 - DNA, 516 bp, Triticum aestivum
  unsure (1)..(516): unsure at all n locations
  Clone ID: PAT_TA_80348
cgccggcgtccaaggaggccggcggcgaggggaagacgaggggcaggaagaagggcagcaaggccaagaagggcgtggagacgtacaagatctacatcttcaaggtgctgaagcaggtgcacccggacgtcggcatctcctccaaggccatgtccatcatgaactccttcatcaacgacatcttcgagaagctcgccggcgagtccgccaagctggcccgctacaacaagaagcccaccatcacgtcccgggagatccaaacctccgtccgcctcgtcctccccggggaagctcgccaagcacgccgtctccgaagggaaccaagggccgtcaaccaagttcanctcatcctanacagcttangctttgatcctccgtccgcttcatgcccttcttgtgtgttacctangtccnggaagttatgaatgttacaaatccctttggtaaaggattctggctngcttgctttgcgggccttgaaaaaaaaataagtgaatgctttttgtccggaatcaa

SEQ ID NO: 80349 - DNA, 601 bp, Triticum aestivum
  unsure (1)..(601): unsure at all n locations
  Clone ID: PAT_TA_80349
gatcctcctctcctccgataatacaaataccatggcccccgccgtgatggcttcgtcggctaccaccgtcgcacccttccaggggctcaagtccacagccggcctgcccgtcagccgccgctccagcggcagcctcggcagcgtcagcaacggcggaaggatcaggtgcatgcaggtgtggccaattgagggcatcaagaagttcgaagaccctgtcttacttgccacccctctccacggaaagccctcctgaagcaggtcgactacctgatccgctccaaagtgggtgcctgcctccagttcagcaaagggttgcttcgtcntccgttgagcaaaaaanctccccccgggttactacnaacngtcgaatactgggacaaatgttggnaactgccctaatgttcggggttgcaaccgacncccacaacaaaggttgctcaaacnaaaggtgggagggaaggtcaaaaaaagggagtaacccctgaacncctantgntccggngtaatctggttttcaaaaaaacctgcgccaaagtggcaanttgggttnanttttcaanccccttnaaaggccaaccngggtttccaaagaattcccggn

SEQ ID NO: 80350 - DNA, 566 bp, Triticum aestivum
  unsure (1)..(566): unsure at all n locations
  Clone ID: PAT_TA_80350
gcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccaggcctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcaagcgtcatcgtgcctatgcgttgtgtgtgtgggccaaaaaatgccttaaancaatntggtccccccctncngcccngtggttttttccccccccnaaaaaaaaaatttnggggtttncttgtttnttcaaactnncccngaatatcccnccctnaaanaaaaaanctngttatngattggttg

SEQ ID NO: 80351 - DNA, 588 bp, Triticum aestivum
  unsure (1)..(588): unsure at all n locations
  Clone ID: PAT_TA_80351
gcacgtactccgccatggccccagccgtgatggcttcctccgccaccaccgtcgcgcccttccaggggctcaagtcgaccgccggcctccccgtcagccgccgctccggcagcgccggcctcagcagcgtcagcaacgggggaaggatcagatgcatgcaggtgtggccgattgagggcatcaagaagttcgagaccctgtcttacttgccacccctctccactgaggccctcctaaagcaggtcgactacctgatccgctccaagtgggtgccctgcctcgagttcagcaaggttggcttcgtcttcccgtgagcaacaacagctcccccggctactacgacngtcgatactggacaattgtggaaagctgcctatgttcggggtggaaccgaacgcaaaccgcaaggtngctcaaacnaaggttggaagggaggtcaaanaaagggantnacccttgacgcctaatgttccgntgtcaatcccgggttccgaaaaaacaatgccgcccagggtggcanntggcgttcangccttcaattgcctttcnanggccaacaaggcttnngaaggaatcctggaaagggcc

SEQ ID NO: 80352 - DNA, 579 bp, Triticum aestivum
  unsure (1)..(579): unsure at all n locations
  Clone ID: PAT_TA_80352
ggtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactgggacaaatgttggaaagctgcctatgttcgggtgcaacgaacgccacaacaagttgatcaaacaaggtggagggaggtcaanaaaggagtaaccctgacgcgttatgttccgcaatcaatccgganttcnaanaanatgccncaaagttgcanttgcgttaaagcttcatccncccttcaaagccaaccnggggttggg

SEQ ID NO: 80353 - DNA, 475 bp, Triticum aestivum
  unsure (1)..(475): unsure at all n locations
  Clone ID: PAT_TA_80353
tcaacaccaatcaaagcctccatccaatcccaagcaacctcgaagatgtcttgctgcggaggaagctgcggctgcggcagcgcctgcaagtgcggcaatggctgcggcggctgcaacatgtacccggaggtcgaggccgccggcgccaccctcctcgtctccgccactgccacccacaaggcgagctccggcgggatggagatggcggcggagaacggcggctgcggctgcacccagtgcaagtgcggcaccaagctgcggctgctcctgctgcaactgctaaatnattgatcatgcatgcgccgcgtgcatcatatctatggtctatctaacatctactaacatgtaacgcttcctgattcgaaggtcctttgtttgtntgttacgcaaccttccctgcaatancaaaacgggttgncaatgccatgcatgttaaaccctaaaataaaatctccccttggntttgccttaaaaa

SEQ ID NO: 80354 - DNA, 605 bp, Triticum aestivum
  unsure (1)..(605): unsure at all n locations
  Clone ID: PAT_TA_80354
gccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaggaagaaaagaaagaagaggccaaggaagagagcgatgattacatgggcttcancttgttcgactaaactgttcaattccaattctcctgtgggttcctcctatgcgaaaanacttgtcctaangttgcttttanggccaaattttgaaaaatttaataaagtttatggctgtttggagaactaaattatcctgtgcaaatgagtactgcaaaaaacctcctttgggaaatggtccttgttaaaaangnaaaatgggtcccaaaataaaggtttaattggttcttttgggggaaagnttttcccttttccngggcaatttacnggattaannttttccacaaatttttccanagccccgggggctttggganaancgncccntaaccntttttttnaaatttgggtnccccttaaanaaaattaaggggggttccanc

SEQ ID NO: 80355 - DNA, 562 bp, Triticum aestivum
  unsure (1)..(562): unsure at all n locations
  Clone ID: PAT_TA_80355
gctcctctcctccgataatacaaataccatggcccccgccgtgatggcttcgtcggctaccaccgtcgcacccttccaggggctcaagtccacaagccggcctgcccgtcagccgccgctccagcggcagcctcggcagcgtcagcaacggcggaaggatcaggtgcatgcaggtgtggccaattgagggcatcaagaagttcgagaccctgtcttacttgccacccctctccacggaagccctcctgaagcaagtcgactacctnattcgctccaaagtgggtgncctgcctcgagttcancaaagtttggcttcgtcntccgtgagcanaaaangctcccccgggttatacaacggtcgatactgggacaatgttggaaactgcctattttcgggtgaaccgaccccaacanaagttctcaaacaaggtggagggngtcaaaaaaggggtacctgancccaatgtccgcgtnancggtttcaaaacctgnccaaggngnatngggttnacttanaccccttaaggcacccggtttnnaagantccggnaanggctaaaat

SEQ ID NO: 80356 - DNA, 541 bp, Triticum aestivum
  unsure (1)..(541): unsure at all n locations
  Clone ID: PAT_TA_80356
gcatcatcccatcccccaagccataaacccaagtcggactcgccttcctcctccccaactactcctcctcgcctccgcgcatcgcaccgcaccgggggtcacctgagatcacatacacaatggtgaaggctgtggctgtgcttaccggcagtgagggtgtcaagggcaccatcttcttcacccaagagggagatggcccgaccaccgtgacggggaagtgtcactggactcaaggaagggctccacggcttccatgtgcacgctcttggtgacaccaacaatggctgcatgtcaactggaccacacttcaaacccccgctggtcntgtncatgggggaccccaaaattnaaatcccccaatgctgggtnattcttgggaaaatttnacaacttnggaaccgggttggtgttgcntaacatcaaattttccttgaactgncaaaantcccccctttactgggaccaaaatttcaaaattttttgggccngtgctntttntncctnccatgggggnacccctnattatttnttgggnaanggg

SEQ ID NO: 80357 - DNA, 582 bp, Triticum aestivum
  unsure (1)..(582): unsure at all n locations
  Clone ID: PAT_TA_80357
ggtcgctgcctatggacagactcccgagttctctgcaacaattgtacatccatggctgccatgcctttaagtcgttgctcaaggacgacggactccctagttcgctacaagccatggacggactaccaagttctctacaaaaattgaacatcacggaatgtcctgccatcgagtcactacctaagggcagcctcccaagttctctgaaagaattaaacatccaccactgccctgccctgacgtctctgcccaaggatggcctcccaagctctctgcaaaaattgatattactggactgccctgccttaaagtcnctgccggaggatggcctcccaagatctctgcaagaactaaagatcgttgggtgtgctgcaatcaattctntncccaaagggngggctccnaaattaaatgcaactatttggtgtccccttttgtgaacaanaaaggaacntaaganggacttncccctgntttanaaggaacaattcccaaagattcctaantttatnctgaaccaaaaggggacctccctgggncttgttnaattcctcctaaacttngcccccttaaaaaaccaaa

SEQ ID NO: 80358 - DNA, 568 bp, Triticum aestivum
  unsure (1)..(568): unsure at all n locations
  Clone ID: PAT_TA_80358
ggctcatagccattcaaagcctcttcatctccgaagctccaacccaaccgaggatgtcttgctgcggaggaaactgcggntgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccaatgcaagtgcggcaccaagctgcggctgctcctgctgcagctgctagatngatcatcgaccaatatgcatgcaccgtgccgttgcgtgcatcatcgattatatcgatntactactaacaatancatgntaacccgcaacctgattcnagggccttttatctatgcaacttgancttgcatcaacantcanggtngcaatgccaatgaatttgttaaaaaanggccccccctaaatnaaaanttccccctgattaaccttttaaaaaaaaaaaaaaaaaaaaaaactcnnagggggggggcccgntaaccaattcccccccaaaa

SEQ ID NO: 80359 - DNA, 493 bp, Triticum aestivum
  unsure (1)..(493): unsure at all n locations
  Clone ID: PAT_TA_80359
gcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcanttcgaggtggccgccgggcagtccggcgagggctgcagctgcggcgacaactgcaagtgcaanccctgcaactgttaagctgcatgcactcgtacgtacgtacgtgtgatggtgtgagaatatacttnaataacgaacgtctgatctgatggagtccaacaaaggtgcgttgtgcgtttnantttgcttggctcnctcncccgcctatgctctgccaaaggggtcccttgtgtgtaagtgtggtgcgcaagtccnccctgttaattgcctcaaac

SEQ ID NO: 80360 - DNA, 383 bp, Triticum aestivum
  unsure (1)..(383): unsure at all n locations
  Clone ID: PAT_TA_80360
gctccccttccggttcgggttctggttcggttcgggttcggttcgagagagaggccgagtagctancctagtctagggtttcggtaganaggaagtgagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacnttcggcagcgaggagtcgatncnccangccnatcgagganattaacggcaangagcncnacgngccgcaacatcacccgttcnacgangnccaagtcccnccnctnccgcntttngnggtc

SEQ ID NO: 80361 - DNA, 584 bp, Triticum aestivum
  unsure (1)..(584): unsure at all n locations
  Clone ID: PAT_TA_80361
gcctacatagtacagccatggcccccaccgtnatggcctcntcggccanctccgtcnctcctttccaagggntcaagtccancgccggnctccccgtnanccgccgctccaacggcgctagcctcggcagcgtcagcaacggtggaaggatcaggtgcatgcaggtgtggcccattgagggcatcaagaagttcgagaccctgtcctanttgccaccgctcaacacggaggccctcctcaagcaggtcgactacctgatccgctccaagtgggtgccttgcctcgagttcaacaangttgggttcatcttccgtgagcacaacgcatcccctgggtaatatgatggccggtactggacaatgtggaaactgcctatgttcgggtgcaccgacncccacacaaagtgatnaacnangtggngggaggtnaaaaaaaggagtancctngacgccgttatnttcgcaatcaatccggattcnanaanaatgcgcccaagtgcaaatgcgttcanctttcaatccnccttcaaaaccaaccggggcttcgaagaattcccngcaaagggctnaaanaactccactcan

SEQ ID NO: 80362 - DNA, 593 bp, Triticum aestivum
  unsure (1)..(593): unsure at all n locations
  Clone ID: PAT_TA_80362
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcaactcctgggtactacgatggccggtattggacaatgtggaaactgcctatttcgggttgcanctgacgcccacnaaaggtgattaacgaaggtgggagggangtcnaagaaaggggtanccctgacncttatgttccgccatcaatcnggattcnaanaanatgcnttcaaggttncaattgcgttcagctttnanccncctttaaanccanccggggcttncaaaggantnccgncaaaggccn

SEQ ID NO: 80363 - DNA, 261 bp, Triticum aestivum
  unsure (1)..(261): unsure at all n locations
  Clone ID: PAT_TA_80363
gtcggttttttttttttttttttccaaaaatgtgtttccggggtaatcaacaatcnattgtcantgatanaaaaccaaatntnaaatancaaacatcangttttanatatcanggnttaagcgccaaccaaacaaanaaccngaacngaactgaactgaaacggggtggncanggganagcacacagngttnggttgggtttcanacacacctccgaatccccnaaaggcgcctctgnccggaagcaacacaaaaaccccc

SEQ ID NO: 80364 - DNA, 580 bp, Triticum aestivum
  unsure (1)..(580): unsure at all n locations
  Clone ID: PAT_TA_80364
gcagcagcagaggcatcactgccagccgcaagaccttcaaccaggaaagggcacacctactacctaggtatatcacgtatattgatcgttgaagcatggctatagaaatagaatcatctgagttgagaagaattactaataatttttcggacgcccaaaaagttggaagtggtggctatggagacgtttacaaggcagtctacaatggggaagccatggcagtgaagttgcttcatgcgaccaaaggaattgatgacagacaattcatgaaggaactccgtaaccatatgaaggtccaacatccaaacattgtacgtctaattgggtattgcaatgaagagancaaagaaatatgttgaagctacctgatggcacgtctgttttggtaaacacaatatacaaaagtgctccgcctttgaatatatgggtttggnaagaagccttanattagcgtccggtcaaggnanttccnctangagaatnaatggcgcccnccatttnccaaattaatnaagggggacttgtgaanggtttgtttttnctcccaaatggggtgttgaaaaancgggttccnccnctt

SEQ ID NO: 80365 - DNA, 451 bp, Triticum aestivum
  unsure (1)..(451): unsure at all n locations
  Clone ID: PAT_TA_80365
gatccctgataccaaagctcatcttcttctccttgaaatctttttgggtccacagatttggaggatgtcttgcaactgcggatcaggctgcagctgcggctcagactgcaagtgcgggaagatgtaccctgatctgacggagcaaggcagcgccgccgccgaggtcnccgccgtggtcgtcctcggcgtggcgcctganaacaaggngggacanttcgaggtggccgccgggcaatccggcgaaggctgcaactgccgggacaactgcaagtgcaaaccctgcaactgttaagctgcatgcactcctacgtaatacgtnttatggggtgaaaatatacgtnaatnaacaacgtctgattttaatngagtcccaacaaattgtgcgtgtgtgttttggttaacntgcccnccccncccttctaatgctcncgccccttgctggtcccctgtt

SEQ ID NO: 80366 - DNA, 584 bp, Triticum aestivum
  unsure (1)..(584): unsure at all n locations
  Clone ID: PAT_TA_80366
gtggaattttacgcagggtcatttcccgaagttaggcgtctatggatatggggcgcagcacagctcagccaagttggaatagagaagggtgcaatgcaaaacctcgttgagctatttttcgtagactgtcccgagctacagtttcttcctgatggcatcgaacaccttacagcccttgagaaattaggtctgatagacacgtcagaacagctggtagataaactcctgcagatgagagattcagatgcatgcagcaaggatttaatgaagattagccacgtaagaatggttggagttcagctgaggcanaaaggattatgtgaacggatnangtgatataccgtcgctgttccaaaactcctgcgccgcaatgcaagaatgacagctccgtcatcttccccgtnggacttcacaagtgcaanaatttaacagttccatgggcaagatatccncttctaanaanttttttgcaagntcaaatccccccggacctcngaaantgtttccncntgtttanaacaactttcnccaaatgaaaaantaatgggccaattcctttgttacnaannggcaaaatanttnng

SEQ ID NO: 80367 - DNA, 572 bp, Triticum aestivum
  unsure (1)..(572): unsure at all n locations
  Clone ID: PAT_TA_80367
gcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcnagggcattaagaagttcgagaccctgtcctacctgccaccgctcagcacggaggccctcctcaagcaggtcgactacctgatccgctccaagtgggtgccttgcctcgagttcaacaaggttgggtttatcttccgtgagcacaacgcaacccctgggtactacgattgccggtactggacaatgtggaagctgcctatttcgggtgcaccgaccccacgcaagttatnaacgaggtggaggaggtcaanaaggagtaccctgacgcgtatgtccgcatcatcgggattcgacaacatgcgccaaggtgnaattgcgtcaggcttcatccccttcaaaccnaccggggttgcnaagaatccgggcaaaggctnaaacagctcaatcccccaacggggccaaaaaatnaaagnggcaatttcngggttttt

SEQ ID NO: 80368 - DNA, 431 bp, Triticum aestivum
  unsure (1)..(431): unsure at all n locations
  Clone ID: PAT_TA_80368
gcaaagctccacctcctccccacaccttcgcacaaagctccacctcctccccacaccgtcgaagcacccatggcgcctaaggcggagaagaagccggcgctggagaagaccccggcggggaagaagcccgcggcggagaagagacccgcggccgggaagacggcgtccaaggagggcggcgagaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgcaaagctggcccgcttaancaaagaagccaacaaccacgtncaagggaaatncaanaccttccgttcggccttgtccnnccccgg

SEQ ID NO: 80369 - DNA, 282 bp, Triticum aestivum
  unsure (1)..(282): unsure at all n locations
  Clone ID: PAT_TA_80369
gcaccaccgccgccagctccacacctcgagagggacgcctcgtcgccggagaagcagcaanaanaacatggccggaaggaatggcggcnatangaaaaaggnggtgacccgctccgtgaaggccgggctccanttcccgtgggccgcatcgggcgctacctnaagaaagggcgnctaccncgcancggcgtcggctncgngcnccccccgtttaacctcgcccgccgttccttctnagtnncctcccccgncngaggtncctgggagcctnggccgggcaaa

SEQ ID NO: 80370 - DNA, 414 bp, Triticum aestivum
  unsure (1)..(414): unsure at all n locations
  Clone ID: PAT_TA_80370
gatccctgataccaaagctcatcttcttctccttgaaatctttttgggtccacagatttggaggatgtcttgcaactgcggatcangctgcagctgcggctcaaactgcaagtgcgggaagatgtaccctgatctgacggancaaggcagcgccgccgccgangtcnccgccgtngtcntcctcggcgtggcgcctgagaacaaagngggacaattcgaagtggccgccgggcaatccggcnanggctgcaactgcngngaaaactgcaagtgcaaaccctgcaactgttaaactgcatgcactcctacnttataantgtgatggggtgaaaatatacgtgaaanaacagcntctgattntgatggagtccaacaaatgtgcctgtgtgtgtgggttanatgcccnccctccgt

SEQ ID NO: 80371 - DNA, 628 bp, Triticum aestivum
  unsure (1)..(628): unsure at all n locations
  Clone ID: PAT_TA_80371
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcancaagggagggcctcctcaaacaagtcgactaactgatccgctccaagtgggtgccttgcctccagttcaacaaggttggggttttatcttcccgtngagcacaaacgcaacccccttgggtactaacgaatnggccggttactggggacaaatgttggnaaacctgcctatgtttcgggttgcaacccgnacccccaaccgcaaggtnaatttaaacgaanggtgggaggganggtcaaaaaaagggatttanccctgaacccccttaangtcccncaancaaccnggattccaacaaacaattgccgcccaaagttgcaaattgcgttcnagctttcnanccgccctncaaaaccaaccggggcttccaaaagaattcccggggcaaaggcccnaaa

SEQ ID NO: 80372 - DNA, 580 bp, Triticum aestivum
  unsure (1)..(580): unsure at all n locations
  Clone ID: PAT_TA_80372
ggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcggtgattcccgacttcatgtgccagggcggcgacttcaccaagggcaacggcaccggcggcgagtccatctacggcgagaagttcgccgacgaaaagttcgtccacaagcacaccaagcccgggattctctccatgggcaacgcggggcccaacaacaaaggctcccanttcttcatctgcaccgtccctgcaantgggtccaacggaaacnagntgtcttcggcgaaggtcctccaaggcatggacntcctcaanaanatcaaaaaagngggntccccaancgggaacctggctccaaacaaatttttattcnccgaaaggg

SEQ ID NO: 80373 - DNA, 214 bp, Triticum aestivum
  unsure (1)..(214): unsure at all n locations
  Clone ID: PAT_TA_80373
gccaagaccctgcctgagaacgactgccgattcgcagtgtttgacttcgacttcaccaccccggaggatgtgccaaagagcaagattttctatatcttctgggtcctctgacaccgcaaaaggtgagggagcaaagattaacnttacgccnagcaacaaacnaagaanttnaaanaagggacccttggaccggnatccaaaattgaatttaagg

SEQ ID NO: 80374 - DNA, 531 bp, Triticum aestivum
  unsure (1)..(531): unsure at all n locations
  Clone ID: PAT_TA_80374
gcctcctctcctccagttaatagaataccatggcccccgccgtgatggcttcgtcggctaccaccgttgcacccttccaggggctcaagtccacagccggtctccccgtcagccgccgctccagcgccagcctcggcagcgtcaagcaatggcgggaaggattaaggtgcatgcaaggtgtgggcaatttgaggggatcaaaaaatttcgaagaacttnttcttaantnccaaccctccccaacgggaagccctccttnaaacaagtncacnaacttattcgctccaantnggtncccctgcctccaaattcaacaaagntgggnntcctcttccgttaggcaanaaaaanctccccccgggtactacgacngtcgatactggacaaatgtggaaagcttgcccatgttttgggttgcaccgaccccaacacaagtgctcaaacgaagtggagggaggtcaaagaaaggagtaacctgacnccctaatgtccgttttcatncggcttcgaanaaacctgcgccaaggtgca

SEQ ID NO: 80375 - DNA, 594 bp, Triticum aestivum
  unsure (1)..(594): unsure at all n locations
  Clone ID: PAT_TA_80375
cggagcaggaggaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcccggtgactttggtttcgaccccttggggctgtccgacccggagggcaccggcgggttcatcgagcccaggtggctggcctacggcgagatnttcaacggccggacggcgattattggggtggtgggcatgatncccccggagggcctgggcaangtgggcctggtgcccccangaaaatncgattccgtggttcaagcaaggcgcgattccgcccggcggggcaactaacaatactggggccgacccaaaanacgctnccttcgtgtttcnaaatgggggctcanccggcttccccngggagaaccggnngggtccaagaactggtaaaaancccngggctccanttgggggaanccnanacttcctt

SEQ ID NO: 80376 - DNA, 593 bp, Triticum aestivum
  unsure (1)..(593): unsure at all n locations
  Clone ID: PAT_TA_80376
gcaattcacgtactccgccatggccccagccgtgatggcatcgtccgccaccaccgtcgcgcccttccaggggctcaagtcgaccgcgggcctccccgtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccggctactacgaacggtcgatactggacaatgtggaagctgcctatnttcggggtgcaccgacgcaacgcaagtgctcaacgaagtggaggangtcaagaaaggagtancctgaacgcctaattcccgttgtcaatcggctttcaacaaaaatgcgcccaagtggcaattgcgttaagcntcaattgcccttaaggcaacaaggttgcgaangaatctggcaaagggctnaaattgcaantttaaattaaaacanttttc

SEQ ID NO: 80377 - DNA, 555 bp, Triticum aestivum
  unsure (1)..(555): unsure at all n locations
  Clone ID: PAT_TA_80377
ggtaaaattagatcatggcctttcatgtttgaagggatatagtattatgataactctcaaaaatcaatattgtataatgacagaagttaataatctaaatcagcaggagcaagctttggntgagtgtanatactagcgacatgtgcggaaagctaagcgggttaatggaagatganaatggtcgaaggtaatcagaattctccggttagttataagatgctctttgggtgtccttcatntaaatnaaaaagtttggaaagattattgggacaactaaaagtcnatttgtcccttttcaaaaaaaagtcattttgtctatttggatgggtaaaacctctgancagggagacccccatccttgtccttaagtacccnatttggtcaaatantgnntgccctttaataanaaantttncctcgggtnggtaaggaaattttaaangggtgnccnaanccaagccccgggnaattttttgnagcccaatttgggnttgggcccntttggnnttttgnggggcttaccaacnattnnaaggncctcccttggnaaaaaaa

SEQ ID NO: 80378 - DNA, 276 bp, Triticum aestivum
  Clone ID: PAT_TA_80378
gaaagagcccgcacgtgaattatctatttttatctgtagcgaagtttcttacctttgtggtggtcaactatgttcgtgtagattttgtagtttgttgatgatagtatttaattttttactgtagctaagatgtattagatcattgtggtatagtcgaagtatgttatagatgaacatctgtgtactatctgtagccaaacatatctccaactgtatttatggaaaggaggagaaaatattgtatccaaaatgacaatttatgctaaaaaaaaaaaa

SEQ ID NO: 80379 - DNA, 300 bp, Triticum aestivum
  unsure (1)..(300): unsure at all n locations
  Clone ID: PAT_TA_80379
gctgctccctcctctcctcgcgcgcagggcccggcgaaagggaagcaagatgtacaccgccaggaagaagatccagaaggacaagggcgtcgagccctccgagttcgaggacaccgtcgcgcaggctttctttgacctggagaatggcaaccaggagctcaagagcgacctcaaaggacctgtacatcaacactgcaaatccaagatgggatttttgtttgggaaaaagggaaaggccgntgggtngatncaatgttgccgtaccntncggcgcnaacccttnaagggaaaattcaatgt

SEQ ID NO: 80380 - DNA, 503 bp, Triticum aestivum
  unsure (1)..(503): unsure at all n locations
  Clone ID: PAT_TA_80380
gcggcaggtaagggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccgaaagctggtaaaggatggtttcatcatcaggaagcctcagaagatccactccaaggtctcgtgcaaggagggcacatganggcaancaaaanggccgttcactcctgggatattgtnanccttaggggtnacaaggaagctaaggctccccaacaaagatncctngtgggatnccggaggatgccncgtcctgganggcngcctttctgccncaaagttaccctttaagggccaaagaaagatncaacaaancnacaatgttccaaagnacaatgttccctngaaanggnccaangggttaanaatntttcnaanaaanaaagaagggttcccccattgggag

SEQ ID NO: 80381 - DNA, 545 bp, Triticum aestivum
  unsure (1)..(545): unsure at all n locations
  Clone ID: PAT_TA_80381
gtcatcctcgacaccaaagctcatcttcttctccttgaaatctttttgggttcatcaagatttggaggatgtcttgcaactgtggatccggttgcagctgcggctcaaactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcnaacaaggtgcctgtgcattnccntgtgggttaattcgctcgctctccgcctaagctctgcccctgggggtccttgngggtaggtgtngtgcaagtgtcccctgttaanttgcntcaacctaaccncaactaangggtngggttgatgaaanatgttaanaatgaat

SEQ ID NO: 80382 - DNA, 601 bp, Triticum aestivum
  unsure (1)..(601): unsure at all n locations
  Clone ID: PAT_TA_80382
ctgccctgccctgcctacctactcctccaccaccaccgccgcggccatggacgacatcgccgagcccggctccccgacctccccaacggccacctcctcctcgtcttcatcgtcgtcgtcttcgtctctcgccgcgaacaagcggccgcgcaaggacagccggcacccgacctaccacggcgtgcgcatgcggagctggggcaagtgggtgtccgagatcagggagccccgcaagaagtcgcgcatctggctcggcaccttcgccaccgcggagatggcccgcgcgcgcccacgacgtggccaacgctngccatcaaagggccgcgccgcccaacctcaacttcccggacctggcgcanctgctggcccccgcccgggcaagcgccggccgcccaaaggacgttcaagggcgggncggccaatactcgccgccttccggccgaatttccccctggcggggggccaagtggcaaatggccaaagaagcccccgaacaggcgggttcccgaacgcccaaggggncgncttcggcgggcggccttcnggcctncggccggaanggccggnaaccnggttccccgggacccaaaaannacgccng

SEQ ID NO: 80383 - DNA, 571 bp, Triticum aestivum
  unsure (1)..(571): unsure at all n locations
  Clone ID: PAT_TA_80383
ggtctacctcaccggagagaaaagaagagaagcgaagatgtcggggcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccancaccaagantaagagtgtctggggttcgtggtccttgaatgttaattgcaacaatctcgctgtttgtttgctaaaccttccgtaaaanngggatgggaatgggnaaanttgaactaantttatcccttngaaaaaaaaaaaaaaaaaaaaactnccaagggggggggcccggttacccaaattccncccctaaaagtggagttcnntatttacc

SEQ ID NO: 80384 - DNA, 573 bp, Triticum aestivum
  unsure (1)..(573): unsure at all n locations
  Clone ID: PAT_TA_80384
gaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcaacaaggttgggttcatcttccgtgagcacaacgcatcccctgggtactacgattggcccggtactggacaatgttggaaagctgcctatgtttcgggatgcaacccgacccccaancaaggttgatnnaacgaaggtgggngggaggtcaaaaaaagggantaccctgaaccctnatnttccgcatcancgggatttcnaanaacaatgcgttcaaggtgcaagtggcgtcaagcttcatcgnccttcaaagccanccnggggttgcgaagg

SEQ ID NO: 80385 - DNA, 428 bp, Triticum aestivum
  unsure (1)..(428): unsure at all n locations
  Clone ID: PAT_TA_80385
gcagagaacagagcggagcggataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccagaccctcatcatgggcgttgccccctccaagggcaccccgtcgttcgaggccgccgccganaacggagggtgcaagtgcggccccaactgcaccttgcaaaccgttgcaacctgcaagtggatccatgaggcctcaatcaaaattcagatcaaagggagaatggcatgggaatggacctgaatgaaagggagcgaagtaagtaagttatgcatggaaatccgcaaagcgttgtggtttccgtttttaaattgccaccccagaatta

SEQ ID NO: 80386 - DNA, 587 bp, Triticum aestivum
  unsure (1)..(587): unsure at all n locations
  Clone ID: PAT_TA_80386
gcccaacaccagcagccctcctccaccgagcagcagccgtccacggccagagaccaaggcgggcgcggcgcagtgcgtgacggtctgacggagagctaggaggtcaaggaccgacgaagcgatggcaatggagccgctccccctcggcttcggcgacgccatggacaccaccctcttctccacgctctggtccttccaggaggagctgcagccccaggagagcgtggaggagctgaagcagagcttgctgggcggcgaacatggagcttggaggtgtccaangaggagcttgcggaggaaggagcaaagcatcgccaagctcgccganctcgtgccgcccangtggccaaaggagcgggacgacgcgaagggaccaaggttgcancancttgctccctccgcccgccggnntaaancaaggccgccgccgcccggtgcaacaannccgggcggcccgggcccttggggcacgttcnagcggtcacccaactccgganttncaanccctncnttgtcgttccccccgtccnanccccttctttcgaaccccgntcaaccttccctcccgaaccnggnggcccnttggg

SEQ ID NO: 80387 - DNA, 598 bp, Triticum aestivum
  unsure (1)..(598): unsure at all n locations
  Clone ID: PAT_TA_80387
gcttcgtactcgcctctctccgcgcaaccgagccttccgcccacctcctccccatttcgccagcggcgcacccaccaaccacccccacccgccgccatgagggagtgcatctcgatncacatcggccaggccggcatccaggtcgggaacgcgtgctgggagctgtactgcctcgagcatggcattcagcctgatgggcagatgcccggtgacaagaccgttgggggaggtgatgatgctttcaacaccttcttcancgagactggggctgggaagcacgtcccccgtgctgtcttcgtanatttcnaacccaactgtgatttgatgangtgagggactgggcgcttaacgccaagctccttccaaccccgagcaagctttatcaantgncaaagggagggattgcaanccaaacaaacnttcgccccggtgggtcaanttaaanccaattggcaaanggagaattgttttgatntgttgccctttgaaccgtttttaaggaaagcttttcaaaaacaaactgncacngggtnctccaaagggaattcctttgtccttcaaatggctggtttgggagggtgggaaactggnctcctgg

SEQ ID NO: 80388 - DNA, 580 bp, Triticum aestivum
  unsure (1)..(580): unsure at all n locations
  Clone ID: PAT_TA_80388
gaaaataagcaccccagatggccctgtttcgcatgccttctctccaaggggagtcctaaatggacccacttcagctccaactataactccaaacccgatgaagaaacagcaggcattaagcaccctagactctgttcagaggcaagcacacccttcagttggaggagttaagcgcactaagatctccagctcaagatagaaccctggtgaagaaacagaagataataagcgccccaaactctgttgtgaggcatgcacgcccttcanttgtggnaagtgagggccactggatntccagctcgagctaaaaccccggtgaaagaaatcacaagataataagcgcccaagactctgttccganggcataatccgcccnttaatncggngggggaaaagaaaggccaattaaaaggtncaaagtncnaactncctggctaatggcncctgggngaaggaaaacnacccancnaattatgcaccccaanactctngnttcttgaaggnaananaaaatttcttcaagggaatggaagnatnggcaaagccactggcggaaangcatnttgggnttaataacntg

SEQ ID NO: 80389 - DNA, 642 bp, Triticum aestivum
  unsure (1)..(642): unsure at all n locations
  Clone ID: PAT_TA_80389
ctcgcctggccggctacccctttcttcccggccggttggttgttggtggggtgtgtggagctagtggtgtaagattgaggtagctcaagctggaggaggacaagaaccggttgtccaagggcttagacccttggagcaaccctaccgccgcggccaccaccagcaccctgcactacctgctccaggagaaggagagagcgcaggcgcangcgcaactccagatctaccaaccaacaagggttcggctaacctccaacaacaaccgggagggcaagcaaccaagcggggggggaagccncccgattggcgggcaagcaagcggccnaatccaacgcccggttggcgggaccgcccctggcggaacnggcatttcngggaagccggggcggcaataagtgccgggtcccgccgggnggggggccgcaaanggacanggcaacaaacaaagggtgttgcaancccccccnncggggcntggccccaaacccccccngttttcgccttcncccggggnaaaaccggccatcccggctttctacnaacgttgcnaaggacccnccctccggnttaacaaaccggcccccaaacaaanggccgttcgaactngggttcatnccccaaacngcccaaggggcngccatn

SEQ ID NO: 80390 - DNA, 541 bp, Triticum aestivum
  unsure (1)..(541): unsure at all n locations
  Clone ID: PAT_TA_80390
ggaactagtctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacggggccacatataaagtgccattgcggttttgtcaactctgacattgctttgggttttccttttccaattatccttcctggttggtcctaaaataagaataatttgtatggtccaatgtttccccgacaatgacctcccannaaaanccaangcncccttntgtngaaatggcnaaccggatngggttnatgnttttattgcccaatggcncataaaatatttataagttccaatcctgtcngacctaaagg

SEQ ID NO: 80391 - DNA, 526 bp, Triticum aestivum
  unsure (1)..(526): unsure at all n locations
  Clone ID: PAT_TA_80391
gaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcangtgtggcccattgagggcatcaagaagttcgagaccctgtcctacttgccaccgctcagcacggaggccctcctcaagcaggtcgactacctgattcgctccaagtgggtgccttgcctcgagttcaacaaanggtgggttcaacntcccgttaacaacaacgcaanccctggggtactatgatggccggtactgggacaatgtggaaagcctgcctatntttcgggtgcnaccgaacgccaaaacnaattgntttaaacaaggtgnngnggaggtcaaaaaaaggngntaccctgaccccttntgtccggaatcatncggnttnccccnggaatncccccacgnggccctt

SEQ ID NO: 80392 - DNA, 514 bp, Triticum aestivum
  unsure (1)..(514): unsure at all n locations
  Clone ID: PAT_TA_80392
gcaccagttcatctcactgagctcgcaggcagccccagccaccagcgaaatggccgcgtcggcgctgcaccagacgaccagcttcctcggcaccgccccgcggcgcgatgacctcgtccgcagcgtcggcgacttcggcggccgcatcaccatgcgccggaccgtcaaagagcgcgcccccagaagcatctggtacggccctgaaccgtcccaaagtacctngggccnttctccnaacaaaccccgtnntnaccgaacgggggaattncccggggaataanggtgggaaaacggccgggctgttctgnccgaaccccgangacgttcgccaaaaaaccggggaagctgggaggttgattcaactccgcgggtggggcgaatgctcggcngccctngggggtgcgttgtttcccgggagaattctgtcccaaggaaagggaatcaaattncggcgaaggcccttttggtttcaanggccggnggccccaaaatttttctccngngggggngggcc

SEQ ID NO: 80393 - DNA, 506 bp, Triticum aestivum
  unsure (1)..(506): unsure at all n locations
  Clone ID: PAT_TA_80393
gcctcgtgccgaattcggcacgaggagagcaaaaggagcactctttcctctacatccagcagatttccccaccggccgccggacgccaccggaaccagatacaccgcaggctccggggaggcgcatctgccccgcctcgcccgccggcacgccgccgccagtgactaactgaccccctttataaacttcccgtgagccaagcgaaacccacgcccaaacactctgaagccgggttnggagaaaaaaccaaccaatcccaagaccancaancangatngcgtncgaacccggcccgangggtccaccggnagcccnctncgcaaggttcgcgccccttggcnngccgccggggggccgcgggcacatttttcgggggtgggttgggcnatcccccggtgaacttcccttgggcctccccgcggccggcctgccggccgggggttgnccgncttcctccgcctttcnggaaaagaaagcaattcccnccgggggttacgccccnccgc

SEQ ID NO: 80394 - DNA, 408 bp, Triticum aestivum
  unsure (1)..(408): unsure at all n locations
  Clone ID: PAT_TA_80394
gagcacagacacgtcctggcctggccggcttgactccactacttctctagcttccaagagaaaccggccactatcttccacattttcaggtttgtcgatccttgttagcacggtagcgtgtanagctcgccatggacgctggcgcggtggctggatgcctccgggacaagaccgtcctcgtcaccggctcaactggctacctcggaaaattgatggtggagaagatactgagagtacagccggacgtgaagaaggtctacctggctggtgcncgctcccgatgccgcctccgccgagcaagcgtttcctgaccangtgctagggaaggacctgttcaaaaaccctgngggaaaaagcacgggcttgctgggcttccaaaaagctgattaaaaganaaanatnatttcc

SEQ ID NO: 80395 - DNA, 558 bp, Triticum aestivum
  unsure (1)..(558): unsure at all n locations
  Clone ID: PAT_TA_80395
ggacactcacactctgctgctgctgcttggttgccattcaccatggagatggagagagtttgcaacagacgagcgggcatgcctcctgctctccttctcgcccttcacggcatcgacgagcagatgatgcctgcgtcatcgctgccgccgccacagacccccatggagcccatggagtacctgtccaggtcctggagcgtctccgccgacgacatatccaaggccctgctgctcaaaggggacaccaagcggagcttcttcgcccccgccgacgctcttcttccgccatcccccatgccggagacgatgacctcctcctcctacgagctcctcgccgcccccgcaagcttccaagtcatcatcaagattcaccaccaacatgtgaccaatcacttgcttccttcttttctgcttttccttgctaagctagtttttactctctgcaacatgtatgcgtccgttaagttggagagaacaaatttgagatggaaaaacaatggtgaatttgctggtgtttgcntaaccaagcatctctgctctgaagctnaattcaaaaag

SEQ ID NO: 80396 - DNA, 550 bp, Triticum aestivum
  unsure (1)..(550): unsure at all n locations
  Clone ID: PAT_TA_80396
tccatatatcgcggatgggtgcaaagatgttgacgagtgcaagacaccaggcacatgtaatggcatttgtcataacaccgaaggtagtcactattgcactgaatgtcctagtcatacagtgtatgatactacaataaagatgtgcacttcgaccaaaaaacaaaatctggtactaggtatcgtcattgggattagcgttggttttggaattctacttctcatgtcaattgtaatattactcattcgtncatggaataaagacatcaagaagaaactacggngaaagcatttccggcagaaccaaggtctactgcttgaacaattgatatcgtcnnatgaaaatgcangtgacaacactaagattttctcactgtcagagttagaaaaggcaacaaataactttgatccacacgtatcntttgtcntngaggggcanggcaaggtttananagggancttatccgaccnacgggtnttgggcaaaaagaaatctnaaatcctnggcaagtttnnaaaaaacagtttggncccttaaggtgccgtccccccc

SEQ ID NO: 80397 - DNA, 251 bp, Triticum aestivum
  unsure (1)..(251): unsure at all n locations
  Clone ID: PAT_TA_80397
gccgctctccctctccctcccggcctgcacacgcacaagcagcggcgangccttctcagctgccttcttccncctccctctctttctgccangaagccncctcacttcaccggggangccgccgcaggngnctcatgggctcacgaggtcaagcaggccctccgtgacangctccggtgggcacccgccgngggcaccacgggtcaccggtggtccactngtnccgcntaggccgccgatggccntcctct

SEQ ID NO: 80398 - DNA, 539 bp, Triticum aestivum
  unsure (1)..(539): unsure at all n locations
  Clone ID: PAT_TA_80398
gctcccgcgtgccaagccaccgaccaacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccaaagcaagacctacatggaggtgaagggtaccggcaccgcgaaccagtgcccgaccatcgacggnggngtcgactccttccccttcaagggcggcaagtacgaaatgaaaaaattctgcctggagcccaactccctcaacgtcaaggccganggcatcanaagaacaagccgccngccttcaaaaaacaaactcaatgaccgtctaactaaccttaacaaatggaanggccgctcca

SEQ ID NO: 80399 - DNA, 556 bp, Triticum aestivum
  unsure (1)..(556): unsure at all n locations
  Clone ID: PAT_TA_80399
ggagagagagagagagaactagtctcgagtttttttttttttttttttttcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggntcagcagctccctccttgtagtaggngaacaccacgccgccatcatcatgcatgctctcgccaacaaagaactgaaggtccttgagcttgctaagaanatactttgtggnggnctcaacattcttcttgaaagcatctaaggtcatccccttcaaagcttgggaanagagggncttggatgttacgcctcaangttgagaagataaactgcttcttgtcaaaaagcaaggttgctcctgaaaacgggaaggngtcaacaatggtccanccancn

SEQ ID NO: 80400 - DNA, 620 bp, Triticum aestivum
  unsure (1)..(620): unsure at all n locations
  Clone ID: PAT_TA_80400
cttctcccatccctggctccgttgtgtgtgtgcacccgcctatctctcccaagccagccaccggcgccgattgctgtcgtgctcaccccccccccccccctcctcctccccgtgtcanacgctgccgtgaagctctttcccatggctgctgctacgagccgccatggctggtggtgagagcttcctctttcgcggtcgtcgtgtgctccgacgagggccgtgctacgggacgcggccggtccaaaaatganatgcgcccgcggcgggaggtgtgctgcatcccgatnaactcaggaaacttggaaacgtcaaaagcgttntggaaaccgggggntcnaaaaaaaacttgaagggaggggaacaactgcttggtggtgggaaataacccctcaagggtgctnnaaanccaaagggnnttttttgccgggaaaccggggaacaaaaaaactaaattcnaacaatngcgggcaataaaaacaaaaacctgnggggctngatccaacnanttttttggctngganccgggccgggaaaaaaatntaatcaaaaccgacccnggtcngggaattnccaccancaaaantttgggccaaacccggggaatncttaaaccttncaaa

SEQ ID NO: 80401 - DNA, 526 bp, Triticum aestivum
  unsure (1)..(526): unsure at all n locations
  Clone ID: PAT_TA_80401
ggcaaacctgaatagaataccttcatgcccaacctccctcccatggcaatggccatcatcgatggattgagttcattagttagctggtttcgattccgccgccgtcggtgacgacgagtgctgcccgtggctcgctcggccgtgctgcttgttacgccgtttctggcgcaagcggcggagatcaggaagtggtggcggcggccggccgaggccatggggatggcgcggcgggttgggtgtggtgacgagcatatcgggcgtctccatccgcgggggaccggtcccccggggaaacccgaacgggcgttcaatncctcaacgggtcaatgttcgtttccgggaaggtaaggtnaanggaanggggtgggccaaaccaaacttgcaaacccccggcgttgggtgggtgggcgccgcttcccaatancnccccgcaattngggcccaaattgtgttcctnccttgcccggccgttgtngcctggggaaagaaaaagaatttgcctcntgtgcctctngncctccgggat

SEQ ID NO: 80402 - DNA, 435 bp, Triticum aestivum
  unsure (1)..(435): unsure at all n locations
  Clone ID: PAT_TA_80402
caaagacaggtcaacctcaccgaggagaagaagggagaagcgagaagatgtcgggccgcggcaagggaggaaaggggctcggcaagggcggcgccaagcgccaccggaaggtcctccgcgacaacatccagggcatcaccaagccggcgatccgtcgtctggctcgcaggggcggcgtgaaacgcatctcggggctcatctacgaggaagacccgcggcggtgctcaagatcttcctcgagaacgtcatccgcgacgccgtcacctacaccgagcacgcccgccgcaagaccgtcaccgccatggacgtctctaagccctcaaagcgccaaggaancaacctctacggattcggggggtaagcctccgccaaattaaagtgtcnaaggttcgtgggtcgttgatnttatcncaatnaccccncctnttttttgcc

SEQ ID NO: 80403 - DNA, 476 bp, Triticum aestivum
  unsure (1)..(476): unsure at all n locations
  Clone ID: PAT_TA_80403
cagacagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacaagtcgacatcgacgccaacggcaaggaaggtgggcaagaagggcgtgtaccaanttcgtttacaagtacggcgcccacgtccacggctacaagccaatctaaacgccanangaatgggccgaatctggtgaacgctaanccngggggaaagaaccgggcttccttaatctggggccgttaaccctcgccgggctcctccggggggggggtcctcctcgtntaaaaaaacaancgctcttcgccngggtaaanaaaacaantaacctnttaaaaaaagggcccgggttccctgcttgcaaa

SEQ ID NO: 80404 - DNA, 605 bp, Triticum aestivum
  unsure (1)..(605): unsure at all n locations
  Clone ID: PAT_TA_80404
gcctcgtgccgaattcggcacgagggggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaagtgcagtgcgtcagcttcatcgccttcaagccaccgggctgcgangagtccgggaagggctaaacaactcactcaacaacggggccanatataaaagtgncaattgcgttttgtcaactctgaaatttgcnttgggttttccctttccaattaaccttncttggttgntcccaaaaanaaaaaaattntgtatgntcaangtttccgacatnantcccagaaaacnatgccncgtttgtntatgccaccgatggggatttttatnnccntgcccat

SEQ ID NO: 80405 - DNA, 372 bp, Triticum aestivum
  unsure (1)..(372): unsure at all n locations
  Clone ID: PAT_TA_80405
gctgaagcgtcaggtcaggctcctcgtcggcttgctgctgctgcccaagccccaggttgtggccggagtggaggagagggagcacgccggtggtggcctgaagctgtcggggcacccgaagctgacctcctcgtcgccacccatgaggaacggcatcgggcccagcaacgcccgcgcgcgcgccggcgcaacaagggangcggcttccttgctgccgctccgcctgcgccgccgcanggtgcancgggcgcgttcgccttgatccnaatggataaaacaacaaccaaccaataaannttggaagggaagggcaaattcgggntnaccntaagggtnaggctncaactggtggancccaacgnccggcaacgg

SEQ ID NO: 80406 - DNA, 498 bp, Triticum aestivum
  unsure (1)..(498): unsure at all n locations
  Clone ID: PAT_TA_80406
cgacgcgccgccaccgcccggcgcaagaacgctcgcctcgatcttcctcgactccgccgagagctccttcaccaactcctccgcgcggcgcgactgctccgacagcccctccacggcgtccgangtgtccgcggagggcgggggcgacgccctcacggccgaggacgccgtcgtcgtggggcccctccgctcctccgaacggctcctgttcgaacccgggggcgtcggggggcaacaanctcaataatggaaggaanaaagttgcccgccggccgnccggcgaaaggntttnttcctnngggnctcgtgccctgtggcgtttnnaattccggnggacccnttaagggggaaattcccggggntttcaattnaaggaaaatggttggcccccccanacgggggcccgccggnttggggcttggggcttggcttggaaagaaaaattntggggttgggaacttnggcncccnaaagggnaaaggananncaaagggggcc

SEQ ID NO: 80407 - DNA, 597 bp, Triticum aestivum
  unsure (1)..(597): unsure at all n locations
  Clone ID: PAT_TA_80407
ggcacacaagaagctcatagccattcaaagcctcttcatctccgaagctccaacccaaccnaggatgtcttgctgcngaggaaactgcggctgcggcaccgcctgcaagtgcggcaacggctgcggcggctgcaacatgtacccaagaggccgaggccgccggggccaccctcctccgtctccgccaccgccacccaacaaggcgagctccggcgggcatggagattggcgggcgggagaaacgggcgggctggcgggctggcaaccaagttgcaaagttgcgggcaaccaagcttgccgggntggctcccttgcttgcaancttgctnagatttgattaatncgaaccaataatngcaatgcaaccgttgnccgttgcgttgcaatcaatncgaattaaanatccgaatttaactaactaaccaataaccaanggttaacccgcaaaccttgatncganggggccctttatccttattgcaancttgaaccttggcaatcaancaaattcaanggtngccaaangcccaattgaattggtaaaaaaanggccccccccttaaatnaaaaattttccccnttatttaaacttaaaaa

SEQ ID NO: 80408 - DNA, 590 bp, Triticum aestivum
  unsure (1)..(590): unsure at all n locations
  Clone ID: PAT_TA_80408
gggcccatcgagggcatcaagaagttcgagaccctgtcttacctgccaccgctcaacacggaggccctcctcaagcaggtcgactaccttatccgctccaagtgggtgccttgcctcgagttcagcaaggttgggttcatcttccgtgagcacaacgcaactcctgggtactacgaatngccggtattgggacaatgtggaaagcttgcctaatgttcggggtgcaactgaacccacaacaanggttattnaccaaggttggagggagggtcaaaaaagggagtaaccctgaacccgtaatgtcccgcaatcaatccgggattccgaacaaacaattgcngtcangggtggcaattgcgtncaagcttcaatccgcctttaaagccaaccgggggctngcgaaaggantccgggggaaagggcctnaaacaagctnaatnaacaacaagggcaatatattaaagttgcaatngaanttttgtaaactcctaanatngcttttgggntttccctcccccaattaacctttcctaattttnttcccaaaaaaaaantntgtatgtccaatntttaaanttaccaaaaattgg

SEQ ID NO: 80409 - DNA, 608 bp, Triticum aestivum
  unsure (1)..(608): unsure at all n locations
  Clone ID: PAT_TA_80409
gctcctcctagcaagctatatacctacatagtacaaccatggcccccaccgtgatggcctcgtcgggcacctccgtcgctcctttccaggggctcaagtccaccgccggcctccccgtcagccgccgctccaacggcgctagcctcggcagcgtcagcaacggtggaaggatcaggtgcatgcangtgttggnccaattgaggggcatcaagaaatttcgaagaaccctgtcctactttgcaaccggcttcaaacaacgggagggccctccctcaaagcaagggtccgaactaaccttattccgcttcaaagttgggttgccnttgcctccgaagtttcaancaaagggtttgggtttcaatccttcccgttgaagcaacaaacgcaaaccccctgggggttactaattaattggccgggttactgggacnaattttggaaagctggcctaatgtttcngggttgcaaccgacccccacaacaaagtttattaaacnnaaggttggaggganggtcaaaaaaaggagttacccttgaacccngtatgnttcccnacaatcnggatttcgacaaanatngcgccaaagttgcaaattgcgttcaacctt

SEQ ID NO: 80410 - DNA, 598 bp, Triticum aestivum
  unsure (1)..(598): unsure at all n locations
  Clone ID: PAT_TA_80410
ccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatnagcaaggagtgctgctccggtgtgcangggctgaacggcctggcccgcaacaacccggaccgcaaagatancgtgcaaggtgcctcaaagagcctccccaccaagcatcaantccaatcaacaatgggacaaaggtcctccgggcgttccccgggcaaatngcggggttcagcggtggcccttccccaatcaagcaatntccaaccaaactggaaacaatnttcaactaagtttaaatatntnaaccttcccgaacgtngcaatgcaaaaggaacnccccttgttttggaagcttnaatttccnacntttaattnggagtggctcaaaaacaattactnnagnctactaaaataataaaaattgaaattttccttgcggtnggtgttaatttcna

SEQ ID NO: 80411 - DNA, 535 bp, Triticum aestivum
  unsure (1)..(535): unsure at all n locations
  Clone ID: PAT_TA_80411
gaaatctctctcggctccccgctccgagtcgcgtcgcgtgaggagaaaggaagggaagccggaaagggttctcgccgacccggaaggaggagatggccgggaagggaggcaagggcctgctcgcggccaaaacgacngccgccaanaccgcccataangacaaggggaaaaaaggccccatctcccgctcntccccgcgcgggggtncaatttcctngtgggccgtttccatcctcaanttnaacnaaaggnctcaaggcaaagggccgtnttnggtgctnctgngggnggtntaatctncttctatnctgggagtnnctnacaacttaagtccttggaacttggtnggaaaccccacaaagntttnaangggaaacgtntnaaccctcntnanctcaacttggcaatccttgaganaaagaaanttntaaaccccaataaagggaacaanttcttgtggggggntttntccccccaatcacaaattcccttattnanaaatcctcccaaanaattggncaanaaaaaattttcn

SEQ ID NO: 80412 - DNA, 433 bp, Triticum aestivum
  Clone ID: PAT_TA_80412
gagagaacagagcggagcggataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccagaccctcatcatgggcgttgccccctccaagggcaccccgtcgttcgaggccgccgccgagaacggagggtgcaagtgcggccccaactgcacctgcaacccgtgcacctgcaagtgatccatgaggcctcaatcaaatcaaatcaaggagatggcatggattggacctgattaaaggagcgaatagtaattatgcaagaatcgcaaagcgttgttgtttcgttttaaattgccaacccaagaataaagaacaagatctatcgtatccgtaa

SEQ ID NO: 80413 - DNA, 442 bp, Triticum aestivum
  unsure (1)..(442): unsure at all n locations
  Clone ID: PAT_TA_80413
ggagagaactagncncgagttttttttttttttttttttttgagacgaacagagggaaaacaatcttagnngacccgggtcgtacgcccccggacgtgagaccctctccatcggctgacacctggacaaacgaatcttaaagcaatgctgaatcctgtttcggcccccgactcatcctgctcgctcagtttaacaaatccccaattccattctgcattcgccggcgcccaagctcgcctgtcggccgtcgtcgtcgtcgccgccgccgccgctgcaactcttcctgntcgctctatcgcggaagcaccggagcaccgtccctgctgctctcttcctcgttgtccacgcctacgctcctcggctcccgtcggnggagaagcttgattgcagccaangggtgcgttcatantgccccgccggtnccggaagtggaggcgcccaa

SEQ ID NO: 80414 - DNA, 162 bp, Triticum aestivum
  unsure (1)..(162): unsure at all n locations
  Clone ID: PAT_TA_80414
gcgacgacctgcgggagctcatgcgcgccgcgtcngaganacnggcggccccggagcggcccccggcggtgcccaagaaccggancgtggncatttnaaaattcaacaagaccggccgttcgantttngtctccccggngccggggtgncgtttgncaaaga

SEQ ID NO: 80415 - DNA, 609 bp, Triticum aestivum
  unsure (1)..(609): unsure at all n locations
  Clone ID: PAT_TA_80415
gcttacttagctagctagcagccatggccgccctctcctctgcagcggtgtccgtcccttccttcgccgccaaggctgccacccccatgcgcagcagcaggatggtggtgcgcgcctccctgggcaagaaggcggcgaagcgccgcggtcgccgtggcggccaacgcgaatgctgctgggcgggtcggcgatggcgcaaggacgttgctcctgggcgccaacggcgggcgttgctggtgttcgaagcccaaacgaatttaagcgtcaaagtcccggcgaagaaccaatcaacctttaaagaaacaaacgcccgggtttcccgcaacaaacgttgggtgtttcgaacgaaagaacgcccgttgccgttccgggcgttggaacgttctccaaagattctccccaaagangggagttaacttcnaacgcccccaaaggcgangaaccttttttaanttcacggcttnaacggtcccccggggaacctaacgggtttctaattgtcaaacccccaaccccccggggggcccgggaattggtcccggaaaangncaaccgtccaaaaaaaagctanactttccaaatnanctccccctgtcctnntccctttaa

SEQ ID NO: 80416 - DNA, 532 bp, Triticum aestivum
  unsure (1)..(532): unsure at all n locations
  Clone ID: PAT_TA_80416
ttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcaacctggggttccgcccgaagaancangggctgcagtaactgccgaatcttctactggtacaaggacaactgtttggactgatggacttaccaatcttgatcgttacaaagggacgattctttcacaaccaacccgttnctggggaaaacaaccaaaggggtctgttatgtnncttaaccaataaacctattttaaaaagggtccgtttccaacaagtttacctccaatgtaaggtacgttatttgtttcaaaancccaacgtgctccacgtttggngggatttacaaatccccccaccttttcaaaaacntttcaaaggnccncccaagggtatccaaatttaaaaaaaaaattttacaaatttnggccnncccnttattng

SEQ ID NO: 80417 - DNA, 543 bp, Triticum aestivum
  unsure (1)..(543): unsure at all n locations
  Clone ID: PAT_TA_80417
ggcatcctcctctcctccgataatacaataccatggcccccgccgtgatggcttcgtcggctaccaccgtcgcacccttccaggggctcaagtccacagccggtctccccgtcagccgccgctccagcggcagcctcggccgcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcctccgggtactacgacggtcgatactggacaatgtggaagctgcctatgttcgggtgcaccgacgccacgcaagtgctcaacgaagtgggaggaggtcaaaaaaggagtancctgacgcctatgtccgcgtcatcgggtttcaanaactgcgccaagtgcagtgcgttcagctcatcccaattaaggcaacngggtngcaagn

SEQ ID NO: 80418 - DNA, 576 bp, Triticum aestivum
  unsure (1)..(576): unsure at all n locations
  Clone ID: PAT_TA_80418
gctgtgccggcgaggagagtcggatgcaggcggacctccgcctggtggcggaagatggacggcgccttgagcggctgcctccagtggtagcggctcccctccacggcgtccattagtgacgacggcaggcagaggcaccatggtgctgatctggccaccccaaccttgcacccaccagtccaccacacaggcgaacacctcccgcgcagggcaggaaagcaacactggagttggagggagccggcgagacgtcctactcgactccgacggccgacgcggacgcgcgccatgtgttcgtccaaatgcttctgcagactgcggggcacaaagcacgcttgccagttagagctgattttgttctcaaaaagtcagaaacaaaactgaatttgctctccgtgatgggcnattctctgcaaaatgattgaatatagangaacgatacgtcattgatatncttgaaaatcanctgttccggttttgattttgtgaaggccttggngaataaattgttcctccaattggtgaaatgcccaaggccttgtcctgccgncaattgtggggttttgttgtttcctt

SEQ ID NO: 80419 - DNA, 605 bp, Triticum aestivum
  unsure (1)..(605): unsure at all n locations
  Clone ID: PAT_TA_80419
ggccttcatggcagcaagaggcaacataaaattagagctggatagcttagttgacaactcactgacggaaatggaatttgaagaaggatggagttcacttattgagagatatgatgcaagtaaaaatgagtacctacaattcatgtggcggataaggaaaatctgggcgcctgtttatttcaagacaagatttctatccatttgccgaatcacttggacgtagtgaaggtatgaacatcgtattattcanaaactatgtgcttccaaaggacaggatanagaagttcatccaaagatacgaggagatacaagagacgacactnaaaacgggntgacgaaaattgaccggaaagcanggaactccaacttcaagcttnctcaattgcnncccataaaaaaacatgcaaccnctatttacaccaagnanattttnccnaaaagtngaaaaanagaantctnccaantctcngggtttngacctntaacgtggtaaaagaaaagggtcctgtgtnccnaccggggaagggtttcaactnccaanaaaccaanagnttgntaaaaatnccctcccaagtggttggttgttccttcancaaancaatcan

SEQ ID NO: 80420 - DNA, 611 bp, Triticum aestivum
  unsure (1)..(611): unsure at all n locations
  Clone ID: PAT_TA_80420
gcgcaacacgaagatggcgacgatgtccctcgccgcggcctcacccctcaccgcctccactccccgcggcctcgccgtgtccgcgccccgagcgccattcctcggcctccgctcatttggcgcgccggcgacgcggttcgcgggactggcggcggcgccgcggccgtcggggaggggcgatgcggcggtggtgaggatggcgaagagggagcaggagctggaggagatacgggccatgggagacggagaatctggagcaggaggtggtggacctgaagggggaactcttcctgctccgcctcaaagcgctccgcgcgccaagagttcaaagtccancgagttcggccgcaatgcgcaaagagggtttgctcgtctgctgactgtgaagaaaangaaagggaaattgaacaaaggaatcaacaaaaagaaattctaaggaancttgacaagaaatgggaactgggtntttgtggttggacaccacaatctcctaaggaaaaaaaagngggggacttnaaaacagcaaanaacangnaatttgnncaaatcaattcaaccccttaaaaagggntggttttttaancaaagtaaanctttnaagttcctttgtt

SEQ ID NO: 80421 - DNA, 542 bp, Triticum aestivum
  unsure (1)..(542): unsure at all n locations
  Clone ID: PAT_TA_80421
gccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaaggcctgcactggtgtgaatgtttgcggttaatgggttggtggattccccaaggaaaggaaggaatgggaaaaggaaaggatgttatgaacaaaaatgtttcaattctnanaagctcaaacaanctgctcctggaagctcaatgnaanccccaaatgcaaaggttttngtttgnttccaaaccaaacaaacancaatnctnccaancctgnaaggagnttgctccaanccntnccctgaaaaaaanaacaattttttgncccncntaacca

SEQ ID NO: 80422 - DNA, 364 bp, Triticum aestivum
  unsure (1)..(364): unsure at all n locations
  Clone ID: PAT_TA_80422
ggctacgcaaccgtcgcgccccgtgcccgctcctccaccatcgtcgccagcctcggcacccccgcgccctccaactcctcctccttccgccccaagctcatcaggaacaccccaatccaggccgcgcccgtcgcaacccgcattgatggacgccgccgtggaagcgcctcaaagaacgggtttcgagaaagtttaaagaaccgaggtctaacgaaaaagaaagcccgatttccttccgaagcccctcaaagggccggncaaggcgcccaaataaaatggtgttccggcgttgcggccnaatcccgtntgtggccctcngtcaacctggggctggancccgggganggcttnaacaaccgnaaaa

SEQ ID NO: 80423 - DNA, 612 bp, Triticum aestivum
  unsure (1)..(612): unsure at all n locations
  Clone ID: PAT_TA_80423
gacgtaccccgcagctccagaaccaggacacgcccacggtatacgcacgtacagctcgatcgcaatggcgtcgctcgtcgccgtccagccggtcgccgtgcggggcctggccggcagctccatctccggccgcaagctcgccgtccggcccgcctccgccgccgtctcccgctccacccgcagggctcgcggggcggcggtggtggccaagtacggggagaagagcgtctacttcgacctggacgacatcgccaacacgacggggcagtgggacctgtacggcagcgacgcggcgtcgccctacaacggcctgcaaagcaaagttcttcaacaacttcgcccgcgccctttaacaaagcgaaggctgctgctcaaggtcctgctgctcggcgggggctccctgctcgcctacgtcaagcgccaacgcctcccccgaactggctccccancaanaaaggggcccaactgccccccaaccccgggggcaacgtgggaaagatntaaatnaattnggcaaatcaaaggctttctnctcctcccgcctcgtgcttgtgtacaaagggatttgaatggattcccccctattggccccnaacaaattccccggttaaa

SEQ ID NO: 80424 - DNA, 549 bp, Triticum aestivum
  unsure (1)..(549): unsure at all n locations
  Clone ID: PAT_TA_80424
gcttgctttcactcttggagtgaagcagatgatctgctgctgcaacaagatggacgccaccactcccaagtactcaaaggcccgttacgaggaaattgtcaaggaagtctcatcgtacctgaagaaggttggctacaaccctgagaaggttccctttgttcccatctctgggtttgagggtgacaacatgattgagaggtccaccaaccttgactggtacaagggccctacccttcttgaggctcttgaccaagatcaatgagcccaagaggccctcagacaagcccctgcgtcttccccttcaggatgtttacaagattggtggcattggaactgtgcctgttggacgcgttgagactggtgtcatcaagcctggtaaggttgttacctttggccccactggtctgacaactgagggtcaaagtctgttgaaatgcaacacgagtccctcctggangcgcctcctggtgaacaattccggcttcaaacgtgaaaaaacgttnctntcaaaggatntgaaacgtggggtttgttgcaatccaaactcca

SEQ ID NO: 80425 - DNA, 170 bp, Triticum aestivum
  unsure (1)..(170): unsure at all n locations
  Clone ID: PAT_TA_80425
gcctcgtgccgaattcggcacgaggagcctattttgccgtcagtctttctttgccgtctgcagctaacggcaaaattggtctttgtcgtctggcccgagaaaaagttgatggcaaagcctcctccggacggtaaattaactgtttcccgtagtgctcctttcctcnaaca

SEQ ID NO: 80426 - DNA, 590 bp, Triticum aestivum
  unsure (1)..(590): unsure at all n locations
  Clone ID: PAT_TA_80426
gcaggaacggaaccaacaaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaagacaaggagggcattcctccaagaccaagcaagcgtctcatcttcgctgggaaacaactggaggatggccgtaccctcgctgactacaacatccanaagggagtccaccctccaacttgtccctgcgtctgcggtggtggcatgcaagattttcngtggaaagaacctcaactgggaaaagaactaatcaacccctttgagggtttganaagctncttgaacaaccaatccgaacaaattgttcaaaggggcaaagattccaaangacaaagggggggggnaattcccccnggaaccaancaagccgcctggatttttttgcttgggnaagcaaacttgggnggatggtccncaaccctccgcccgactaacaaaaatccaaaaaaggggttccancccttaaccttggtgn

SEQ ID NO: 80427 - DNA, 460 bp, Triticum aestivum
  unsure (1)..(460): unsure at all n locations
  Clone ID: PAT_TA_80427
gagacagacagaacttgagagagcgcacgcgagatggcagcctccatgatcacctcgccgattgtggcgccgacgagcgtgccgtccctctcccgccggggctcctccttcgccgtcgtctgcagcggtggcaagaagatcaaggtcgataagcccctcggactcggaggcggcttgacagtcgacatcgacgccaacggcangaangtcgggaagaanggcgtgtaacaatttgttgaaaatacggtngcaacgtccgaagggtaaaagccaatctaaaaccccanangaatggtctgaatctggtgaaccgctacnccggggggaacgancgggcttnttatctgggccgtnancctcgccgggctcctnggggggggggtcctcctcgtctaaaaaancancgctctccccgggtaanaaancaactacgtgtaacaaaaaggccgggtctctgctt

SEQ ID NO: 80428 - DNA, 490 bp, Triticum aestivum
  unsure (1)..(490): unsure at all n locations
  Clone ID: PAT_TA_80428
gaatccaccaagcaaacccgatggcccgcacgaagcagacggcgaggaagtccaccggcggcaaggcgccgaggaagcagctggccaccaaggcggcgcgcaagtcggcgccggccaccggcggcgtgaagaagccgcaccgcttccgccccggcaccgtggcgctccgggagatccgcaagtaccaagaagagcaccgagctgctcatccgcaagctgcccttccaagcgcctcgtcaggggagatcgcgcaagggactttaaagaaccgancctgaagtttcaagtcctcccgctgtgttcnggcgctgcaagganggcccgccgagggcaattaccttggtngggggctgtttcgaaggaaaacaaacctnctggcgccaattcaaagncaaagcnncgtnaacaatnnatggccaaagggaatccaagctcccnaagancccncnaggggaaaaaaaggnctaaattcntctggctccctcccaat

SEQ ID NO: 80429 - DNA, 627 bp, Triticum aestivum
  unsure (1)..(627): unsure at all n locations
  Clone ID: PAT_TA_80429
cggaccctcgccgtcgctgtctcccatctcgccggcgctagctagggcaccggtcgccctccccctccgaccactacaacccgcgtcaagggccaagcctccttcaccgctgaagccccgtcgcccggggcaaggcgcaagcctcctgctccgccgaaggctcctcggcgcccgcgggagccgccgaagggtcttcggggtgcgtgatcgggggtgcaaccgcgggccgggacggtcganatctttcaacaagcttcgagctcgtcctcnaaccccgttaaccggcaacgctcgaagcgcgcctttcctggagaaaaaaagctttgaagctctaataaaaagggttttcccttgaagtttctaatgttgctggggctnggtaactccaactngggaagcgaattttgcaaaggataacttgaacaatcctaaatccaacaaaggggtccttaattgggacaatttaattgaaaaggccctggtttnanccttcccccttgaaatccctggnaaatcaaaccaactncccaaaaaagggattctcccttgtggacaaattttatgaagagttgaagtttgcaatgtttattgaattgggtgggncccccaancctcaatcntttntta

SEQ ID NO: 80430 - DNA, 256 bp, Triticum aestivum
  unsure (1)..(256): unsure at all n locations
  Clone ID: PAT_TA_80430
ggagaggcacaagagcacacgagtcgacgcggcgcgacagctcagctctttcgtctcgtctcgcctcgcctcgccccgccccgcccccttccagtccctccggcgcgccgccaaccaaattcattcccccggggcctaaattcccgaagggctcccgccggccgcaacctcctcaanggcatcanancctcggcgaacaagcngggggttgggaaagaattncttngatnaaacaatnatttnaaaaaaantttaa

SEQ ID NO: 80431 - DNA, 386 bp, Triticum aestivum
  unsure (1)..(386): unsure at all n locations
  Clone ID: PAT_TA_80431
aatgcagcttaaatctctttttgagaattggttcctgatgttacatttagctactcctgtatatcttttagatttttttctctttgtaaattttgatttttgtttgctcaccttgtaatcaactctgtatttgatgatttagaaatcagaattcagtttaactcctgcaattaacccttaatgataaaataattgttcctggntgcactcatccccaaattcaataagcctcaacaatgggtgataagcaattggtgtcaanggagcaaaggtgggagangggaagaaaagaagaaaaaggaagaatgggaagccaaagtggataaaacaaaaganaagtgaaaaggnntttggttcaaaataaatttttccaccggttaaccnga

SEQ ID NO: 80432 - DNA, 336 bp, Triticum aestivum
  unsure (1)..(336): unsure at all n locations
  Clone ID: PAT_TA_80432
ggagagagagagagacctagtttcgagtttttttttttttttttttttttttttttttttttttttttttttttttttngganaaatnaaanaatgcttttgcacggattcttgtaatttanatganggnagtaaanatnaaaccaccccgccagcccncaantcaaccctantaggtgtcncctgtggccngctanaacgggncctncataatctaaanacctaaagttcangctatttngcttgggacaatgtanatgtctattaacnncntaggccanntgtgtgantncttctacatcccttgggattttnggattccaaaatttnacaatt

SEQ ID NO: 80433 - DNA, 216 bp, Triticum aestivum
  unsure (1)..(216): unsure at all n locations
  Clone ID: PAT_TA_80433
gcttctggtaaatgaacacaaagatacattataatagtattagtggacaaatgcgtccattagtactattataatgtatcttctggtaaatgaacacaaagatcggtcttgaaagtactaatggacgcatttgtcnactaatatgttcatttaattttgtnacctatgtttttcatctcatgnnccattangaacatttgntnggntattatttta

SEQ ID NO: 80434 - DNA, 546 bp, Triticum aestivum
  unsure (1)..(546): unsure at all n locations
  Clone ID: PAT_TA_80434
gcctcgtgccgaattcggcacgagggccaagtcttacgccaaatccattcgtggcgaccggcgagacatacgctaaccaacaacaacgtcgccggccgcatgccctgagaagcacctgagctgtccaccagtatttgtccacgatcgagagcgtccatatatactactcctacttattcgattccgtagaatctttctcgatcttcgccatcgctcgccgaccggtccgtcgatcgatctggtccgtggcagccaccggcgagcagtaccaccacctcaagaacgtcgccgcgcacaggcagaggcagacggaccggccggccatgtaggaggagcaccacgacggttgcggtggcggcggtggtggaaaaattgttggggggatcgacgaatgcggtgcacgtggtgctgctncccgtgcctgcgcctcgtcggggggttccctgcaagcgttcaagttctccaanctggctntngggcgtttaaactcacnctgngcggttgtccgccaacttgccgggggtntgcgccaacncnccggggngg

SEQ ID NO: 80435 - DNA, 507 bp, Triticum aestivum
  unsure (1)..(507): unsure at all n locations
  Clone ID: PAT_TA_80435
gaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaaagttcgaagaccctgtccctaactgccaacgctcaagcaacgggagggcctcctcaaagcaaggtccgaactaaccttgattcgcttcaaagttgggttgcctttgcctccgaagttnaancaaagggntgggtttaatcttccgtnaagcaaaaacgcaacccctggggttataacaattggcggttctgggaaatgtggaancttcctnatgttcnggtngaacnancccaaccaaggtatnaaacaagtggnggaaggtaaaaaagggtnaccttgaccctntgntcccaacaatcgggntcca

SEQ ID NO: 80436 - DNA, 571 bp, Triticum aestivum
  unsure (1)..(571): unsure at all n locations
  Clone ID: PAT_TA_80436
gaccactcccaagtactcaaaggcgcgttatgaagaaattgtcaaggaggtctcttcctacctgaagaaggtcggctacaaccctgacaaggttcccttcgtccccatctctgggtttgagggtgacaacatgattgagaggtccaccaaccttgactggtacaagggcccaacccttcttgaggcgcttgaccaagatcaacgaagcccaagaggccctcaaacaagcccctccgtcttcccctccaggacgtttacaagattggtggcattggaactggttcctgttggnccgtttttgaaaactggtgtnaatcaaacctgggttatgggttgtcacctttggtcccaactgggtctgaaaaactnangggcaaagttccgtttaagaatgcaaccaatgaggtccctccttgggaggggggcttccctgggtgaacaaacgttttggcttcaaatggtccaanaaagttncccgttaaanggatntgaaancgttggnttttgnttgcaatcccaactcccaaagggattaacccctcccaaaggaggggancccaactttcaacnt

SEQ ID NO: 80437 - DNA, 618 bp, Triticum aestivum
  unsure (1)..(618): unsure at all n locations
  Clone ID: PAT_TA_80437
ggtgatctgatctttatattttgtgactgctagtggacacgtggagctactggtgctactacacatataagaaatggagatcattaaaggcagcactataaaatgacatcctataactatactgttttgatgtaaataaatgatcacatgccctcagcaccatccacttgtagagaatatttccctcaacaacaacaacaacaacaaaaaaaaacacttgtagagaatatttgagtgtgtcactcattactgagcctgaactgaattgaccatncttgccactcccacttaatttgctcctgggttagtgggattgcaatatggtnggaaaaaaaaaagttgaaaagntgaagtgggtgggagaatttgggaacnacaagaaacaataattcnatngncaattaaccggnaaattngganccttaacaaccctcctcctcctcctcccccccccaaaatnggnatncaacccacntttcaatcnacaaagaanaggggaatggggnacgtcntattcacacacctggttaacacntncaanaacctgcngcccatttncntcncaaagcanccatatangggggaaaaaccgtcaattnanggcccgaaagtttgggt

SEQ ID NO: 80438 - DNA, 398 bp, Triticum aestivum
  unsure (1)..(398): unsure at all n locations
  Clone ID: PAT_TA_80438
ggtttggtaatgttcagagaaaaggacattgaatcacgaccgttcttggaggctgccaaggcttgcatggagatttgcaggtcgagcggagtgccgctgctgatcaacgaccgtgtagacattgccctagcgtgcaatgctgatggtgtccatgttggtcaatcanacatttcggcacggggaggttcgggagctccctttggaccggggtaaaatcatcggtgtcnccangcanagancccngcaaaatncnaancaaaggctttggaggaacgggncggacnacctcggtggcggggggtnnttccaaccaagaacaaagggnaacaatcccnnccntgggaatttaaaggnntaaagntgtttgctttggttcnaaatttcccgntgncnccaat

SEQ ID NO: 80439 - DNA, 244 bp, Triticum aestivum
  unsure (1)..(244): unsure at all n locations
  Clone ID: PAT_TA_80439
ggagagagagagaactagtctcgagttttttttttttttttttttttttttttttttttttttttttttnaggcaactgtcaactttcttattgctgcccanatggcttaagcttctactactaatacagtactgatcaatctaggtttaccactttttagattaaagcatgaaagagggattgacctcnacccttcacctataatataagtacgtgatctcaacactatacacgcccntttcc

SEQ ID NO: 80440 - DNA, 536 bp, Triticum aestivum
  unsure (1)..(536): unsure at all n locations
  Clone ID: PAT_TA_80440
ggaagcacacacgaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcaagctgctagatncatcatcgatcatgcatgcacccgtgccgtgcgtgcatcaatcgattatatcgatctactactaacataccaagttnacccgcaancccggatnnaaggggcctttatttnacgcaaccttgaacctgcatcaagcaaatcaaggtgncaatggccaaangatttgttaaacaaggnccccccntaaattaaaaacctcccttggattaaaaaaaaaaaaaaaaaa

SEQ ID NO: 80441 - DNA, 395 bp, Triticum aestivum
  unsure (1)..(395): unsure at all n locations
  Clone ID: PAT_TA_80441
ggttgattgtgtgcgagactatgaggtgcttcgcaaggagcttcctggcgacacggaggttgcggagtcattgttccatgcccaagtcgcgctgaagacaacccgtggtgaggaggtatcaaatatgaagtttggtggagaggttgagatagttaccaagcatagagcaagtccgagctgctatacattcgcccggggtgactgttctttacttcatggcaacaatgaatcaacagtgtgcacagattaccccatcaagtgggatgctctttgttctgagtgcccttcggttaattttctgaaggtaaaatgttgnatnagaagcccaatnatatcaaaagggcagagaaatgtngcgcgtaatccccgggcaatcaaanatatacaaaggggcc

SEQ ID NO: 80442 - DNA, 511 bp, Triticum aestivum
  unsure (1)..(511): unsure at all n locations
  Clone ID: PAT_TA_80442
cgaggacaagcccatcttcgcggactccagtcccgagcagcacggcgcacccatgtacgactcggagaggatccctgcggcggccaaggaggtggagcacaacgacgctccggcagcggcgcaggaggtgaagcgcgaccacgccgcggggatgcggctcggcgacttgggcggcccgccgtcggcgaaggaggtgaagctggatgacacccagagggtgccgctcggcgacctttggcgccccggcagcggcgcangaggtgaagcgcgacgacnctccgggggtgcggctttggtgancttggcgcccccggcagcgggcgcaaggaggtgaaacccaaacgaacgcttcctggggtgcgggtttgctgaanctttggcgcccccgggcaaccgggcgcaaggaaggtgaaaaccgccgaacnaacancccaaggaaggtggccgctccggggaattttcggcangcccttttcnnttnaaggannccccgggcngtncccnaaaatcc

SEQ ID NO: 80443 - DNA, 421 bp, Triticum aestivum
  unsure (1)..(421): unsure at all n locations
  Clone ID: PAT_TA_80443
cggccgcacccaccctcaatcatcgtcgtcgtcgtcgtcgtcgtcgtccgcaaccaatcaatcaccagcgagcgacctaaacctccgctccgtctccgcctccgcgcaaaaccctagcggatccgtcgaccccgcggagaggagggagggggtccgaagatgcagatcttcgtcaagacgctnaccggcaagaccatcacgctcgaggtcganagcagcgacaccatcnacaacgtcaaggccaanatccaggacaaggagggcattcctccaagatcagcaaaggctaanttttgccggaaaancaattggaaagatggggcgaaacattatctgattacnaacattcaagaaaaagagtccacnctccaattttgtccctgaaggntttangggggtggggnactaatggtnnaaaggg

SEQ ID NO: 80444 - DNA, 532 bp, Triticum aestivum
  unsure (1)..(532): unsure at all n locations
  Clone ID: PAT_TA_80444
ggtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgcctttgcctcgagttcancaagggtgggtttatcttccgttaagcaaaaacgcancccctgggtactacgatgggcccggtactggacaaatgtgggaagctgcctatgtttcgggatgnaaccgacnccaacgcaagttaatcaacnnaggtngagggaagttaaaanaaaggagttacccttgaacgcctaatgttccgcaatcaatcgggattccnannaacaatcngt

SEQ ID NO: 80445 - DNA, 533 bp, Triticum aestivum
  unsure (1)..(533): unsure at all n locations
  Clone ID: PAT_TA_80445
gcacttatcatcatcatcagcgcccctccgtccctcctcgcgcgtcgtgatccatccagcccaggtgattaaggtcgccatgtcggactccgaggaccaccacttcgagtccaaggcggacgcgggggcgtccaagacctaccctatgcaggccggcgccatccggaagggcggcttcctcgtcatcaagaaccgcccctgcaaggtggtggaggtttctacctcgaagactggaaagcatggtcatgctaaatgccactttgttgccttagatatattcaatggtaaaaagcttgaggacattgttccttcatcccacaactgtgatgtgccacatgtggaccgttactgangtatcagcttgattgacatatcnanaggatgggattttgtgaagccttcttnactgataatggtancactaanggntgattctttaaaactcccaaacttgattgancgcctttccctgaacccaagcttcaanggattggattttgctnaanggggaaaagattnccgcactngaaaat

SEQ ID NO: 80446 - DNA, 551 bp, Triticum aestivum
  unsure (1)..(551): unsure at all n locations
  Clone ID: PAT_TA_80446
cttcacttgatttagttggacagtgtgttcagtatttcaatagttcagttgtttcattgattgacatgtgcattctcgtacttagtgaagcatcttaatgcattttcgtactctgtgaagcatcttaatttgattgatatgtgcattcagttgagaactcaagaagtagaacaactgtgtttcacttcttcagatggtaatttttatcggttatagacttatagttacaattactaagaagtagcaaaggtctgggtttgtttagaccttgagttggtagctatgcttttttgtttcagatcaatatgttggtacttcattttactcagattatatgaaaggtgaagtgtaatttgtgtgatctggattaagggacgcaatgaaattcanaaagtaagtaaaangtacactngttttttaacnttccttcaagnaatgattaacnacagnanttcncccgcttcaatnggtaaaattaattgccaatgggccctcaaatngggtagggttgtacccctngaataggttatnattatccctaaccgaggtnc

SEQ ID NO: 80447 - DNA, 248 bp, Triticum aestivum
  unsure (1)..(248): unsure at all n locations
  Clone ID: PAT_TA_80447
gattgccttcaagctcaataatatgaccacacaccaagtttctgaatgactgatgcacatactagggttatacttaactcttgattgtgcattccacctanggcttgaacatgggtggcttcctcactttggtagcttgctcgaatgcatacgccatctcgatcagccttggctcgtacccctgcagcccaccgaagcatatgccaaagggaaccccttgctcattaaaccccgctggcacaatgatg

SEQ ID NO: 80448 - DNA, 492 bp, Triticum aestivum
  unsure (1)..(492): unsure at all n locations
  Clone ID: PAT_TA_80448
gctccggcgaaacccagccccagtccaccccaccgtccgcatccatggcgcccaaggccganaagaagccggcggcgaagaatcccgcttatgatgagcccgcggcggagaaggccgagaagactcccgccgggaataagcccaaggccgataancggctgccggcggggaagtcggccgccaangagggcggcgacaagaaggggaaagaaagaaaggcaaagaaagaacgtgggagacgtacaaagattctacatcttcaaagttgctgaaacaagttgcaaccccgacatccnggatctcctccaagggcatgtncaatcaatgaactccttcatcaacnaacatcttcnaaaagctcccccgggaagggcnccaanctgggncggtncaacaaagaagccaaccatcacnttccggggaaattcaaaactccgtncggctcgtcctccccgggganctcnccaaacancccgtctccnaaggnaacaa

SEQ ID NO: 80449 - DNA, 314 bp, Triticum aestivum
  unsure (1)..(314): unsure at all n locations
  Clone ID: PAT_TA_80449
ngtctctctcccccnancccgcgcacccgcggcanttcccccctcccgccacataatccncctccatggcctccctcgccgccgcctccgcctccacngtgctcctcttnncgccctccacctcctcctcnaattcccctcctcccgctctcnacatccctcgntttctcnnctcccgnttcggtnacnccncacngtggtngctttggcnggtganctccggnacgcncccggggctnctcnttcttgcnctcctccaaggggcaatttctatnggggancaatnccccanttnaacaatccgggaccaattc

SEQ ID NO: 80450 - DNA, 551 bp, Triticum aestivum
  unsure (1)..(551): unsure at all n locations
  Clone ID: PAT_TA_80450
gcggcatcctcctctcctccgataatacaataccatggcccccgccgtgatggcttcgtcggctaccaccgtcgcacccttccaggggctcaagtccacagccggtctccccgtcagccgccgctccagcggcagcctcggccgcgtcagcaatggcggaaggatcaggtgcatgcaggtgtggccaattgagggcatcaagaagttcgagaccctgtcttacttgccacccctctccacggaggccctcctgaagcaggtcgactacctgatccgctccaaagtggggtgccctgcctcgaagttcaacaagggttgggcttcgtcttccgttgagcanaaaaagctcctccggggtactaacgaacggtcgaataactgggacaaatgttggaaacctggcctaatgttcgggggtgcnacccgacnccaacgcaaggttcctccaaaccaaaggttgggagggagggtaaaaaaanggaattanccctgaacgcctaatgtcccgcggtcatncgggtttcnaaaaaaccttggncccaaggtngcaa

SEQ ID NO: 80451 - DNA, 401 bp, Triticum aestivum
  unsure (1)..(401): unsure at all n locations
  Clone ID: PAT_TA_80451
gctgatcaccaagcacagccgcgcatccaccgctgctagcaaggtcgagcaagcagcacagagatggctgctgccttctcctccaccgtcggtgccccggcttctacgccgaccaacttcctcgggaagaagctcantaagcangtnacctcnggcgttganctannatgggaagagctccaagggcaacaggttcacggtcatgggcaancgggaaaacatccacnanaaaanggaaacaaccgtcctagttggaaagggtccttgcngtttcgaatatctccccaacgaaccaagcaaaggacaattaaccaaganggggaaanggggaatncnttggacccccctcctttcaanggcngcccaaattggngaaangggaacccaacaaggggcgttct

SEQ ID NO: 80452 - DNA, 482 bp, Triticum aestivum
  unsure (1)..(482): unsure at all n locations
  Clone ID: PAT_TA_80452
gctcctccgataatacaaataccatggcccccgccgtgatggcttcgtcggctaccaccgtcgcacccttccaggggctcaagtccacagccggcctgcccgtcagccgccgctccagcggcagcctcggcagcgtcagcaacggcggaaggatcaggtgcatgcaggtgtggccaattgagggcatcaagaagttcgagaccctgtcttacttgccacccctctccacggaagccctcctgaagcaggtcgactacctnatccgctccaagtgggtgccctgcctcgaagttcaacaaggttggcttcgtcttccgtgagcaaaacagctccccccgggtactacgaccgtcgataatgggacaatgtggaaagctgcctatgttcgggttgcaacgacnccaacacagggtgctcaaacgangtgggagggaggtcnaanaaanggattacccctgacgcctaangtccgcgncaatcgg

SEQ ID NO: 80453 - DNA, 531 bp, Triticum aestivum
  unsure (1)..(531): unsure at all n locations
  Clone ID: PAT_TA_80453
tcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacaagtcatggcaagcggaaaacctcgacgagaagaggaacacggacaagtggaagggtcttgcgtacgatatctccgacgaccagcaggacatcaccaagagggaagggcatcgtggactcgctcttccaggcgcccacgggcgacggcacccacgaggccgtcctcaagctcctacgagtacgtcagccaggggactcaagaaattacgacttcgacaacaacatgggangcttctacatcgctcctgctttcatggacaagctttgttttccatctctccaaagaaattcaaggacccctgcccaaacatcaaagntnccactcatccttggggtatcn

SEQ ID NO: 80454 - DNA, 539 bp, Triticum aestivum
  unsure (1)..(539): unsure at all n locations
  Clone ID: PAT_TA_80454
gaagctaatctcgtctccgatcgactcgaggcttgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattccccctgaccagcagcgtctcatctttgctggcaagcagctggaggatggccgaaccctcgctgactacaacatccagaaggagtccaccctccaccttgtcctgcgtctgcgtggtggcatgcaaatcttcgtgaagaccctcaccggcaaagaccatcactctggaggttgagaagctctgacaccatccgaacaatgtcaagggcaaagatncaaggaacaagggaggggcaattcccccgggaccaacaagcgcctggattctttggccgggaaagcaancttggggggatgggccggcaacccnttgcgggactaacaacaattccaagaaagggggtccaaccctnccaacctgggggggnt

SEQ ID NO: 80455 - DNA, 534 bp, Triticum aestivum
  unsure (1)..(534): unsure at all n locations
  Clone ID: PAT_TA_80455
gccccttccgccgccccttccgccaccgcccttccccggtgcggtgacgccgccccgcgccaccaggaacccaggaccggcgggccggggcctccccgtacgaccgcgccagcgctgctgcgtgctggtccaagcaaccccagccgtccaggggacgccatcgccgccgcctggtctccaagcatccagctactccagccgtccctccgtttgcctccctcctctccacactccaagacaggacgaccgacggtcgactccctctgctgctgaccaggacgctggtatctctgtgtcctgaagtcatatgtgcgtaacanagcacatccagaaggatctatcgcttaaagcacatctgcaagacaagtggcaatgatgtttttgttcaagaatatatttgatgggttccgcaacaaagcataatccggccntcaaaggnattgacgaattaacaattaagggngggttggattgtttnaaanaaaggattnaaactcctgntttncctttcnggtagggaaaaacaaanttggg

SEQ ID NO: 80456 - DNA, 457 bp, Triticum aestivum
  unsure (1)..(457): unsure at all n locations
  Clone ID: PAT_TA_80456
gcaccttcttccactgctgccgccgccggcagccgaacctctggggatcccctctacttccttctgacccggcgcgccactgccttgcccagtcccaatacaccgctctccgccgccactggaacctactgccggccaccttcagatccggcgatccccggcgacacgacccgcccaccaccttctcccgtatgcggatccgttggatctcgggctccactcccttcccccaacctctgcacggcgcgggtggccggtggtggggagggccaaccaccgtgccctaaaaggagctcaaccactgagggaagcgcgattcatccttcgggcggggcgaccgggatgttgcgtccccttcctaatcttccaacttttgcaaggtgaacantgggcaacccctccgccccggctgggatncgggccaatnatctccaattgggggggtggggtttttcaa

SEQ ID NO: 80457 - DNA, 431 bp, Triticum aestivum
  unsure (1)..(431): unsure at all n locations
  Clone ID: PAT_TA_80457
gcttttgcantatccatccccaggagcatgattggcggcaggagaggcggattcatctnagatanaacatgaacagtacctaaatctgaccagacgcgcnactggntgggacaanaggaggcgcgcatccatccgcggttccgggccggcggcactggcacgattttcgccgcccggtncttatccaacgcccgggcacatcgcgcaancactntccgttaccgccctgcgcccgtccttgtattcctccggattccaccaacnggtttgattaaacgattgtttggccccctaataatntaatcctctaatnnaacaatttntaacatcctcaanggggnaanancaaatncaaaataaanggcccccanccaaatttnatcccaagctnccanttttatnnaatncaaatctatgtgccaattncacct

SEQ ID NO: 80458 - DNA, 494 bp, Triticum aestivum
  unsure (1)..(494): unsure at all n locations
  Clone ID: PAT_TA_80458
gcgcanacagacagagcttgagagagcgcgcgcgagatggcagcctccatgatcacctcgccgattgtggcgccgacgagcgtcccctccctctcccgccggggttcctccttcgccgtcgtctgcagcggtggcaanaatatcaaggtcgacaagccccttggacttggaggcggcttgacagtcgacatcgacgccaacggcaggaaggtgggcaagaagggcgtgtaccaattcgttgacaagtacggcgccaacgtcgacgggtacaacccaatctacacgccaanaagaatggtctgaatctggtgaacgctacgccggcgggacgaacgggcttcttaactngggccgtcaacctcgncgggntcctcggggggggggcgtnctcctcntctaaaaaaacaaccgctcnccgnccgggtaaaaanancanttaattttaanaaaagggcgggtcttctncttgnaaggnacgtctctgntnatctaaa

SEQ ID NO: 80459 - DNA, 472 bp, Triticum aestivum
  unsure (1)..(472): unsure at all n locations
  Clone ID: PAT_TA_80459
gaacaccaattcctcggnaatggcgaccatcccgatcgaggagctgagtcnggcgattgggtcctacagccaagcttcanaccctaaccaccccacgggcgccactgcaaggcccattgcttaacttccctaagcttggagaanatctgggactggaaccctctccctagaacctccaanggtttgcacaatgcttcaagtaacttcttagttgcantgaatgggatcaatgcacttatncaatatatatgcctccccattattttgtngaacnttagtggttanaantgcaagaccanatttaatnccgggggccnaaaggatcanangggcttatcaatattggtgcatnggggaactaangtttaacaangntttanaaggncaangtttcctnangtcccccaatgggcaaanttaaacttnggtggnnaacaacctgggtccnggtggccaatttttcaatntttcc

SEQ ID NO: 80460 - DNA, 537 bp, Triticum aestivum
  unsure (1)..(537): unsure at all n locations
  Clone ID: PAT_TA_80460
gccggcctccgcgacgcctcttcgattcgccctacgcagctcaattccactgacaagatcgcgatggccgccgacgagcttcctcatcagatggcgatggccgccgactagctccctgatcagatcgcgttggcgccttccgcctgctccaccaacagctgcctgcaggggcttgcgcaggaggatgactatgcgatactaattcctctttcccacatctttgccctcatgctgcaagctctcaagttgccccctgcaatttatcatcacaagacatatctagccaatggagtctcgtgtgacggttactttcaattcatcaattacagtttatcgatgggtttgcttattccaacctcgatttctggggtgattctcnaanaactgtgattaangcggaanacanttgctgctatnggcagccattaanantttnttggagggatngtnttttgggcaaagggaaatncanggggaactaatccacnaacatcccaatgntttaaaaagggntggggaaaataaagtcaaccccnc

SEQ ID NO: 80461 - DNA, 184 bp, Triticum aestivum
  unsure (1)..(184): unsure at all n locations
  Clone ID: PAT_TA_80461
gtccatcgaccatgggagccggccatgacctgnaggccggcgccggtgacggnggcgagaagaagatggccactcntcctcctcnggcncgctcccgccgtctgagccgccgcacctgcggggccangaccccgcccagtaccaantntggtaccttccacccccctgtncccaattngcgttt

SEQ ID NO: 80462 - DNA, 532 bp, Triticum aestivum
  unsure (1)..(532): unsure at all n locations
  Clone ID: PAT_TA_80462
gctggcttgtggcagccaagcgttcatagcgacgttgctttttgatccttcgatgtcggctcttcctatcattgtgaagcagaattcaccaagtgttggattgttcacccaccaatagggaacgtgagctggggttagaccgtcgtgagacaggttagttttaccctactgaatgacagtgtcgcgatagtaattcaacctagtacgagaggaaccgttgattcacacaattggtcatcgcgcttggttgaaaagccaagtggcgcgaagctaccgtgtgccggattatgactgaacgcctctaagtcaaaatccaanctancaaggnaacgcctggcgcccggccgnccgccccgaaccacgttaggggcgcttgcgcccccaangggccgtgccattgggtnaaccggtccggccgaagtgcccggtcgggccgcctccaaagctcccttccaaacggggggtggggctgaatccnttggcaagacgaacttaaatacncnnacgggggnattgttangtggnaaagttg

SEQ ID NO: 80463 - DNA, 545 bp, Triticum aestivum
  unsure (1)..(545): unsure at all n locations
  Clone ID: PAT_TA_80463
gacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccacccgctcaacacggaggncctcctcaagcaggtcgactacctgatccgctccaantgggtgccttgcctccgantttnagcaangttggggttcaacttccggtgagcaaaaacgcaatctcctgggtactaacatnggccgggtattgggcaatgttggaaactgcctatgtttcgggtgcactgacgccaacacanggtngatnaacnaaggtgggggggaggtcaaagaaaggagtaccctggaccngnatgttccgcaacaatcnggatttcgacaaaaattccgttaangnngcaattgcgtcaagctttcaancgcccttnaa

SEQ ID NO: 80464 - DNA, 635 bp, Triticum aestivum
  unsure (1)..(635): unsure at all n locations
  Clone ID: PAT_TA_80464
gagaagccccgacgctcaagcccccagacgccgcancgccgccactccacccgcagcggcaaccatggcggtcggcaagaacaagcgcatctccaaggggaggaagggtancaagaagaaggccgtcnatccgttcaccaanaagcagtggtatgacatcaaggcgccgctgctgttcaccaagccgcaacgtcggcaagaccctcgtgtccaggacacagggtaccaagattgcctcagagggtctgaagcacagggtgtttgaagtatctctagctnatcttcagaacgacgaggaccaagcctacaggaagatcagactccgtnctgaggatntgcaanggattaatgtcctcaccaacntntggggcatggacttcaccaatgacaagctcangtcccttgttaagaaatgggaaacactcatttgggctcaagtggatgttgaagacnacttgacaaataacatngcntcccaatggtttcgccaatttggcttnancaaanaaaacnccnaaacaaatttgaatcncaatttctatgcccaaannaantcagatnantacantattccccnnaaagatnggttgnaattatgggcaaacaaacctncaaacngtttacnttaaaggagc

SEQ ID NO: 80465 - DNA, 195 bp, Triticum aestivum
  unsure (1)..(195): unsure at all n locations
  Clone ID: PAT_TA_80465
gagtaaataaaaacggagggagtatttgcgtatggaacttcgtttaggaagttgttccgtantcaaaattgataaggttagttgtaatcgccatgctcagatttagttcattttgaactaaaaaaaaaaaaaaaaaaaaaaaaaaaaaaaaaaaaaaaaaaaaaaaaaaanaaanaaaaannaaaaaanaaaaaa

SEQ ID NO: 80466 - DNA, 531 bp, Triticum aestivum
  unsure (1)..(531): unsure at all n locations
  Clone ID: PAT_TA_80466
gcacaccccggggtcgaggccganaagcaccaccagtgacgcccgcgcccgttcccctcgtcggcgtccacctcggccaccggttcgatccncggacgtccgaccctcggccccctcgacctcgtcgcgaccctcactacctcgagaccgctgctgatgcccctgtgatcaactacatcgacgacgacccttgttttgtttcaagcaaagcttccagatgctggagtccangagccanacgccaccctcgacgacgactactcctactacaccggaggtgcctactactacgtgcaaccccgctgacgacgaccaangaagtagtttaggaggatcccaaggcaaggaggcctgcgcctccttttgatctgtatcccantttgtgctanccttcttaaaggaaaacttggttaacttaagtcctgtactcanatatttggttgcttccgctgaatcntccatnattcaacacntttnttccaaccctcnangggccctggnttgtattaagnangcttgtatgactaatta

SEQ ID NO: 80467 - DNA, 395 bp, Triticum aestivum
  unsure (1)..(395): unsure at all n locations
  Clone ID: PAT_TA_80467
gctctcttctcctcccacgccgccgaccgcgggtccggctcgtcgggcccccgaaatccggccagatccgcctcagcggacgccggcaggccagccggtccgcctcgccgacgccgggacaccagccctagtcttcatccgtcggcgctcgcggtagggtcctcatatccaagcctccagcgacgccggtgaagccgcccttcgcctcctctgccctcgcgcctttnccggngcctgccgaatcgtgctcacgccgccgttcgtcttcaaccanaacttccgncatgggngaaagcctggannaactttcaacgcccgtttccgcgcttcgggcggcgggatgctnaaaaatngacnggnttcanccctgaaccgagaaggnatggggccnacca

SEQ ID NO: 80468 - DNA, 614 bp, Triticum aestivum
  unsure (1)..(614): unsure at all n locations
  Clone ID: PAT_TA_80468
gctcttctctcctctgcccacaaaaccctagccgtcgtctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgcccaatncgcacgggagattatcatcaaggggcaacgcggacgcaaaacgtgctttggtgaagaangggccgcaaggatnaaggggagctcaacctcccgttcgtccaagaaacggttcaaactttcccggagaaacgggngttttaagcttttacgnccgangaangggtcgtccaaaccggttgggcctcctggcggccnatcngccccaaaggctgaagtcaattcccgnctacaaaacctcctccngggagggccntngccgtcccgcaaagggcaaagnctantgggngtttcctccccttttnttntgggnaaaattggggccntaaagggntnttaaggncnattttggangcggggaaancccaaagggnccanaaaagcccaattcaattaa

SEQ ID NO: 80469 - DNA, 620 bp, Triticum aestivum
  unsure (1)..(620): unsure at all n locations
  Clone ID: PAT_TA_80469
gctaggaccatggcgccagccggaggacgcactacccatctcctcctgctcgccctcttcctgtccttcgtcctcgcctcatccgcggctgcgagctacccagaagcacccaaggccagggcgccgggggattcttcagcggcataccgtggttccgcggcggccaanccgggttggcgctccgaggtgcggaggcatgggcgccgggtttaagttggcggggtgggggccccggccggctttnggccaaggggggaaaggttccgcgccggcgcgggaattctgcaacccttccgttggtcctgcccccgaacaaaggttccctttttacaaagcaagcgggntnaaaattgcccgttccaaattgcnttcaacttccntanaagcttaccaatgggaaaaaaattggccggaangaaagtngtttggcggccggttngtttcaaatttccaactggaacaaactgtcgaaggcccaaatngctnntttcaaacnaaccaaacttacggggggggggaaaaattggtttaattggggaaaagggttccntncanaactccaaattaacaaatcccagggccnaaaccggcccatgnaactggtttaanttaancccacn

SEQ ID NO: 80470 - DNA, 551 bp, Triticum aestivum
  unsure (1)..(551): unsure at all n locations
  Clone ID: PAT_TA_80470
gcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacaagtgacatcaagctcaaggacgacaagactctgctcctttggcgaaaaaccanttaaccgtccttccggcgtcagggaaaccttganggaattcccttggggttaagggcttggtgnccgaataactttnttggaagttccaacgggtntncttaactggaaaanggacaangggccgcctncccantttnaaaggggtggtggcnaanaaaggggggnaatctcctgccccaaacaaaanattcccccaaagtttttggngtggggttcaacnaagganaaatncnaccccaaaacgntttacaatttttcaaaatgcntaacctggaac

SEQ ID NO: 80471 - DNA, 564 bp, Triticum aestivum
  unsure (1)..(564): unsure at all n locations
  Clone ID: PAT_TA_80471
ggccgagagaagggagaagatgtcggggcgcggcaagggaggcaagggtctgggcaagggcggcgccaagcgccaccggaaggtgctccgcgacaacatccagggcatcaccaagccggcgatccgacgtctggcgcgtcggggcggcgtgaagcgcatctcggggctcatctacgaggagacccgcggcgtgctcaagatcttcctcgagaacgtcatccgcgacgccgtcacctacacggaagcacgcccgccgcaagaccgtcacagccatggacgtcgtctacgcactcaagcgccaaggggcgcaacctctatggattcggaggctaggctccggcgaagcgaatccaagctcccnacctgctgattnagatattcanattancaattnnctanggcgtttgttcanttgttcaatgggtgatagaatgttaattttatgaatgccatgggtgcccttgtttccctnggaatgggatttaaatagcttttttttttanccccaaaaaaaaaaaaaaaaaaaaaaaaaanccccaggggggggggcccgntaccaaattg

SEQ ID NO: 80472 - DNA, 491 bp, Triticum aestivum
  unsure (1)..(491): unsure at all n locations
  Clone ID: PAT_TA_80472
gtacaataccatggcccccgccgtgatggcttcgtcggctaccaccgtcgcacccttccaggggctcaagtccacggccggtctgcccgtcagccgccgctccagcggcagcctcggcagcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagttgggtgccctgcctcnaagttcagcaaaggttggcttccgtctttcgttgancaaaacanctccccccgggtactnacaacggccgatatggacaatgttgganctgcctaatttttcggggtgcaacggacgccacngcnaggtnctcaaacgaanggtggaaggaaggtcaaanaanggagtaaccttgaanccctatnttcgcntncancccggttccanaaacctng

SEQ ID NO: 80473 - DNA, 541 bp, Triticum aestivum
  unsure (1)..(541): unsure at all n locations
  Clone ID: PAT_TA_80473
gcttccggcgaaacacagcacctctccccggcgaagcagcagcgtccaatggcccccaaggcggagaagaagccggctgccgcggagaagaccccggcggccgagaagaccacggccgggaagaagcccaaggccgagaagcggcccccgaagtccaaggagggcggcgctgacaagaagaagaagaaggccaagaagagcgtggagacgtacaagatctacatcttcaaggtgcttaaacaagtgcaacccggacatcgggatctcctccaagggncaatgtccatcatgaaactccttcatcaaacgaacatctttcaaaaaagctcgcccggcgantcccgnccnaagctccgcccggctacaaacaaagaaagnccaaccatncacgttcaaagggaagattcaaaaaccttccgttacgcctccgtccctccccggggggaagctcncccaagcaacncaattttccgangggcaacaaaggcccttcaccaaantttaacctccnncctaaaaccaannatnggttctnctgtta

SEQ ID NO: 80474 - DNA, 383 bp, Triticum aestivum
  unsure (1)..(383): unsure at all n locations
  Clone ID: PAT_TA_80474
ggccagccaagccaaccaaatctttatcgtcccctgccaatcagctccgtccatccatctccccccttcctatgggcgcggccgagcagcatcagcacccgccggcgccggagggggagaagaagactttggtgttcacgtacggcacgctgaagcggggcttctccaaccacgggctgctgcaggaccttgcgcgccgcgggggacgcggccttcgttnccgccgcctccaagggcgccccgctgcccgctcgtctggcggggcctaacggntccccttcctcctcaaacttcccggttatgggcaacgcgttaaggggggnaagttctactccggtnaaccgcaagggggctcccccccggtnggaacaanctcnaaaggg

SEQ ID NO: 80475 - DNA, 345 bp, Triticum aestivum
  unsure (1)..(345): unsure at all n locations
  Clone ID: PAT_TA_80475
ggtttgttcgtgcggctgagcaggagggaggaggaggacgacggcgccggagcanctgggagcggttcaggcgggtccagatggcgcggganangcgggcgatacggcggataaagaacgcggcggcgcggcaagtgaccttcctccaaacgggagggcgcgggctgttcaagaaagggcggaggagctcgcccgtgctctgcgacgcccaacgtccgcgctccgtccgtcttcccctccaacccggnaaagctcccccaatttcncccangctncaantttgaacnnagatnaatttnacaaagttatantaccncaantcaaaaggaaacctggggggaaaat

SEQ ID NO: 80476 - DNA, 170 bp, Triticum aestivum
  unsure (1)..(170): unsure at all n locations
  Clone ID: PAT_TA_80476
cggaagagctacagcccgctgtcctcaatgttgtcaagaaggctgaaaaacttatgttggagaaaagagaattcatangtaaatgcttgtcttcttttaattaagagaagtcttctcttaattaaaagaagacaagagatgatttctttagcacaaaaaaaaaaaaaaaa

SEQ ID NO: 80477 - DNA, 452 bp, Triticum aestivum
  unsure (1)..(452): unsure at all n locations
  Clone ID: PAT_TA_80477
gtcctcctctcctccagataatacattaccatggcccccgccgtgatggcttcctcggctaccaccgtcgcacccttccaggggctcaagtccacagccggtctccccgtcggccgccgctccagcggcancctcagcagcgtcagcaatggcggaaggatcaggtgcatgcaggtgtggccaattgagggcatcaagaagttcgagaccctgtcttacctgccacccctatccacggnggccctcctgaaacaggtcgactacctgatccgctcaaagtgggtgccctgcctcgagttcaagcaaaggttggcttcgtcctccgttgangcacaanaantcccccgggtataacgaacggggcgaatactgggacaatgtggaatcctggccnatgtnccgggtncacttgacgccaatacacngtgccnaaacgangngggagngacgtc

SEQ ID NO: 80478 - DNA, 383 bp, Triticum aestivum
  unsure (1)..(383): unsure at all n locations
  Clone ID: PAT_TA_80478
tctgatnacagtaggactaacttcagctaacctgcancgtctgccactccgggcattttcttgcatcaaccacggcaatggccaccgctgatgtccagaacccnacggccgcgctnacggaggaggcgcccgcggtgganacncccgtctccgccgaggaggttgctaatacagaggaggtccccgcgccggtggatgccnaagtcgaggcgcctgccccccgtcgaggttgangcgaccaaggaggactcaccggccgccgcccganacgaaggaagaacaangaggcccnanccatcaactgctnccgatccgggaggccganggcgccgaaaganncancccttgtcaagacaaaagaccaaagganggcgggtgggcaa

SEQ ID NO: 80479 - DNA, 170 bp, Triticum aestivum
  unsure (1)..(170): unsure at all n locations
  Clone ID: PAT_TA_80479
ggaagggtataaantaagagaaaggtgancatacactggtacataatangcatgctctcggttcatgcttnaaaaagattacnaacagagagagaaagtggcccctngtgaagcagctgttgcattggggagtttattttatagtactattgctcaacatactttatcta

SEQ ID NO: 80480 - DNA, 463 bp, Triticum aestivum
  unsure (1)..(463): unsure at all n locations
  Clone ID: PAT_TA_80480
ggtacgctgccactctttcccaaccacttacttagctagctagcagccatggccgccctctcctctgcagcggtgtccgtcccttccttcgccgccaaggctgccacccccatgcgcagcagcaggatggtggtgcgcgcctccctgggcaagaaggcggcgaagcgccgcggtcgccgtggcggccagcgcgatgctgctgggcgggtcggcgatggcgcangacgtgctcctgggcgccaacggnggcgtgctggtgttcgaacccaacgaattcancgtcaagtccggggagaacatcaacttcaaaaaaaaaccccggttccccgcaaaaagttgtgtttcaanaaggaacccgtnncgtccgggggtggacgtctccaagatntcccangangagtaactcaacgccccaaggnaaaacntttcantnaangctcaacgtccccnggaactanaggtt

SEQ ID NO: 80481 - DNA, 615 bp, Triticum aestivum
  unsure (1)..(615): unsure at all n locations
  Clone ID: PAT_TA_80481
ggtggggaagacgcagctgctggggcgcttcgccaaggacgagttcttcctcgactccaagtccaccatcggcgtcgagttccagacccgcaccctcaccctccaccgcaagcaagtcaaggcccagatctgggacaccgccggacaggagaggtaccgggcggtgacgagcgcctactaccggggcgcgctgggcgccatggtggtgtacgacgtgacccggcgcgccaccttcgaccacgtgccccgctgggtggaggagctccgcgcgcacgccgacngctccaccgtcgtggcgctcgtcggcaacaaggccgacgcgccggcgcaacgcccgcgagggtgcccgccgaacnaangccgccgcggtttcgcgggaggagcaaagggctccttcntctccngaaggnggtccggcgctnaacngggggaanaaacgttggaggcggccgccctttcctcccggctccctcgaanganggtcctcncccgtccttctccccgnccggggcgcttggggcccnccaacaagggggcgggggggacacnccaaaagggccnccnaanaggggggnaaagggcccttttcacttgaangggggaacaaagggttng

SEQ ID NO: 80482 - DNA, 563 bp, Triticum aestivum
  unsure (1)..(563): unsure at all n locations
  Clone ID: PAT_TA_80482
gctttacagtcatcttgtagcttttgcttgcagcaatacgttcagttagaatgttttaacttatcaattacactgaattgacaccctgcataattagtcatatcatgagccaaaataatatttatcattctctcccacatctgtagttancttgataggnttttgcttttaacnggaactnaccccangcataagatagtaaaaacaccntcacatttagattggtttgnccaatgatttttcaggagatagacaaagaaaactgcttccttttaaattttcacatgttcgaggagttttatttccccctttggaaaaattaagggttgcccnancccctgtttaccttccntggacccttaaggttagaacantgacgggagcttacttttggggaacaaccgttttccctcaacnttgtttcctgantgaacgtaacccacaaatttgaaggccccccaagaaaaccngtccacaagcaaataccngtccccccaaaggggtttttggncctccaaaccttccataaagccaanaaanaagttttnaaacanctgaaaggg

SEQ ID NO: 80483 - DNA, 568 bp, Triticum aestivum
  unsure (1)..(568): unsure at all n locations
  Clone ID: PAT_TA_80483
ngcctcgtgccgaattcggcacgaggtgtttgatgaatggctaaacgaatggtggaagagttcaccaaattcatctgacccctcaaatgaggcctcctcctccctttctgaagaaagccangaaaaccttgaccagagtgatcaagatnttcaagcctggttggaaggacattttccgaatgaatcaaagtgagctcgaggctgagatacgaaaggtttctcaagattctagtcttgatccanggaggaaagcaaatctnatccaaaatctcaagacgaagccgctggatanctgccaacaaaaatcaccaaaaccaagatnaagaaagatnataatggatttactggtatacctggattttttccctccctatcgagattcaagagaaaacaaaatattgggttgtgngcaatacaaaaagaaactgcaagcntggttgccngcctgcngcaaanaagcngttcaacatgcaagggtctgtccatgaaaaaaagttagtgggtcataccnatnggggagggaaagcaacctttgggaataagtggcaagtccagtttgnaaagttca

SEQ ID NO: 80484 - DNA, 658 bp, Triticum aestivum
  unsure (1)..(658): unsure at all n locations
  Clone ID: PAT_TA_80484
cctcgtgccgaattcggcacgagggtgcaaaagactgttttgccatatcatggcttcgagtgggaggttccagtacatgaagatggtccttctccttgttatactggagctcattctgggaatctctgcaggttacggccgcggagtccccatctacagcaaatgtacgtgctccagacattccatcataatatctaaccagttaagggtttttttaatcgacaactatatatgatagacaagccatccttactgttttaatccgattaaacaatttaattgggcttantaacacaataaaacctcaaaaagtttcaattggggtcccgttantaaacctaaagttcctcaactcaattattggttaatggtttaatcaataattgaatttgtggggaataatggaaacccgggaagggtccgtcattaattaancctgaaggagggtttcaatttaaatacctcaaccccnnatttcttgtnaatcacaaaacnatgcncaaaaaaatntgggtaaggtttgantaaaattggctaaatttataaaaatcgnttatnnttccaangaantnttgccccctttttttggtaaaaaaattngtttcccccnggaaccaatgtnnttctcccttctanaaanggcnttttctaccttaag

SEQ ID NO: 80485 - DNA, 203 bp, Triticum aestivum
  unsure (1)..(203): unsure at all n locations
  Clone ID: PAT_TA_80485
ggtcgtcccctgcatttccctttctcctcaccctcactcccganccgaacgccgccaccgtccccnatctctggncgctgcctcctccggngactggatccggatcccccgcccccaaaacctccncntanccccnatcgtanggaccccnccgccccntatcactacnccncgcccacccccgctccacncnatccccgacc

SEQ ID NO: 80486 - DNA, 576 bp, Triticum aestivum
  unsure (1)..(576): unsure at all n locations
  Clone ID: PAT_TA_80486
gccagatcccccaagagctcgcactcccccaccccaccccagcctctcgtcccgatggcccgcacgaagcagacggcgaggaagtccaccggcggcaaggcgccgcggaagcagctggcgaccaaggcggcgcgcaagtccgcgccggccaccggcggcgtgaagaagccccaccgcttccgccccggcaccgtcgcgctccgcgagatccgcaagtaccaaaagagcacggagctgctgatccgcaagctccccttccagcgcctggtgcgggagatcgcgcaaggacttcaagaccgacctccgcttccagaagctccgccgtctccgcgctgcaangaggcgggccgaggnctacctcgtcgggctctttgaggacancaacctttgcgccatccangccaagcggcgttaacatcatgcccaaaggacatccanctcgcccgccgganccgttggngaanaangggctaaaaacgcttccaancttgggttggngggggtaaaaaggntttaacntcngaatccngtggttgcgttggnnggaaatctgggnttngggggnatnaaggattc

SEQ ID NO: 80487 - DNA, 563 bp, Triticum aestivum
  unsure (1)..(563): unsure at all n locations
  Clone ID: PAT_TA_80487
gcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatcgctncaaagtgggtgccttgcctcgaagtttaagcaagggttgggttcatcttcccgtgagcacaacgcatctcctgggtactacgaattggccgggtattgggccaaatgttgggaagcttgcctnatgttcggggtngcnctggacgccaacacaaaggtnattaanccaangtgggggggnagggtccaaaaaaggagtnnccctngaaccncgttttnttcccncaataatcngggttccnacaaaaatgcggtnaaagggnaanntgcggtcanccttn

SEQ ID NO: 80488 - DNA, 536 bp, Triticum aestivum
  unsure (1)..(536): unsure at all n locations
  Clone ID: PAT_TA_80488
gcaagcatccgcatccgcatcccacctcacatcccatctccccacacgctcgaaccaccagcagcagcagcacccatggcacccaaggcggcggagaagaagcccgcggagaagacgacggcggggaagaagcccaaggcggagaagcgggcgccggcgtccaaggaggccggcggcgaggggaagacgaggggcaggaagaagggcagcaaggccaagaagagcgtggagacgtacaagatctacatcttcaaggtgctgaancangtgcacccgggacgttgggcatctcctccaaaggtcatgtccatcatgaactccttcatcaacgacatcttccgaagaaagctcgccggggaagtccggncaaagctggcccgctncaacaaggaagcccaaccatcacgttcccgggagattcaagacctccggtccgccttcgttcctccccgggggagctncccaaagcancgcccttctnccggagggcnaccaaaggccgtnnaccaagtttaacctcccnccctaaggnaacc

SEQ ID NO: 80489 - DNA, 325 bp, Triticum aestivum
  unsure (1)..(325): unsure at all n locations
  Clone ID: PAT_TA_80489
gtgttcttcttcttgttgttgtctcaccgcagcaaggagcatccagcatcgagggagcaacaatggcgatggcgtcgtcnancgggctgaggagctgcagcgccgtgggcgtgccgaagcctgctggcgccttcgtccaggtccggccgctccgggctgcccgttctgcgcctacgccaccacctccggncgcgtcaccatgtccgccgaatggttncccgggcaagccccgccccgcccanctcgacgggtcctnccncaaggaaganttcggggtttccaaccccctggngnctcnccaccgtncccgganaaaattntaagt

SEQ ID NO: 80490 - DNA, 552 bp, Triticum aestivum
  unsure (1)..(552): unsure at all n locations
  Clone ID: PAT_TA_80490
gcgctggcgggccgatctgcgccgccaggactcgcccgacccgcgggacgctcgatccggtgacacaccagtcgccggtcgtcggcccggccaaccgacgacggagatcacatcaccctgcaccatcattctgcctcagctcatccttcctctgcgcacccgagctcctcgatgtgtgctgcctgggagggctcgcgctcgccgctcgaccaagagccacacggccatccggtcgtcgttgcactcgccgccccctctgctcctccaactcaacttcggactcacgtgatttctggtgcccaccccaagctaccaagaggaaaacgcacgccagtttcnctgggattncttttantttctggctgaaggattacgangtttggcacaagttttcaatganggtcaaaattaactgcaanatggtggtggcctcnttgtccantaagggaatagaatttanctgggtttgtaaggtttgtgggattgttcncaatttatttattgcanaacaaacntggtttgtggtgtttgtcccgangcccggttttanng

SEQ ID NO: 80491 - DNA, 464 bp, Triticum aestivum
  unsure (1)..(464): unsure at all n locations
  Clone ID: PAT_TA_80491
gcccagatcccccaagagctcgcactcccccaccccaccccagcctctcgtcccgatggcccgcacgaagcaganggcgaggaagtccaccggcggcaaggcgccgcggaagcagctggcgaccaaggcggcgcgcaagtccgcgccggccaccggcggcgtgaagaagccccaccgcttccgccccggcaccgtcgcgctccgcgagatccgcaagtaccagaagagcacggagctgctgatccgcaagctccccttccaagcgcctggtgngggagatcgctcaggacttcaagaccgacctccgcntccaagagctccgccgtctccngnnctgcatgaggcggcccnagggctacctcgtcggggtcttttaggannaaaaacctctgggnccaattcacggccaaaancngggtcaccnatcattgncccaaanggacatccaaccccnccctgcnggc

SEQ ID NO: 80492 - DNA, 681 bp, Triticum aestivum
  unsure (1)..(681): unsure at all n locations
  Clone ID: PAT_TA_80492
cgccggcgaccgtggacctcgccgccgttacgggagtgcagccgcgattccaatccaaatccaccatccacctgaccgcgtcatacggggaaccagaaaacccacaattcgaccccggccaggcggaggcgaggccaaaccgaccaaagccctgcctgctgccagtccgcgcgcgatccccaaaccccgatcgatcagccccgccgccgccgccgcggagcacgatgctcgatttgggacacggaatggatccgcaagatcttcgccgcctcctcccaggccccgccgctccctccccgccgacgccgcggtccctccgcccgcctgggttcctcctcgaacccgctggggtaacatcgccgaacaacgcaacnccaactccggcgggagggctcctccaacaagggggcanaacctttccggggtcaaccgtctggcgccggccgaaccggttggggctctcccangtntggcgtccaatggcccgggctcaacggccgncgaattctncgaacnggccaacggttgtttggtccngaaaaaggaactcctccgtccctcnccgnctgtnttcantcttgggggctaanncaaaggggggggctcaaaggaataattcccnaaaagggccgggccnggcggggngtcctncaaatgntcccaaaggcccttccggggtnt

SEQ ID NO: 80493 - DNA, 574 bp, Triticum aestivum
  unsure (1)..(574): unsure at all n locations
  Clone ID: PAT_TA_80493
gccataatacctcatttcgattgatttgttgatcaacatacgctccttgattctcacagctctcttcgctccttagaccctcaactcaaactagtttgccattttgccatttcttttgaccccgaaactacagcatcaaaaaaaatcggaatcgcttcttcaagatggtcaacttcttcactttctctttcgtcacaggtcttttgaccgtgggtgctgcggacatcatccaaccggncagcactctgagtggcactatagcgcccatgttagaacctcttcaatccgccgcaggcctatccttcgacaagctaagtgcgagcccgggcgttcgaccaaaagggctcgctttgacctccccancccggtatttgtcacagacactgcctgataangacccgaaanggtccaaganagggattnactcaagcannatttnctccgacaatntttgttcaaggcaaaacgaaaagtncnacgncatatcctgttttccgggctcncnaaagggaattcttcccccnanncttttttttattcnaaaggggtttncggtttnaacaaaangggccnt

SEQ ID NO: 80494 - DNA, 418 bp, Triticum aestivum
  unsure (1)..(418): unsure at all n locations
  Clone ID: PAT_TA_80494
gctagtaatagcgcgccgcggccccttccatttcccacacgcattcgatctcccctcctcgtggcggcgtcgtgcgcgcgggattccctcgtctcctagatctcggaggaggacgcgatgagggcgacgcggctcctcgcggcggcggcgctcctcgccgcgctgctcgcggtgtccgcggcggcggcgaagctcgatctggacgacgtggacgactcggaggtgctggaggcgctgctggtggtggacgacgaggaggaggcggcgccccntgngggcnggcgcgggcnagggggcggaggctctgaggccntngcggcggaacgcantccatgggtgctgggtgctccaattaactnggaaaatcggtcgccncgnccntgcggggnaanaacccangngggtngttggctncctc

SEQ ID NO: 80495 - DNA, 581 bp, Triticum aestivum
  unsure (1)..(581): unsure at all n locations
  Clone ID: PAT_TA_80495
cctcgccgcgtgattgaagatttggtcggccgtcgtctcgcgttctttggagaagtaagacaattattggccgtacattaaggaatgcatcttcttcatcttgtaggtttctgaaggtctactgggagagtaatgctagagagggacgctcacctatacagtggacaaagacaagcagatttacagcggacaaggacgtgcaactgtcatatttcaattggttggaaaatctgattgaaaaccaattagttttcaatcggatgtcagcggccatggtaatctgcaagacctcctcaacggtggtcgtccacacaggcgaagcacctatttaaggtcgtcggccactccctgggtccaagtaagggagtgggctcacctcctgagaccttcccgcgtttggcgggctacgaattgggctnatccgtcctactaacctaacggnctttgcccaagtttttttgatgatnggcaattcaacgtctggtgtttccccaaagtttgatgaaggccctaacnaanagttganggtcaatggcgntcctaatcccttctggccctccaaggattcctgtntnccccaa

SEQ ID NO: 80496 - DNA, 225 bp, Triticum aestivum
  unsure (1)..(225): unsure at all n locations
  Clone ID: PAT_TA_80496
ggttggcttctcctccccttccggttcgggttctggttcggttcgggtccgacagtanctaggcctagtcnanggtttccgtacctcggaagaggagagaaagggananatccatggcggagacggantacccgctgcttcgtgggcggcctcgcctgggncaccggacgaccacancctccagcanagcccttcagncagtacgggcgagatcgctcgaattcc

SEQ ID NO: 80497 - DNA, 553 bp, Triticum aestivum
  unsure (1)..(553): unsure at all n locations
  Clone ID: PAT_TA_80497
ttccctgcctccagcaaactcacacatctcaccaccggagctcccaaccccacccgaagcggcagccatggcccccaaggcagacaagaagcccgtcgccgagaacaaggtcgagaaggcggcggagaagacccccgcgggcaagaagcccaaggccgagaagcggctgccggcgggcaagacggcgtccaaggaggccggcggcgaggggaagacccggggcaggaagaagggcagcaaggccaagaagggcgtggagacgtacaagatctacatcttcaaggtgctgaagcaggtccaccccgacatcggcatctcctccaaggccatgtncatcatgaactccttcatcaacgacatcttcgagaagctcgccggngaatccgccaaagctcgcgaggtacaanaagaagcccaccatcacctcccgggagattcagaccctccgttcggcctcgttctnccccggngaagctnggcaaagcaacccgtnctccngngggggcaaccaaggggcngttaccaaaagtttaanatcctcctaagaacttgt

SEQ ID NO: 80498 - DNA, 594 bp, Triticum aestivum
  unsure (1)..(594): unsure at all n locations
  Clone ID: PAT_TA_80498
gctcactcctcacagcatcctcctctcggttcttagtttcttttccaccacccacaggccaaggaggatgtcttgctgcggcggcaagtgcgggtgcggcgccggctgccagtgcggcaacggctgcggcgggtgcaagatgttccccgacgttgaggccaccgccggcgccgccgccatggtcatgcccaccgcctcccacaaggggagctccggcgggttcgagacggccggggaagaaccgggggctgcgactgcaccancttgcaaagtgcggcaccgcntgcgggntgcttccctgcttgcaagctgcnaactgaagcccggccgcccaaaggaaggccgggcangagggccaagcaacnaaaggaatgaagggaaggaagggacaaangccaaagncaaaagcanccaatccgtcaacccaaagcggtattcantttttgnttnaacaancccgcctngcaattncaaacaatgccnccccncggcnncgccgccttaaattaaaaattaaaaaaccaaccggtcgcctcngtgttttccnccctttaaatttccgnttnttacccctttcccccccccnccccttnt

SEQ ID NO: 80499 - DNA, 572 bp, Triticum aestivum
  unsure (1)..(572): unsure at all n locations
  Clone ID: PAT_TA_80499
ggcagtccccctcacatccagccccacctccacacgcgctccaaccggcagcacccatggcacccaaggcggcggagaagaagccggtggccacggcagagaagaccaccgcggggaagaagcccaaggcggagaagcgggcgccggcgtccaaggaggccggcggcgaggggaagacgaggggcaggaagaagggcagcaaggccaagaagggcgtggagacgtacaagatctacatcttcaaggtgctcaagcaggtgcacccggacatcggcatctcctccaaggccatgtccatcatgaactccttcatcaacgacatcttcgagaagctcgccggcgagtccgccaagctcgcccgctacaacaagaagcccaccatcacgtccgggagattcaaacctccgtccgcctcgttctcccggngagctcccaagcacgccctctcttanggggaacaaagggcgtcnccaaagtttaacctcatncctaaactaatccggcctgttcgtnaaactgattggnggnattcttttttgttnttttaacaatnccaatgtttacaacccttg

SEQ ID NO: 80500 - DNA, 538 bp, Triticum aestivum
  unsure (1)..(538): unsure at all n locations
  Clone ID: PAT_TA_80500
ccactccatgccgtcccacatatcagcagctgcttctctactggcagtatggctcggtttagcgctgcttggagttggagcagcaccgcctaggcctagcagcagttgccagagagaatgcggcggcgtanacatcccttacccgttcggcatcgccgacgacggcagcgactgcgccatgcccggcttccacctgacctacaagcgagaccgggattaatggcgggcgcaggccatttgctggcaacctggaggtcgtccgcgtctcgcctgcaggaaggtcaggcccanatnaagaatgaccatctccacatactgntaaaaacgncacctctcaaaccatggangncnaccccntgggggggtnnaactttacggncaacgcgctncaaggatngcccgacaaccaaaaaagtttaaccgtcatccggntggcaanaccctngggttanatcnttgggcgaaccgcngccnaacaattanaacaaaccgggttgcnttggcaatttttnccggcngggggaaggngaacggcggg

SEQ ID NO: 80501 - DNA, 538 bp, Triticum aestivum
  unsure (1)..(538): unsure at all n locations
  Clone ID: PAT_TA_80501
ggtggatcttgattttgagcataatgtaagacctgccccagtaatcacggaggaagtcacagcttctctcgaagagatgataaagaaaagaattgcggagggtcattttgatgatgttgaaaagccttcaaccttgccgtataaagttccaaagcagcaaaaggagatggatgaaaacaagagcaaaaagggtcttgctgaacagtatgangatgagtttaaggaaaaaactgggcattgcacctgccacacttgctatttcagatnaactgaaagaatgaggcaaaatgatttattttaagaaggatatgcttgaagttgggatgcgctcccccatttccactttggcccaaaacccgtcaattgangganttgtccaatacaagntaataataactgnctccnancaaatgggaaaaaaggttgcaaccttttnnctttttcaaaattcccgcaatngccccccnccccnaaaaaaattttttnganggggaaaaggggganntttaaaagaanaacnntgggggnctttaaacaa

SEQ ID NO: 80502 - DNA, 432 bp, Triticum aestivum
  unsure (1)..(432): unsure at all n locations
  Clone ID: PAT_TA_80502
ggtcgcgccccgtgcccgctcctccaccatcgtcgccagcctcggcacccccgcgccctccaactcctcctccttccgccccaagctcatcaggaacaccccagtccaggccgcgcccgtcgcacccgcattgatggacgccnccgtggagcgcctcaagaccgggttcgagaagttcaagaccgaggtctacgacaagaagcccgatttcttccgatcccctcaagggcggccaaggcgcccaagtacatgggtgttcgccgttgcgccgactccccgtgtgttcccctcggtcancctggtggccttggagnccgggcgaaggcttcaacatccgcaacaatcnccaaaattgtccccgtcctaatgcaaanaaaaaagtacgcctgggggttgggatngggcaatcgaaataacgccggnctgngctcc

SEQ ID NO: 80503 - DNA, 507 bp, Triticum aestivum
  unsure (1)..(507): unsure at all n locations
  Clone ID: PAT_TA_80503
ggagcgctcccatccagcaccgccgccgcaaacaccacacctcgagcgtactcgtcgccggagaagtagcaagcaagatggccgtaaggaagggcggcgacaggaagaaggccgtgaccaggtccgtcaaggccgggctccagttccccgttggccgcatcggccgctacctcaagaagggccgctacgcccagcgcgtcggctccggcgcccccgtctacctcgccgccgtcctcgagtacctcgcggccgaggtccttggagcttgcccggcaacgcgggcaagggacaaacaaagaaagacccgcatcatcccgccgccaactgctgctcgcttttcgcaaacgaaccaaggaagctcnggaaaggctgctcccccggggttaccaatttgcccaangggggggttattccccaanaatcaaactcttttgccngctnccccaannaantcccccccccncgggcngaaaaaanaaggccaanttncccccaanaaaaaaaaac

SEQ ID NO: 80504 - DNA, 644 bp, Triticum aestivum
  unsure (1)..(644): unsure at all n locations
  Clone ID: PAT_TA_80504
gcctcgtgccgaattcggcacgaggcaaaaggggaattgcgcagccaggatgcactcgtcaccattggtcgcccaggtgagctcgtcgccatggcgtgcgcgtcctcgtcctcgaatgctgccacaacacttgagactgctgccctctttttctgggtaagtgacggcgggcgtggggtgctgcaagcagcgaagcccagtgttttcaggtaggcgacgactggctacaagtggggcggcaccgccaaccacctatgcgatttcgccggngaagattctgctaccccggcgtgggcgggactgcaaaccgttagttcggcggagctacaacccgtatgctggtggagtanncaaaccaacaatgacaaatgccanaaccggcngcaagccctgtttgtgatgggcaaccaacggngnccaataattgcctgggagncaacaaaaaaaaattggctgggaaacggttatttttttgctaccnaccgtactaaccatgnttcanatttttgctgggaaactttaatactttggctgggaaccttttccttttttttttttnaaacaaaaattcttcctggttatcaaaaaaaaaaaaaaaaaaaaaacccnngggggggcccggtacccaantcccctaaaattgg

SEQ ID NO: 80505 - DNA, 451 bp, Triticum aestivum
  unsure (1)..(451): unsure at all n locations
  Clone ID: PAT_TA_80505
gccacccagcaacatccccaacaccggcgccatggcccgcaccaaacagacggcgaggaagtccaccggcggnaaggcgccgaggaancagctggcgaccaatgccgcccgcaagtccgccccggccaccggcggcgtcaagaagccccaccgcttccgccccggcaccgtcgcgctccgcgagattcgcaagtaccaaaagagcaacgaagctgctcatccgcaaagctccccttccaagcgcctcgtcccggggaaattccccaaagaactttaaagaaccgaacctccggcttccaagtccctccgccgtctnccgcccttgcaangganggccgcccaanggctaacttggtggggggntgttccaaaggaaaacaaactnctngcgncatccaaggccaaaggcgcgtcancaatatngcccaaaagganattcaaactncccccg

SEQ ID NO: 80506 - DNA, 586 bp, Triticum aestivum
  unsure (1)..(586): unsure at all n locations
  Clone ID: PAT_TA_80506
nntctatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcaacacggaggccctcctcaagcaggtggactaccctgatccgctccaagtgggtgccttgccttgagttcancaaggtcggggttcatcttccgtgagcacaatgcgtctcccgggtactacgacggccgctactggacaatgtggaagctgcctatgttcgggtgcaaccgaanccacacagggttatcaacgangttggagggaagtcaanaaanggagtaccctgaacgcgttacgtccgcaacatccggatttcnaacaacatgcgccaagggtgcanttgngntagccttcaatggncttcaanccaacccgggctngcgaagganttcccgggaaagggctaaaanagctcn

SEQ ID NO: 80507 - DNA, 428 bp, Triticum aestivum
  unsure (1)..(428): unsure at all n locations
  Clone ID: PAT_TA_80507
gggtgaaaacacaaaggaaccaccctcctccttcaacatctaaaggcatacaaanaagaaccacttgggtaacgagtggaagaaacccttcgccgggtcatctcacgccaagggcattgttttggagaanatnggnaattgaggncaaacaacctaactctgccatccgtaagtttgctcgtgtgcaacttgtgaanaaaggnaanaaaattgctgccttccttcccaatgaaggggtgccctgaactttaatcnaaggaaaaatgaccaaggtgcttaattggcttggttncgtccttaaggggcaatgccgttggaaaaaattcccggtgttccgttnaaaagggcctnaaaggngtncgggggnttccctgccttgcccccttcaanaaaaaaaagggaaacccaagtctttaaatggcgntttc

SEQ ID NO: 80508 - DNA, 537 bp, Triticum aestivum
  unsure (1)..(537): unsure at all n locations
  Clone ID: PAT_TA_80508
gcctcgtgccgaattcggcacgaggctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcaacaaggtcgggttcatcttccgtgagcacaatgcgtctccccgggtactacgacgggcgctactgggacaatgtggaaagctgcctaagtttcggggtgcaacggncgccaaaaaaggttnatcaacgaaggtgggngggangtcaaanaaaggagtacccctgacgccgttacgttccgcatcaatcgggatttcgaaaaaaatgcnccaaagg

SEQ ID NO: 80509 - DNA, 470 bp, Triticum aestivum
  unsure (1)..(470): unsure at all n locations
  Clone ID: PAT_TA_80509
ggcagctcgaagaggatcgtcggcgaccatgtccgggcgcggcaagggaggcaatgggctcggcaagggcggcgccaagcgccacangaaggtgctgcgcgacaacatccaaggcatcancaagccggcgatncggangcttcgctcggngggggcggcgtgaaanccgcaactcnggggctcaactaccaggaaanccgncgggcggtgctnaaagatttttcctcgagaaaanncatccngcgaagcccgtnacctaaaaccgnagcaacgccccgccngcaaagaccgtcancccccaatgnggacgtnttctaacgcccctcaangcnccaaaggggccgcancccccctaacngggtttncggnggggtaaagggtcggtncttncgcccccccctncctggcaaaatttcccnaaanttttnttgataacccccaaatttttccaaatttnctgtntngccccc

SEQ ID NO: 80510 - DNA, 622 bp, Triticum aestivum
  unsure (1)..(622): unsure at all n locations
  Clone ID: PAT_TA_80510
gctcctccgataatacaataccatggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggcctcctaaagcaagtaaactacctgatccgctccaagtgggtggcctgcctcnaattcaacaaagntggnttcgtcttccgttggcaaaaaaactctccccgggtaactaagaacggtncgatactgggacaatgttggaagctgcctaatntttcggggtggcaaccnaacnccaacncaaggttggtcaaacgnaggtggganggangtcnaagaaaagnagttccctgaatgcctaatttcccgtntcaatcngntttcaaaaactngggccaaagtggaaattngtcaaacttnanccccccttnaagggcaacaaantttncaaagagtnccggnaaaggcnnaaactaaaaantttaaanaatgggccangtttgatgggcaa

SEQ ID NO: 80511 - DNA, 465 bp, Triticum aestivum
  unsure (1)..(465): unsure at all n locations
  Clone ID: PAT_TA_80511
gatcgctgatcaccagcacagccgcgcatccaccgttgctaagcaaggtcgaccaagcagcaccgagatggctgctgccttctcctccancgtcggtgccccggcttctacgccgaccaacttcctcgggaagaagctcaagaagcaggtgacctcggtcgtgaactaccatggcaaagagctccaangncaacaggttcacaagtcatgggancggaaaacatcgacgagaagaggaacacanaccagtggnaagggtncttgcctaacgaatatctnccgnacgaacaagcaagganattcaccaacnggggaaanggncatccttggactnccttctttcaaaggccgcccaaaggggcgaacgggaacccacgnaggccgttccttcaagctccctaagaagttcttcnagccaagggaactccaanaaattacgaactttcgaacaaacaccaangggga

SEQ ID NO: 80512 - DNA, 601 bp, Triticum aestivum
  unsure (1)..(601): unsure at all n locations
  Clone ID: PAT_TA_80512
gccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcaatccggcgagggctgcaacctgcggcgacaactgcaagtgcaacccctgcaactgttaagctgcaatgcactccgtacgttacgttgtgtttggtgttaagagtaataacgttgaataaacnagcgtcctgatntgaatggagtcccaaacaaagggttccnttttccctgttccgtttgggtttgctttgcncnctccccccaatgcnccggccaaagggggncccttgnggngnagtgtggtggnncaagtttcccccggtaattgcctcaaaccaanccccancnatgggttggngggggttgaaanttntaaaaaattgaaaaanttnccctaatttaaccaaaaaaaaaaaaaaaaaaaaccnc

SEQ ID NO: 80513 - DNA, 422 bp, Triticum aestivum
  unsure (1)..(422): unsure at all n locations
  Clone ID: PAT_TA_80513
ggcagggaggcgacggcactgtcgtgcgggcaggtggactccaagctcgcgccgtgcgtgtcgtacgtgacggggaaggcgccctcgatcaacaaggagtgctgctccggtgtgcaggggctgaacggcctggcccgcancagcccggaccgcaagatagcgtgcangtgcctcaagagcctcgccaccagcatcaattccatcaacatggacaangtctccggcgtgccccggcaaatncggngtcagcgtgcccttccccatcagcatgtcaacaantgcaacaangcaactagttaatatataaccccntccnacgtncatgcaaaggncgcncctgtgttgaaccctaaatgtccaccnttgannggggtggtccanaaccaatacngngcctccnnaaataataaaaattgaanttt

SEQ ID NO: 80514 - DNA, 178 bp, Triticum aestivum
  unsure (1)..(178): unsure at all n locations
  Clone ID: PAT_TA_80514
ggagggtaatggcgcagagttggatcccagcctgaagcagctgcaggacattctataatgctgaatcttgctgaggttaacgcatcttgtactgttacgttttgtcagtatgattaaattgcagagtgggacaaaaaaaaaaaaaaaaaaaaaccaaaacanaaaaaanaaaaaaaaa

SEQ ID NO: 80515 - DNA, 198 bp, Triticum aestivum
  unsure (1)..(198): unsure at all n locations
  Clone ID: PAT_TA_80515
ggtttgggggtganataatgagcagcancttggcntccgccatttctgcagnaaccantgntgcttgtccccgccatggctcggtcaagcagcatctgagcacaanggtgaagccacacctgaancatgctgcacgctgctgggaagagcattngnaccggcacggcngtggtgncaaaaggccgggcccgggccgct

SEQ ID NO: 80516 - DNA, 314 bp, Triticum aestivum
  unsure (1)..(314): unsure at all n locations
  Clone ID: PAT_TA_80516
gctccgctccccactccgcagcagttccgcaccgacnccctcgccctcaccctccccaaagccctaaccgctcgcccgctccgccgccatgangtccaangccaacggagacaccgcgttcaaggcctccgggcaagaacaanacngccaccggcggcgtcnccaagccgaancgcgcccccacccccttcttcgccttcctggctgagttcangccacaatanatgnnggaagcaccccgangcaaaagggccgtcncggncgtcaacaanggcggcnggggaaaaattggcncaacatgttcngatgaagga

SEQ ID NO: 80517 - DNA, 581 bp, Triticum aestivum
  unsure (1)..(581): unsure at all n locations
  Clone ID: PAT_TA_80517
acaataagagataagtgagagctttgctcaaaaaccttaaaaacaaccatgaagaacaccaagcttgtggcgatccttctcctccatgccatcctggtcatgggaatccttgcacacgtgaatgccaactacttccccaagtgttgtgacaaatgcaggtcgttctcgggggttgacatatgtgacgacgcccatcctcagtgccccaagggctgctccacatgccgcgcggtgcagacgggccgtgtcaagacgttccgatgtgccgacatgcgctccaccatcaacggcacgtgcggcccacgctgcaagaagaactgaccggttcaagcaagaattaggagatgtgtttcgccaaaaataaagctcagatgagacgagcattgtgaccgtttttgtgcgtagatgtggcccacattgcacgccgacaatgcatacactattgtcaagtccgccgtcgtttcatcatcaccactgttcctgggtttaagnttccccctcaagaagtagtcnaaatggttgcccaacttacaagggtgncccgttggtntccttcgtggaataancaacatttnttttat

SEQ ID NO: 80518 - DNA, 580 bp, Triticum aestivum
  unsure (1)..(580): unsure at all n locations
  Clone ID: PAT_TA_80518
gctccgataatacaaataccatggcccccgccgtgatggcttcgtcggctaccaccgtcgcacccttccaggggctcaagtccacagccggcctgcccgtcagccgccgctccagcggcagcctcggcagcgtcagcaacggcggaaggatcaggtgcatgcaggtgtggccaattgagggcatcaagaagttcgaagaccctgtcttacttgccacccctctccacggaagccctcctgaagcangtcgactacctgatccgctccaagtgggtgccctgcctcnnagttcancaaggttggcttcgtcttccgtgaagcaaaacagctcccccgggtactacgacggtcgatactgggacaatgtggaagctgcctaatgttcggggtgcancgaccccncaaaagttctcaaacaagtggaaggaaggtcaaaaaaggaantaccctgacncctnagttccgcgtcaatnccgggttncaanaaacctgggcccaaggnggaattggtcanacttcaatcgccctnaanggcnacccgggtttncgaagganttccgggnaaagggcctaaaactnn

SEQ ID NO: 80519 - DNA, 422 bp, Triticum aestivum
  unsure (1)..(422): unsure at all n locations
  Clone ID: PAT_TA_80519
gcccaacccccaagcaccagagcctcctcaacctcccggcgccggcgcatcgacggcatggcccgcaccaagcagacggcgaggaagtccaccggcggcaaggcgccgaggaagcagctggcgaccaaggccgcccgcaagtccgccccggccaccggcggcgtgaagaagccccaccgcttccgccccggcaccgtcgcgctccgggagatccgcaagtaccaaaagagcaccgagctgctcatccgcaagctgcccttccaagcgggctggtgagggaaatngcgcaagacttcaaagaccgaacttcgctttcaagtcctcccgcccgtctccgccttgcaaggagggcccccgagggcctaactncgntggggcctcttcgaagganaacaaaccttctggcggcaatccaangccaa

SEQ ID NO: 80520 - DNA, 583 bp, Triticum aestivum
  unsure (1)..(583): unsure at all n locations
  Clone ID: PAT_TA_80520
ggatccatccagccctcgccggtcgccaccacgaccgatcccgccatggcgacggcgccgccgcagctcctcctcctcgccctgctctcctgcctgagcctcgcctctgccgccccgtcgctccggccgctcccacgcgccgacgacgacggcctcctcgcgcggaccaccggcagctcctcgtcgccttcggagcggggcgtgggcgcgcggacgtgctggtacacggtgcagatcaagacgaagctgctcgtccccggcgcgcacgtcggagcgcgattnaaaccctgggcgttcgggtaacgtgtaaccgncgaacnangttgtacgcccggcgccgggctggggccggcgcccgccgggcggcgttcgaacccgggtgcgccaacggaacacgtttaaagattcggcgggggccctggcngggtanggggggtctggctaacctctaaccttccggccgcgccggggcggcaacngggtgggngcccccaagttgggtntagggggtttanaaaaancccacggcccccaaaagggggccccccnanctttccggcntangggggaacccgcttcccca

SEQ ID NO: 80521 - DNA, 535 bp, Triticum aestivum
  unsure (1)..(535): unsure at all n locations
  Clone ID: PAT_TA_80521
gccgcgacccatccccacccccgctcccacctgcgccgccggaccccgcccccaccacgcgccacccccaccacgcaccgcaggagccccgacacgccgcacgccgcccgagcctcgccccgctccgcgctgctggagccccctccccccaatcgccatgcgccgccgtgcccaagccatcccttgcccaanccacgcaccaccgggagccccgcccctctcctcaccttcttttgtggatatccgacatgggatccaagcgggctaccctggcctcttcctctccgacatccgctgacatccgcggggccaagtaccacaccaagcgagaagctcagccangatcctcctctggctccgtcgccgtgcctccgtngtcagatcgggngnttaatcaaccccgcggncaantaaaactatactngcctncctcccgcgcgntgnaagtgnaaaatcctggnaacgcnaacaattnaaaagancggnngggggctggggcccccccatccccttaattcccggnttccnggggaac

SEQ ID NO: 80522 - DNA, 586 bp, Triticum aestivum
  unsure (1)..(586): unsure at all n locations
  Clone ID: PAT_TA_80522
gcggccggctcctccgcgctccggcaccgcctcgacagcctagatctcccgtacccccaaggccccaaccactctccctcctccaccttgctcgcgtccggcagggaaatggcctcgccctcgccgctggtggatttcccccagcacctcctggaggagatcttcctccggctgcccgctgcggaggacctcgcccgcgcctccgccacctgcgtcaccttccgccgcctcgtcaccgaccgacacttcctccgccgcttccgccgcctccancccccgccattcctcgcctttttcgactcccacaggctccatcccgcccttccgccccaaccctccgcgcccgccgcaagggggctcgccctcggcgccgaantctctttctccttcgttccaatnaacccaantgccggccggggccgggcgtttggggccgtttnaggaaatccgggaacgggngggttcttcttccggcaaaacccccttngggggacttccgcnnttttgngaccccttaaaacggggggaanaaatccgggcttnccccaattaacttgaaaaanttnggcngcttttgggngggncn

SEQ ID NO: 80523 - DNA, 409 bp, Triticum aestivum
  unsure (1)..(409): unsure at all n locations
  Clone ID: PAT_TA_80523
gcaccttccgtcctccccccgtcgtcgcggctccagctagggtttctcgcccccgccctcccgccccaccgccggccccgtccgccatgtcgaancaaggaggaaaggccaagccgctcaagcatgccaatgtcgccgaagaaggactacgacganaatgacctggcatacctccaagaagaagaangatgagcaaaacgccctgaaggagctgaagggcaangcaaggcaaaagggttgcgctgggaagatttggtctcaaaaanaatgggaaaaaaatgagtctggccaaccattcgttatacccaaaaaaatgataatctaacnannctacctntctttttcgcgcttcaactaancctgggggttgtaaacaaaacnaaccttcaatttttgtttgaggcaattt

SEQ ID NO: 80524 - DNA, 518 bp, Triticum aestivum
  unsure (1)..(518): unsure at all n locations
  Clone ID: PAT_TA_80524
gccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcgggcaagcccaaggtggcggcgtccagcaagcccgtggtacggctccgaccgcgtgctctacctcggcccgctctccggcgaccccccgagctacctcaccggcgagttccccggcgactacggctgggacaccgcgggcctctccgccgaccccgaagaccttcgccaagaaccgggaagctggaggtgatccactgccgctgggccatgctcggcgcgctcggctgctcttcccggagctgctcccccgcaaacggcgtcaaattcggcgaaggcgtgttgttcaaaggccggctcccaaattttcaaccaaggggggcctccnatnactcnggaaacccaaccttggttncacnc

SEQ ID NO: 80525 - DNA, 214 bp, Triticum aestivum
  unsure (1)..(214): unsure at all n locations
  Clone ID: PAT_TA_80525
ggagagagagagagaactagtctcgagtttttttttagtttcacggacatccgacgtcggcagttaaacagtgccctgatcaacaaacaagcggtattgttggtcgtttgtatttatgagcgaattatgcatgcacttacacatgtatttttgtctgaaaaaaaaaaaaaaaaaaaaaaaaaaannaaaaaaaaaaaaaaaaaanaannaaaaa

SEQ ID NO: 80526 - DNA, 299 bp, Triticum aestivum
  unsure (1)..(299): unsure at all n locations
  Clone ID: PAT_TA_80526
gganacaactagtctcgagtttttttttttttttgcctatttcagtgtctcgaaaaaaggaanatcaancggagtccaaacggaatgaaaccttagagagcnatctgtttggaacaaaagtgatccaggggatttggagtggacgtcaagcaacagangangtggccacaagggtgcntgncncgctccctaaaggtgggcgccccccaccngcntccaccgacctactacttcctcctatatatacctatgtaccctaaaanattctnggagcaccaagaaaaactattttcaacgcc

SEQ ID NO: 80527 - DNA, 493 bp, Triticum aestivum
  unsure (1)..(493): unsure at all n locations
  Clone ID: PAT_TA_80527
gagcacacaagaatctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcaactgctaaatcattgatcatcgatnatgcatgcaccgcgcgtgcagcatcgatcatatcgatctactactaacataccatgttaccgctacctgatcgaagggccttatctattcaacttgacctgcatcaacaatcaaggtngcatgccatngctttgntggtaaanaaaggnccccctaaattaaaatcncccctgg

SEQ ID NO: 80528 - DNA, 581 bp, Triticum aestivum
  unsure (1)..(581): unsure at all n locations
  Clone ID: PAT_TA_80528
cctcgtgccgaattcggcacgaggaccttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttnatccgctccaagtgggtgccctgcctcgaagttcaacaaggttggcttcgttttccgtgaacacaacaactcccccgggtactaagaaggtcgatactggacaatgtggaanctgcctatttcgggtgcaacgacgccaaaaaagtgcncaaacaaggnggaggaagncaaaaaaggantacctnaagcctatttccgngtcaatcggnttccaaaaacctgcgccaagtggaattgggtaagcttcatccccttaaggcaaccgggtttgccaaggatctgggaagggctaaaatn

SEQ ID NO: 80529 - DNA, 424 bp, Triticum aestivum
  unsure (1)..(424): unsure at all n locations
  Clone ID: PAT_TA_80529
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcaacacggaggccctcctcaagcaagtcgactacctgatccgctccaagtgggtgccttgcctccaattcaacaangttggggttcancttccgtnaagcanaaagcanctcctgggtactaacnattggccggttanttggacaatgttgnaagctgcctaatttccnggtgcactgacgccaaaa

SEQ ID NO: 80530 - DNA, 526 bp, Triticum aestivum
  unsure (1)..(526): unsure at all n locations
  Clone ID: PAT_TA_80530
gcaattcacgtactccgccatggccccagccgtgatggcttcctccgccaccaccgtcgcgcccttccaggggctcaagtcgaccgccggcctccccgtcagccgccgctccggcagcgccggcctcagcagcgtcagcaacggcggaaggatcagatgcatgcaggtgtggccgattgagggcatcaagaagttcgagaccctgtcttacttgccacccctctccactgaggccctcctaaagcaggtcgactacctgatccgctccaagtgggtgccctgcctccaagttcaacaaggttggcttcgtcttccgttgaacacaacaactccccccgggctactaagaacngttcgatactggacaaatgtgggaaactgcctaatgttcggggtgcaaccgaacgcaaacgcaaggtngctcaaacgaaaggttggnggaaggccaaaaaaaggaantacccctgaacncctaatgtccggtttcaaccnggcttccaaaaaaaaatgcgccaangtggaaatg

SEQ ID NO: 80531 - DNA, 474 bp, Triticum aestivum
  unsure (1)..(474): unsure at all n locations
  Clone ID: PAT_TA_80531
gaatccaatccgcacagaaatccccatctcaaaaccctanccctcatccccgatcccggcgagngagatggncaacccgagggtgttcttcgacatgaccgtcggcggcgcgccggcggggcgcatcgtgatggagctgtacaaggacgcggtgccgcggacggtggacaacttccgcncgctctgcatcggcnagaagggcgtcggcaaagagcggcaagccgctgnactacaanggcacncgccttccaccgcntgatcccccgacttcatgtgccagngcgggcgacntcaccagnggcaacggcaccgggaggcgantccatctncggncganaanttcccccgactagaatttcntccanaancacaancaangcccggggatcttctccaatgggcaatcnccggncccaaanaccaatggntcccaagnttttcanccngcaacgcccccctggtanattggngccc

SEQ ID NO: 80532 - DNA, 515 bp, Triticum aestivum
  unsure (1)..(515): unsure at all n locations
  Clone ID: PAT_TA_80532
gcctcgtgccgaattcggcacgaggctcaacatccccgcgcatcgacgacatggcccgcaccaagcagacggcgaggaagtccaccggcggcaaggcgccgaggaagcagctggcgaccaaggccgcccgcaagtcggccccggccaccggcggcgtgaagaagccccaccgcttccgccccggcaccgtcgcgctccgtgagatccgcaagtaccagaagagcacggagctgctcatccgcaagctccccttccagcgcctcgtccgggagatcgcccaggacttcaagaccgacctccgcttccagtcctccgccgtctccgccctgcaggaggccgccgaggcctacctcgtgggcctcttcgaggacaacaacctctgcgccatccaagccaaagcgcgtcaacatcatgccaaaggacatccaactccgcccgncgcatcccgttgcgaaaaggcctaagctgctgctgcaatcaaaancaatgcgtcctggcaaaattcctgttaattg

SEQ ID NO: 80533 - DNA, 571 bp, Triticum aestivum
  unsure (1)..(571): unsure at all n locations
  Clone ID: PAT_TA_80533
gccgatccagcgcaaccgccgcaaacaccacacctcgagagtcctcgtcgccggagaagtagtagcaagcaagatggccggcaggaagggcggcgacaggaagaaggcggtgacccgctccgtcaaggccgggctccagttccccgtcggccgcatcgggcgctacctcaagaagggccgctacgcccaagcgcgtcggctccggcgcccccgtctacctcgccgccgtcctcgagtacctcgccgcaaaggtacgcccagatntctcctctccccgagcatctcttctgctctgttcctcttgtgttcgacagataaatgacttggttcttgcttgaaatctcaagtcctgggagctcgcccgcaacgccggcaaaggacaaaaagaaaaacccgaatcatnccgcgccaacttcntctcgccgttcggnaaagaacaagaagctcggaagggtgctcnccggggttaacaatcgccaangggggnttgttcccaaaataaactccgntgtggcncccaaanaattcccccccccccccccaaaaaagggggcaaantcncccaaaaaaa

SEQ ID NO: 80534 - DNA, 435 bp, Triticum aestivum
  unsure (1)..(435): unsure at all n locations
  Clone ID: PAT_TA_80534
gcctcaacccgccgccgcttctcctcctccggaagaaaaacagagagcttcaagttctccggagcgagagagatggcggcgaagggcgatgggccggcgatcggcatcgacctcggcacgacgtactcgtgcgtcggcgtgtggcaagcacgacagggtcgaaatcattgccaatgaccaaggcaaccgcaccacgccgtcgtacgtggccttcancgactccgagccgcctcatcggcgacgctgccaagaaccaagtggcgatgaaccccatcaacaacgtcttcgatgccaagcgtctcaatggccggagatttaacgattcaactgtccaaaagtgacattaagctgtgggccctcaaggntgttgctggnccttggtgaaaagcccatgaataatgtccaantcaaaggtgaaggaaaacaatttgcaac

SEQ ID NO: 80535 - DNA, 596 bp, Triticum aestivum
  unsure (1)..(596): unsure at all n locations
  Clone ID: PAT_TA_80535
ggtgcctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcaacacggaggccctcctcaagcaggtcgactacctgatccgctccaaatgggtgccttgcctcgagttcaacaaggttgggttcacctccgtgaagcacaacgcatcccctgggtactaagaanggccgggtacnggacaatgtgggaaactgcctntttttcgggttgaaccgacgccaaaaaaggtnatnaaccaaggttggaaaaaggccaagaaaggagtaaccctgaacncnttaagttcccgnatcaatccggnttcnaaaaanaagncccnaattggaaatggctncangtttcatcnncctttaaanccanccgggctcgcaaggantnccgggcaaaggcc

SEQ ID NO: 80536 - DNA, 250 bp, Triticum aestivum
  unsure (1)..(250): unsure at all n locations
  Clone ID: PAT_TA_80536
ggagagagagagaganagagaactanacaggnanagtggtggtaacctcctccancgcggaganctccangagantaacaagcggntgggacngngattcacaccaaggggccgccnacggnttncggtgtactccaaccgctggctacggtggcgcaagcgtcaatctaaancatctcgccancgggccggngcggcaagatttaatgagcgggatntacanacanactcttgtgacngtggtgctcca

SEQ ID NO: 80537 - DNA, 571 bp, Triticum aestivum
  unsure (1)..(571): unsure at all n locations
  Clone ID: PAT_TA_80537
gctcgagttcagcaaggttggcttcgtcttccgtgagcacaacagctcctccgggtactacgacggtcgatactggacaatgtggaagctgcctatgttcgggtgcaccgacgccacgcaggtgctcaacgaggtggaggaggtcaagaaggagtaccctgacgcctatgtccgcgtcatcggcttcgacaacctgcgccaggtgcagtgcgtcagcttcatcgcattcaggccaacgggttgcgaagagtctggcaaggccctaaactacganttaaaacaatgggctaagtatgaatgtcctttgtgaaacttcanttttgtccaaagactccgcttcccgaccaaaagcaaanttttccctccggnaatgatctgtgtttgntacaaacaanaagttgtggagcatgcaatatntttaattccnancaaccggntanaanaaanaacnaacaaccaaatgtggtttttaattatttacaaaaaagccggcccattttncctggcgttttaaaaaaaaaaaaaaaaaaaaaaaatncngagggggggncccggtaccnaantnccccct

SEQ ID NO: 80538 - DNA, 522 bp, Triticum aestivum
  unsure (1)..(522): unsure at all n locations
  Clone ID: PAT_TA_80538
gctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcancacggaggccctcctcaagcaggtcgactacctgattcgctccaagtgggtgcctttgcctcganttcaacaaggttgggtttatctttccgtgaggcacaancgcaatcccctgggtactacnaatgggncgggtaactgggacaatgtggaaagctgcctatgtttggggttgcacccgacgcccaacncanggttatcaaccgaaggngggagggannggtcaaagnanaggggtacccctngangcccgttnangtcccgcacccattnnggattcc

SEQ ID NO: 80539 - DNA, 578 bp, Triticum aestivum
  unsure (1)..(578): unsure at all n locations
  Clone ID: PAT_TA_80539
gggcatcctcctctcctccgataatacaaataccatggcccccgccgtgatggcttcgtcggctaccaccgtcgcacccttccaggggctcaagtccacagccggcctgcccgtcagccgccgctccaancggcagcctcngcagcgtcagcaacggnngaaggatcaaggtgcatncaggtgtggccaattgagggcatcaannaagttcgagaccctgtctttanttgccacccctctncacggnanggccctccttgaagcanngnccactaccctgaatccgctccaaatggggtggccctggcctccnaagttcaagcaaanggttgggttcnctccttccggtgaagcaaaaacnagcctcccccgggggtactaactaacgggtcgatactggnacaaatgtgggaaagctgcctatgttcgggggntgcnacccgacgcccaacanaagggtgcctccaaacgaaggngggggggagggncaaanaaaaggagtaacccctggacacgcctaatgttccgcggtcaatcgggctttncgaaaanctnggcnccanggtngtanattgggt

SEQ ID NO: 80540 - DNA, 508 bp, Triticum aestivum
  unsure (1)..(508): unsure at all n locations
  Clone ID: PAT_TA_80540
gtatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcaacaaggttgggttcatcttcccgtgaagcacaacgcatcccctgggtactacgatggccggtactggacaatgtggaaagctgcctatnttcggatncaccgacgccaacgcangtgattaacnaggtgggagggaaggtcaagaaaggagtaccctggacgcctatgttccgcaatcatcgganttcgacaacnanggcgtcaaggtgca

SEQ ID NO: 80541 - DNA, 560 bp, Triticum aestivum
  unsure (1)..(560): unsure at all n locations
  Clone ID: PAT_TA_80541
gcaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaaagttgccatttcagttttgtcaactctgacaatttgctttgggttttccttccccaaattaatcctttcntaattgttcccaaangaatatgtgtatgtccaatgttcaatgttacaacaatggnctcccaagaaagcaaggctcngtaaggtnaaatgctatncggtgggctnatgtttaatgcancgggccgccatnaaananttaaacaattatgttccagctnaaaaaaaaaaaaaaaaaaaaag

SEQ ID NO: 80542 - DNA, 524 bp, Triticum aestivum
  unsure (1)..(524): unsure at all n locations
  Clone ID: PAT_TA_80542
gctcccccgcccgccgccgccgccgccgccgccgcagagccgcagggagagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggcgagcacgtcgacgtcaaggtgaacggcgccgtccacaagggcatgccgcacaagttctaccacggccgcaccggccgcgtctgcaacgtcaccaagcgcgccatcggcgtcgagatcaacaagcaggtcggcaacaggatcatcaagaagaggatcatgtccgtgtggagcacgtgcagccatccaaggtcaacgaggagttcctccagaggaaactcaacaacgacaagcctgaaaggcggagggccaaggcgcgcggcgaggtcntcancaccaaagangggaagccaagcaagggcccaaggcggggggttcaaggnttgaggggaacaacatc

SEQ ID NO: 80543 - DNA, 544 bp, Triticum aestivum
  unsure (1)..(544): unsure at all n locations
  Clone ID: PAT_TA_80543
gtcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttggggttcatcttccgtgagcacaacgcatcccctgggtactacgatgggccggtactgggacaatgtggaaagctgcctatgttcgggatgcaaccgaacgcccaacgncaaggtgattaaacnnaggtgggagggaggtcaaagaaanggagttacccctggaccccctaatggtccggcatcaattcgganttcgacaaacaatgccntcaagggngcaattgcgt

SEQ ID NO: 80544 - DNA, 567 bp, Triticum aestivum
  unsure (1)..(567): unsure at all n locations
  Clone ID: PAT_TA_80544
ggcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcaagctgattgacataactgatngatgggntatgttancctttcnactngaggagtggcaacaacgaagggatnaacctggaaagcctcccaactggattgatggttcctggccttgggccaaaaattnaaanaactgggattttcctgantggnnaaagggacctggattcctngtccnggngnatggtcccgcccantgggggtgaangaaanaaantt

SEQ ID NO: 80545 - DNA, 534 bp, Triticum aestivum
  unsure (1)..(534): unsure at all n locations
  Clone ID: PAT_TA_80545
gcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcaagcacggaggccctcctcaagcaggtcgactacctgatccgctccaagtgggtgccttgcctcgagttcagcaaggttgggttcatcttccggtgagcacaacgcatcccctgggtactatnatgggccggtactggacaatgtggaaagctgcctatgttcgggtgcaaccgacgccacacaagtgatnaacgaggtggnggaggtcaaanaaggatancctngacgcgtattccgcaacatcggattccaaaaanatgcnncaaggtgaantgcggtancttcaacgcctt

SEQ ID NO: 80546 - DNA, 566 bp, Triticum aestivum
  unsure (1)..(566): unsure at all n locations
  Clone ID: PAT_TA_80546
ggcacagctcagctcccacccactcccaaaccctctcgccggagccccagcaaggaagatggacggcagcaaggcgaagaaggtggcggcgaagaagttcggcgggccgaggaagaagtcggtgaccaggtccatcaaggccgggctccagttccccgtcggccgcatcgggcgctacctcaagaagggcccgctacgcccagcgcgtcggctccggcgcccccgtctacctcgccgccgtcctcgagtacctcgcanccgaggtgctggagctggccggcaacgccgccaaggacaacnagaaaaaccgggtccgtgcgaggcancctcctgctcgccatccggaannaancaaggaagcttcngganggctgttgaanccggngttaacaatcngcccaangggggggggttgattccccaaacatcaaacccgggtggcttgctcccccaagaaanaaccgccnaanaaaggccgaaaaaaagggccgggngcccgccccccaagntccccaaanaaanaacnaacaaagttcccccaaagaaaggccancaangggcctann

SEQ ID NO: 80547 - DNA, 243 bp, Triticum aestivum
  unsure (1)..(243): unsure at all n locations
  Clone ID: PAT_TA_80547
gcccgatcccagccccagtcccaatggcgtccaccgccgcgccgcccgccgccatcgtcgcccgccgcgccgcgtctgcgtccgtggccgccgcgccgctccggcgcgcggncgggtgccagccggngcgctcgctggcgttcgcggccggagccgacccgcgcctcgcggtccacntcncgtcgcgctgccgtgccgcntccgccgcncgcgggncncgcnccgtnnccaccatggncaaga

SEQ ID NO: 80548 - DNA, 533 bp, Triticum aestivum
  unsure (1)..(533): unsure at all n locations
  Clone ID: PAT_TA_80548
gcttcaacgtgcccatggaatttctgccggtgccaacccatggtgggccagattgcagcaagtggccgcgctgcgtagctgacatcacatcacagtgtccaagcaacctcaaggtgccggggggttgcaacaacgcgtgcaccaggaacagatcaaacagttgcaaacccaccacatatttgaggttctttaagcagctatgtcctgatgcatacagctaccccaaggactattcctcaagcactttcacttgccctacaggcaccaattaccaaggtcgtcttctgtcccccgatcaatccatcgtctttgcctccaagcccttctgcatctattcctactaggaagacaagcataggatccccatctgacattggaatctcattccgagctggtctaactgttatgaagtaaatttcntcttgcacggacaatacttgggtgcatattccatttaatccaagcatacatccattttggttctacgttaaccnacgacnccaagttgcccggngggaaaganaaanaagatt

SEQ ID NO: 80549 - DNA, 560 bp, Triticum aestivum
  unsure (1)..(560): unsure at all n locations
  Clone ID: PAT_TA_80549
gagcttttttccccttcctccgccgccgcgactagagtttcctcgctagggtttcgtctcccggtccggatccagcagcagcagcgggcgatggcggccgcgggagacgccggcgagaagaagatgatcacactcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcnaagtactgcaacaagcacgtccaaggccaaccccgccgatggggctgcccgccggagccggaagccggagcctcgggangccgcccccgccgccccccgccgagggacctcaagaactggggaacgccgagtttcgtcaaaggtccaacaaagncaancctccttcgaanntcaatccctggcttggccnaactacctngaaaaatcaangggggcntgntgggacctngaaccctgccannaactgggttgctggacattgattcaaaggggcaaanan

SEQ ID NO: 80550 - DNA, 533 bp, Triticum aestivum
  unsure (1)..(533): unsure at all n locations
  Clone ID: PAT_TA_80550
gaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcaagataccgtcctaagtctcaaccataaacgatgccgaccagggatcggcggatgttgcttataggactccgccggcaccttatgagaaatcaaagtctttgggttccggggggagtatgggcgcaaggctgaaacttaaaggaattgacgggaagggcaccaccaagcgtgcagcccaaaaagagcccccggcgggnaacctcccccccggggaactccaancaactgaactccngtaaaggtgatancctgtttgggccctggcaagccgtngacaaaggaaagggaaacttnttcctnt

SEQ ID NO: 80551 - DNA, 478 bp, Triticum aestivum
  unsure (1)..(478): unsure at all n locations
  Clone ID: PAT_TA_80551
gccacacgacccccactctctcctcacggacgcccgacaacaacctcctccgccatgcgccgtcttctccggccgccgccggcgatttgtcaccaccggacggagagaccgtctgagccgcgaccggcctcgggcgcctccatgtccgctcctttgcagctccgcggatcagcatcgcgcgccatccccgatggccctggagccgccgcaatgctggtcaacgcgccggctggaggtgcgctcctgaaggaggccgagcgctgcggcgacgcctgctctcctgctctgccgcggcgggcgtcgaggccgcctcccctcggtcgaggtcttcgcgcgaaccgtcaggcctcccgtcgcgctccgggtcaacctcctttctgcaagctncctccgccgaccgggctcganggtggccgccgcggggaaaaagagccgagcgccggcctgctcgccccgttgctggacctttaacggacat

SEQ ID NO: 80552 - DNA, 334 bp, Triticum aestivum
  unsure (1)..(334): unsure at all n locations
  Clone ID: PAT_TA_80552
gaccagatccaaagccctagcgctcgccgccgcccgcgccgacgcggtcgcgccgtcgcngctcgccgccgcctgggggacccgcgcgctctccaccctcccccgcgatcnggccgccgcatcccccgnctcgtcnccgcggcaaccggcggcggtctcgccgctcggcctctccaagattntaggatatgagcaagcatctcgactcggtggcacacactttantgcctcgctggttttctacnggnngcctccaatggatnttctgatcagcanacctcananacaattgntgggntnggacaatcggatgcaatgaaaatnanangaggga

SEQ ID NO: 80553 - DNA, 549 bp, Triticum aestivum
  unsure (1)..(549): unsure at all n locations
  Clone ID: PAT_TA_80553
gctgaatctccatctccatctccatctccaaaccacagcaacccacctccctccccgccgaccccgcagcagctccgatggcccgcaccaagcagactgcccgcaagtccaccggcggcaaggcgccgcggaagcagctcgccaccaaggcggcgcgcaagtcggccccggccaccggcggcgtcaagaagccccaccgtttccgccccggcaccgtcgcgctccgtgagatccgcaagtaccaagaagagcacggagctgctcatccgcaagctccccttccagcgcctcgtccgggagatcgcccaggacttcaagaccgacctccgcttccagtcctccgccgtctccgcgctccaaggaggccgccgaggcgtacctcgtcgggctcttcgaggacaccaacctgttcgccatccaacgccaaagcgcgtcaaccattcatgcccaaaggacaatcagctcgcccgccggcatccggcgggggaagcgcgcctnangntcctgttttgngccctctgtnancntgggcctngaatccttnctnan

SEQ ID NO: 80554 - DNA, 575 bp, Triticum aestivum
  unsure (1)..(575): unsure at all n locations
  Clone ID: PAT_TA_80554
ccacgcgtccggccccggcctcagagggtatgtaaatgcggtcgtcgtcgtcttccaaatcacagctcgggacagcgaggaggagcaggagcagcgggggcggcctgccatgtcgtcttcgtccatggcgcggcacggcccgtcgagggccggcgaggcgtggtgagtccagtgtctcctctccgatttccggtcggtgctacggttctgcaccagcgggctgcccagcgacgtcgtcttcgaggtgcaggacatgagcttccacctccacaagttcccgctcatgtccaagagccgcaagatcagccgcatgcttgccgagcaggacgagcagcgtccgccgggccagccgcggcgtcggcggcgtgggagctccggaggcaatgccgaggagcatgctgctcctgctgcggcggcggaaacagagattgaggaagcagaggaggaggacggggacgaggaacagcagcaggttagtatggaggacggcaagtcgtaccgcatcactttcccggacttccccggtgggccgggcaccttcgagncnncggccaagttctgctatggcgtccgct

SEQ ID NO: 80555 - DNA, 255 bp, Triticum aestivum
  unsure (1)..(255): unsure at all n locations
  Clone ID: PAT_TA_80555
ccacgcgtccgccaagggcgtcgcgcccaaggccagggttgccgcgtacaaggtgtgctggaagggcgccggctgcctcgactccgacatcctggctggcttcgaccgcgccgtcgcggacggcgtggacgtcatctccgtctccataggcggcggcaacggcgcggtgtcgccgttctatatnnnnnnaattgccatcggctcgtannntgccgtttnnnnnggagtgttcgtgnnnnnctctgcnngaancnn

SEQ ID NO: 80556 - DNA, 583 bp, Triticum aestivum
  unsure (1)..(583): unsure at all n locations
  Clone ID: PAT_TA_80556
ccacgcgtccgcaagcggaaatattgaacggaagttaagatgattgggctttcacatctgcagtcacgctttgttggtctaagaggtcgcacaattcatgtggagtgttactcgaagccaccggctaccgtcttggactccagcttgctctcttctacttgtacaaattctgctcaagaccccgagaaggccctgatagaagtgggaccgtctcttctgagctttgaagtcccgagtaattgacccgtttcccaagcagagtctcacgaaattcgtcgaatacaaagggctccgagaggaagcttgcctcgaaggcatttggcgcacttgcgtggtacttgtggggtgtcagaaataaagctttatttgagggtattagattcaaacagccggctgatgtcttctacaaaatgattgcccttcagcttggagacagttggtgaggcatggggaggaattactgttgcttgaccacttattggacaccatgcgagctnnnnntgtcagcacaactccacctnnnctgttcttcatggtgcttctgttttgagctcatctctaccacgctgcgtcgtgtgtacnn

SEQ ID NO: 80557 - DNA, 193 bp, Triticum aestivum
  unsure (1)..(193): unsure at all n locations
  Clone ID: PAT_TA_80557
ccacgcgtccgcaacacttgnnnggccttctgaatgccacgtttgggaatgcaactgagatgataatagcaatatatgctttgaaaaatgggatgatccgagtagttcagcaatcgctattgggttctatattatcaaatatgctattggtggttggttgtgctttctttgctgnnngtattattcatcgnna

SEQ ID NO: 80558 - DNA, 402 bp, Triticum aestivum
  unsure (1)..(402): unsure at all n locations
  Clone ID: PAT_TA_80558
ccacgcgtccgctctccggcagccgcctccctccctcccgcgcgcctcctctcctcccacccacatcgccgccgccgccaccccctcctcgaaccgcgatgagcagcagcggagggaggacgaggagcacgactgcggcggcagcggggaggagcagcagcagggcaaggcggcgcaacagcaaccccgactaactgccgccccggaatttcatgtccgccgcgcgtgctgagtgccgacgcccccccgccgaacccttcccgaaaccaagcacccgccgcgccggaaaagcggctcccctaccctcatccggcggcgngnnntgcagtgcgccgtctgnnnntctccggccgccggctgcgggggnnnnnnnnnnnngnggggnnnnnnnnnnnnnnnnnn

SEQ ID NO: 80559 - DNA, 564 bp, Triticum aestivum
  unsure (1)..(564): unsure at all n locations
  Clone ID: PAT_TA_80559
ccacgcgtccgnnnatttccacaggtccataagttattaggagccgatccagagaaagtcaatgtaagcataaacctggtagcactcaaaatactcaagttactgccggttgattattttgagtcacaactttcaagcatcatacatcgaatctgcaattttctcaagaatcgtcttgaaagcgtacgtgatgaagcaaggtcagctttagctgcatcgcttaaggaacttgggattggttacctgcagtttgtggtcaagatattgagggcgatactgaaaaggggttacgagctacatgttctgggctacacccttcattttttattatcaaaaactgtgactgctgagatgaatggtagtcttgactattgcttacaagatttgttgtctgtagttgagagtgatatacttggagatattgcggaacaaaaggaagttgaaaagattgcctccaaaatgaaggagacaaagaagagaatgtcatttgagactcttaagttgattgctcagagtattacattcaggacacattcttcgaaattaatcttgccaatttctgnn

SEQ ID NO: 80560 - DNA, 361 bp, Triticum aestivum
  Clone ID: PAT_TA_80560
ccacgcgtccgcgctctatctgtcgaatgttgcgaccatcactgtcatccatggcaccatgcatgcccacgttttcacacggcaccatgcatgcgtgcatatccagaattccagaatgcctgcctcctcactgtactttgctgccattctattgtgtgtcattttattttcgaaaagaggaaaagaccctctgcctctgaatgcacctatccatgtatattattaacgaaatttgtattttccaaacgttcggattttgtgtttagatccgaacgaactggatcgaacgtacatgcatcgctgggcacggaaaaataatatgcaattgttgggagtcggacccaggttgaaaaaaaaaaaa

SEQ ID NO: 80561 - DNA, 257 bp, Triticum aestivum
  Clone ID: PAT_TA_80561
ccacgcgtccggttcatagtcagacatgccgtgtgtggccgtggttacctgctcatcaacaagatgttgttgtccttgtggtagaagatgttgttgacctgcagttgtatcctctctgcatattatctgagaatcaacaatacctgcaaaagcttgacttccctagccgtcggtcgcattgaattgaattctttaccgtggcgggacgggaggaacgtaaatgaaagaaatgttggcactgatttaaaaaaaaaaaa

SEQ ID NO: 80562 - DNA, 595 bp, Triticum aestivum
  unsure (1)..(595): unsure at all n locations
  Clone ID: PAT_TA_80562
ccacgcgtccggggagacagagcactcacaccctcgctcgtcacccaggcgccgcaccgccgccgccacgccatgggcctcctccgatctgcagtcgccggttcgtttgaaggaggatctggccgttgactgctggtgcttcccctccccggggtgtaagagctggctactgctcgtgtgatctctggagatgagaggatgagaacttgagaggaacaagcttggtgctatgattgcaaaaaaaaaatactacaggtgagagttgagacacaccatacacaagccctgcaagcgggcagaaatagacctcttcgttgacgacttctacaaggatgatattgacctagaggctggagctttgctactctttccggccaacaagatgtgaagagaagaacaagggatcgaacatatgtgaaaatgatgaagtgattctgtgaggaacttaccaggttttctccatgttcaggtgcaaaggggcctcaagtgcaacgttcaggaagcaaacagannnactgcactcacaatggaccatgaagctagtgatccacgtcaactggatattttagnnnncannnngtacaactnngtctnn

SEQ ID NO: 80563 - DNA, 586 bp, Triticum aestivum
  unsure (1)..(586): unsure at all n locations
  Clone ID: PAT_TA_80563
ccacgcgtccgcgactcctcgngcagggccgcccgctaggattcctgcgccgccgcccgccccagttcgccgtcccggaccacccagccgccggtgcggccctcgccgccgccggccaggtactcgccgccgccggtccccactcccgccgcagtccagcttcctctgcgggccctttgcccctttgccctctgccgccaccgggacacccggaagccgccgtcgggcccctctgcaccggctaccgacggcgcctccgtcccaaagctgcagccgaacatcaacatctcctccactcctccacgccatgaagaagaacaaacaggggaactgacatatcaggccaattctgcaccgatggagacggtgcatacaaaggaggctatgggaaccacttgtcctgaggataacggccaaggtaaagatggatcaaccacggatgaacagtacgatccacggatacctccttcacctccaagcgatctcaaatcactcaaggaggtgcatggccgaacaaaacaagtgccatacctgctaattccagagcaacatccacaatcatcccagacngtactccccagtgggt

SEQ ID NO: 80564 - DNA, 262 bp, Triticum aestivum
  Clone ID: PAT_TA_80564
ccacgcgtccggtcggaggtgaaaggcatcatctcctacctgctggagaagcgggaggaggacgagtacaggaagatctcgcggaggctcatgttcatggcttcccagggcttcaacacccaagttccgtcgttcgatccttgacatacgctagttgccacatggaatgagaatgtcgctactgaatattcatttttcgaccttcgatcagacatttatgcagaataatgcttgtaatttgtgaaggttgaaaaaaaaaaaa

SEQ ID NO: 80565 - DNA, 593 bp, Triticum aestivum
  unsure (1)..(593): unsure at all n locations
  Clone ID: PAT_TA_80565
ccacgcgtccgcgacaagtatattctgaccatgttgtccggccacgcctacacgtcggaggtcttggagaagattggcctccttcagcggcttgtgaccccaggcccccaacactgatgaggcttcatggcgggtaagttacagcaaacagtgcatccgcttcgactggttaattttctgcgtgccaaagagggcctcgacaagacaacaagtaccccatgaccaagttgtccggcagtaggtatgaatcaggtgcaaattccccattcatgcctcatgttttatatggagcaaagaaatgttttctgcctctttattttctgtataaaaaaatccctgttgttaggctgctggcctttgttaatacttgcttacttctgaatcctgatatctgaattcgaggtgatggttttccatattacattgcttcaaaaactatgttaatccatgacgtcagctgttaatcttccctttgtcatgttctcttttaacttttaagcgttttttttgattaatccagttccaactgttaatctattcccatgggaacatagcaacacaacaannnngnantcaacaaaaactcaaatgtg

SEQ ID NO: 80566 - DNA, 579 bp, Triticum aestivum
  unsure (1)..(579): unsure at all n locations
  Clone ID: PAT_TA_80566
ccacgcgtccgtattaagtgtttacgtgaagtgttctcgggtgtgtgttatgttgttggcatacctaccatacttatgcacgcctatgaattagataagaaattgttcagtgaatgattgaaggtatatttctctgtagttaagtgtaaaatatggttattgttctttgcccagaccatgaagtttaaatagttgtatatttgggacctgtatgaagtggcttgagcaacctcacattctcaaactcgtcatatttttcatcaagatttaattgggttctcacgtgtaattaaactcacactacctatgctagcattttcttagccctggattctaagggcttaagtagaatataaactccttacttaaggtgtctcaaatgtttgcaggacaataaaatcttaccatgtaattaaggtactcttatctaatagcttaccatgcaatcttaatctaataacttatatacggtagtgccatagtgctctactgccctctttaatctctgtatcacttggttcttctatatgcattttgtctttcctgttgagataaattttctgtgctagtatatactnn

SEQ ID NO: 80567 - DNA, 555 bp, Triticum aestivum
  Clone ID: PAT_TA_80567
ccacgcgtccgcattcactgttgcgggtcaccactgatgatatactgaaagtcacaaagaatttcagcaaagaacacatcataggcgatggtggctttggcactgtctataaggcggcactccctgaaggtcggagagtcgcgatcaagaggcttcatgatggccatcagttccagggtgaccgtgaattcctagctgagatggagaccattggaaaggtgaagcatccaaaccttgttcccctgcttggttactgtgtttgtggcgacgaacggttcctgatctacgagtacatggagaatgggagccttgagacatggctgaggaaccgagcagatgcggttgaagcacttggatggccagaccgtctcaagatctgcctcgggtctgcccatgggcttgctttccttcatgaagggtttgtgcctcatatcatccaccgggacatgaaatcaagcaacatcttgctggatgtaaactttgagccgagggtctctgactttggcctcgcacggataatcagcgcgtgcgagactcatgtcagcaccgacatcc

SEQ ID NO: 80568 - DNA, 580 bp, Triticum aestivum
  unsure (1)..(580): unsure at all n locations
  Clone ID: PAT_TA_80568
ccacgcgtccggattatgtttccccccttttaatatagatttccctatttacatttattgcgaaattgcagctagatgtttccgcgccacaacaggtcccctctaacatattctttacgtccattttacggaagatgtaagtgtacagaaagattaacatgggttactcttctttcaagggagtagctacatagcttatgtaaattcttaattgtcatttcctattcatgtactggctgagtttttatttagaaggtactttgtagtttcgatgcattgtcgtggatttgcattttctgattaaaaattgcccttttatttttttcctctaaaaggatgattgcctttttgtgaagacctttgtgttgatattttagtttatgataacatgtcacatcattagagaaatttcatcactttttgctggtataattcttcaatatcatttatacttctataaaaatcataaggtggtctagacgatgatcatcaggatgcttgtgtgccatagttgtcttcttagcccggtgccttaactattgtcttgctttttatctgcagccattgcaattctcaatnn

SEQ ID NO: 80569 - DNA, 589 bp, Triticum aestivum
  unsure (1)..(589): unsure at all n locations
  Clone ID: PAT_TA_80569
ccacgcgtccgggcaggggcagcgtgtcggtgtgtgaatcctaccttcccatgggcaagttaacgcggaaggtactgagagccaacaggatggagaataaggtgaagctcttccacaagcggtcagatgagctcgaagttggagtcgagcttgattcgccagctgatgtactggtgagtgaaattcttgactctgagctgttgggtgagggtctgatacctactctacagcaagctcatgattcgttattggtgaaaaatccaaagacagtcccatatcgagcaactacatacgggcagttagtcgaaagtccgttcttgtggaagatgcatgatttgcacagcaatgaagcaaatgctgcagatggtgtctggcttactcctgatgggatggaaaatattgtttctgtgaagctgcagcaacatgcaatgcaatgtgacccattagaggatgagatacgattgctgtcagaacccttcaaagtttttgaatttgacttttcggaacgaccagagagccagcgtgagaacaagatcacgattaaaacaactggtgatggctgtgttcatgctattatttcatggtgggn

SEQ ID NO: 80570 - DNA, 597 bp, Triticum aestivum
  unsure (1)..(597): unsure at all n locations
  Clone ID: PAT_TA_80570
ccacgcgtccggaacaattagcactgaatgatctcaannnaagacgacctgttcagtctggcatctcagttgagcggagaaaagagctccattgagatgccagactgaacaattagcactgaatgatctcaaaaagaagacgacctgttccggaaaaggcttgctgagtcggcctaaccttggattatattgatgagaaacagagtttttatttccaagcacccgtttaccattacccgagtttgtccagttttgaagatctcccaaatgccgttgactccaaaacctttgtcgtagtaattgcagaatgcagctccagctgaaggagtcaaaagcttcttggaaatccatcttcagcatgaccaaaggcattttacgcttctgagcacatcgcacgagcttcgaagctaaagcaaagtttttcactgtagcacatcatcctctgataacgcctgattgcgtgaaatgaacgcgttgatatgagatgctgcaacctactagccagaacctctgtgagaagcttgatgaggctatggaccaacgcaatcgggcggtaatgcgtgatttccagcggagtctcaacctnnnngagtnnnn

SEQ ID NO: 80571 - DNA, 270 bp, Triticum aestivum
  unsure (1)..(270): unsure at all n locations
  Clone ID: PAT_TA_80571
ccacgcgtccggtaaaagcaactttgtaagagcaacttggtcgaagcaagagcgaaaaagtcttcatctgaataaaagaaaacaggttattgttgagttatctgcatttcagtggattgcactaaaacctcgtcagaagatgaaagggtacaagctatatgcaggtaagtgatactatttgcctgcgagtcttggttgagtcgattggcacggcaggtgaagcggcagccacagccatggcgtcaagccgtacgtagagcaccatcgcnn

SEQ ID NO: 80572 - DNA, 579 bp, Triticum aestivum
  unsure (1)..(579): unsure at all n locations
  Clone ID: PAT_TA_80572
ccacgcgtccggnnaggatctgggtcgggatcccaggcgatgccgatggcgaggagatcttcggggcgcggcggcggcgggccgggggtggaggtcacgatggtgatggagctggcggcggcggaagacaacgtaatcatcatcaaccgccccgaccaagctggcctcggctgcaacctctacatcaacatctcgagttcgaccttcgcatctcccacaccgaaaccttgtcctgttgctgatggactccgactctggctgctggtccagttgccttcgacagctctcccgcaccttggttcgctctcgcccggacaaccgacccgggtctcctttcggccacagaggaacaacctggtagcgaatattattaggagtccttttgcttcaagacctgaacagaccaacaattgcaagggcttcaatctgatgtgttgtaccacacggtattcctctacctgcgtattcccacgaatcctatttcttccatacatatgtgcctttcnnnattcgcttctactatttttgttatgtttagccttctgccatctaatgcatggcgtgttaatccttctttnn

SEQ ID NO: 80573 - DNA, 548 bp, Triticum aestivum
  unsure (1)..(548): unsure at all n locations
  Clone ID: PAT_TA_80573
ccacgcgtccgctttacttgtcatttgtttattttgcagaaaagtgcgataaggcactataatcttgaagatcttgtctacaaagaaagaggatacaagaccgagggccaatagaagagaaggggggactcgagtatgaagaattaaagaaatggagggccaaaactaaagaagaaagggatctacttgaggctaaagaagagaagaaggagggcaaaagtgcaaaaatgcagatctgggaggggatcaaaatccctagccgcatctccattgcaatcaggcctgccatctcatctctcttcacctgctgctgctcatccctcacgccccttctctagctggtcgttgctgctcttcaccttcccttgccccaacctgctgctacttcttctctcaacctcctgctgctgcttctcctcacgtccctgttgctgctccattcccaatcttgctgctctctctctctctctttctctctctctctctctctctctctctctctcaaatttnnnngaccttcnnnagtgtaataatcnnnnntatgtaat

SEQ ID NO: 80574 - DNA, 606 bp, Triticum aestivum
  unsure (1)..(606): unsure at all n locations
  Clone ID: PAT_TA_80574
ccacgcgtccggaagactgcaactgcaacacccttgggcgcaaagttcctcttccggacccgtcagtgtatgacgactcgggtgcgaccacgtgcatttgtcaagtaccctgtaaccactgatgacttcaagaccggaaagtccaactagcaccaatgccccaaggaccctgagtatgactacgcggtgatgcgtcaagcagttatactgcgtccccggaggccgccaagactgtccaggattcgccaagtacaatgccgtcggtacccctccaagtttgatgttggaacatgcacgactacgcggattcgccaagtaccatgacgccccccgaagagttcaggttcgacaagtccgatgtcgcgcttgtaccactacgttgctgagatcgagaccggcgagaccgaccttgtaacgctatgccaagtacctctaccggcgacccgaacatctacgaaccgtgtacaactactgccactgtaatttttatgagaaacatgtaccactaccgtcgcgagtatctctaccgtcgtcatgtacctctacttccactaccgcttcgatgatcgccgatgaacgatnnnncgactacttcgacntccgtcn

SEQ ID NO: 80575 - DNA, 606 bp, Triticum aestivum
  unsure (1)..(606): unsure at all n locations
  Clone ID: PAT_TA_80575
ccacgcgtccggcgcccgacgaagctgcaatgcctcgccaaatcctacacctccctgcccaaagacatgccgaaagactgcgggcatgcgcagccggagctccgggaggtggaggctgccgcggccaccgccggctccgggggcatgtcggttccgtgcactaggttctacggggatgtgaagtctggtccagaggtcgtcgtgtccagtggtgctcagctcggctttagtaaccactccgtcgaccgtgtcaagttccctgcttccgggtcgctgccggtgtcgattggcggaccacgccggtacatcgggtccgtgtcggcaatggaggtcgagcagtccgaggactacacctgcatcatagctcacggctccaatccgaagaccacccgcatttttgggggattgcatcttggagccctgccctgttctcatgcctgactgggagagcaaggagatcgatgtggacaaggaaggaactgagttgtactggctggtcaagggctcccccgacgccgacgccgcngnggactccacgcgcttctgctcgtcttgcaagaagaacctgaatggcaacgaatcttccatttaccggtatgtggatnn

SEQ ID NO: 80576 - DNA, 600 bp, Triticum aestivum
  unsure (1)..(600): unsure at all n locations
  Clone ID: PAT_TA_80576
ccacnnnntccgaaaagccatattagtttctgtgggtaatgtgcaatatcaatctctgtagttggttggcaagaaccttcatgatcactttgaggcaacagtttaggagtgtgctcggcctatagtcatttgcagtctccggtgaggcagttttcgggatccgtgtaatgtagccagtgtttatactctggagattgagtttgccatcataaaagtgctcaactggtagaaatcgtatctgacaatgtgccagccagatttcagaaacacgccactaaacccgtcaggcccctgtgcctatctgcaggcatcacttgatcacgctatctatctcatcgcggtaaaaggctcagagagcaccactgaagctcccagacaaatctgaagtcctgacattgcatataaagagtgtctgggaaattcctcacctctggctatgcgccttgatctaaactccatttttcatggaatcgagggccttgagcatccattttgaaagatattggaattggatggaagtcggatcatctggttcctgtntnttactatcctatcttctactgcttcnnnncaaaccaccaagaagccaaaaccccacca

SEQ ID NO: 80577 - DNA, 595 bp, Triticum aestivum
  unsure (1)..(595): unsure at all n locations
  Clone ID: PAT_TA_80577
ccacgcgtccgatcgggaaaccccctccccgtgtcgatccaaccaccccaagggccgccactcccaccgtaccgcggcaatgccgacgccgcgaaaccggaaggtccctgcccctgccccgccgcgccggccgcctccccgcctggagtaccgcgcaaaggacggcgcgtggtacggcgcgcgcatggcgctgcagggcgactcgctgcgcgtcatgttcgaggaattccgcgaggagttcgacgagtggcacgacccagacgcgggcgacctcgcctccccgggcgacgtggccgcgctccgcgccaggttccgcccggcgagccnnncctcgannacgcccgctgcggcgacctccgccgcggccagccgctctgcgtcctccgcgccatgcccgacggcgagcgcaagtactacgacgccgtcctcgattccgtgaaaagagcggctcacgtcaccgtgggcggcgaggagcgntgcgcgtgccgcttacggtgcggtggacggacgggccgttccgcggcggcttcgnnnanntcggcgtcgncgaggtctgctgcgtgcgggactcgccggtcaacgacncgntgctgnn

SEQ ID NO: 80578 - DNA, 324 bp, Triticum aestivum
  unsure (1)..(324): unsure at all n locations
  Clone ID: PAT_TA_80578
ccacgcgtccggagagagagagagtggggacgggtgtgctgagagcctgagacatgccccccaccgccctcctcctcgtcgtcctcgccgtcgccgccctccacgcccctgccgcctccgccgcgttgtcccaggagccaccagcgacgccgtgcgcggcggccatcgtgtccttctcgccgtgcctggcgccgtcgcggtggtggcgccgcccgccctgccctctcccgcgcccaccagcgcctgctgcgcggcgttcctgcgcgccgtttccgccggggacggcgannncggcgnnnngnnnnnnngcnnntnnnnnctgct

SEQ ID NO: 80579 - DNA, 473 bp, Triticum aestivum
  unsure (1)..(473): unsure at all n locations
  Clone ID: PAT_TA_80579
ccacgcgtccgacccggtttcggtcgtcagcaggagtgggccaggcaggcaggtgtgcgagaggctaaccactaggcaatcggcttttgaccggctcaacggccagcacgaccactgtgcagctgataaaggtttggttcaaaccaatttgaatggccaaggcgcggctcagtcgggtcaggtgacagttgtgaagcgggccctcatggcctccacgatcgtggcaagtgcgtcgcagcaagctgcgggcccagagagggttcgagaagtgcggcctggcatgactggatcaccaatcgcatctcgtgctgacacgacagtggtacccgcgcgggatggattggccaataatgtatcaagtgcgttggtcccatcgtctgtgctagctggacctcaggtggtgggatcggctgcgcagcggatagcaccagatcccgaggcaggaggagtggttggannnnnnnnnnnncgct

SEQ ID NO: 80580 - DNA, 371 bp, Triticum aestivum
  unsure (1)..(371): unsure at all n locations
  Clone ID: PAT_TA_80580
ccacgcgtccggcgaannacgcttggtgggctgctccattccgggttccggccagaatcataccaaaccctcgcgtcgccccgccaccatggccgacggcgccgcctccctcctccccaccgccggatacgacggcgaggaccgaatcagcgccctccacgacgacctcctctgtgccatcatctcccgcctctccgtcacggacgccgcccgcaccaccgccctctccccccgctggtgccacctctggcgctccaccccgctcgccctcgacgatgtccacctccacgagtccgtncgtgacgccgtagtcccccggatccttgctgaccatccgnnncccttccgcgnnntncnnntcgccgaatgna

SEQ ID NO: 80581 - DNA, 648 bp, Triticum aestivum
  unsure (1)..(648): unsure at all n locations
  Clone ID: PAT_TA_80581
ccacgcgtccgcggacgcgtgggcggacgcgtgggcaggcgtgtacaaggagacggtgagcgtgccgtgggagaagaccaacctggtgctggtcggcgacggcatggggaagacggtcatcaccggcgacctcaacgcggacacgcccggcgtgtccatgttcaacacggccaccgtaggcgtgctcgcggacggcttcatggcgcgcgacctgacgatcgcgaacacggcggggccggacgcgcaccaggcggtggcgttccggtccacgggcgaccgcacggtgctggacacggtggagctgctggggcaccaggacacgctgtacgtgcacgccatgcgccagttctacacccgctgccgcgtggccgnnncnngtggacttcgtcttcggcaactcggccgccgtgctccacgacagcgacctcgtcgtgctgccccggcagctgcggccgggagaagggcgagacggacgcgctgngggcgcagggccgcaccgacccggcgcagcccacgggggatcgtgctccggnnnctgccgcgtcaacggnnncgacgagtacatggccttctaccggcagaagcccggcgtgcaccacgtgttcctcggccggcnnnnganngnntactccnnnacggtgttnnnnn

SEQ ID NO: 80582 - DNA, 650 bp, Triticum aestivum
  unsure (1)..(650): unsure at all n locations
  Clone ID: PAT_TA_80582
ccacgcgtccgatggcatgtttaaacatgaggatgttataaagtctcttcgatgcctctatgagatctcgaaaaatctgaaggatattagattcaagggtggagctctttcgcttgacacttcaaagcccacgatcctatttgatgaagatggggctccatgcgatagctatcgctataaaaggaatgatgcatgtttcattgtcgaggagttgatgctgttggcaaatatgtcagctgcagaagttatatccaatgcattccctgattgtgctttacttcgtaggcatcctgaacctaatccacggaagctgaaagaatttgaggcattttgtgctaaaaatgggtttgaattggattcttcatcatccggtcaacttcatctttcaatttgcagattgaaggaagagttgcaagatgatcctgttatgtttgatattctcatgttttatgcttcaaagcaaatgcagtctgcggaatacttctgcacaggggacctgataagcaagaaggatgattgggctcattatgcgctatctatccctttgtacacacacttcacttcgccacttcganngtatcctgatataatcgttcacaggacactgaatgcagtaattgnnnctgaacagatgtatctgaagcaannnn

SEQ ID NO: 80583 - DNA, 327 bp, Triticum aestivum
  unsure (1)..(327): unsure at all n locations
  Clone ID: PAT_TA_80583
ccacgcgtccgaacaccgcctcttcgtatctcactgcccttccagaagcttccggaaggatctcgtcccaccaccgccccttccgaactcgcgactcctcgccgttccccttccccaaccctcttccttctcggcagcattcccgcctgctcgggtcttctcggagcgctttcgcagcggggacagcgtggctggttgaaacgcgaacgactcctggtcctcggagggttgttgtcggggaggactggggtggcggcggagcttccggagacnatggacnnnntggcgcaacgggtgagcgcgctgcgggcctnnntgcnnnnnnnn

SEQ ID NO: 80584 - DNA, 317 bp, Triticum aestivum
  unsure (1)..(317): unsure at all n locations
  Clone ID: PAT_TA_80584
aaacaccacataaccgcccaaacgttttaagctacccccagggggggcagctggcagggtcacttgaaaagggcacaaataattcacagtagcaggggggttttttttggtttgggggggggaatggtaaaaaataagcgttcgttcctttaaaaagtactttttttccaatggaaaaaaaaagggggggaaccacaacatgggggaaaaaaacggggtcattttttggggggggggnncaacattttgggcgacgggggcccaagcagcagggnacccgagtcnaggannnccttgttgttggaggntgcantggg

SEQ ID NO: 80585 - DNA, 585 bp, Triticum aestivum
  unsure (1)..(585): unsure at all n locations
  Clone ID: PAT_TA_80585
ccacgcgtccggttgagactgccgatgtcacaatattgaggttcaccgattaccaaagaagacaggaggggtcacctgaatctgaactggttgcatctacgttgatgcaaaatgagacagagacaggagctggacccttggagcttattattgaactgggagttgttggagtctctttgattgatcataagccaagagagcttttgtacttaaatctgcagaaggttttcatctcatacatgactggttatgactctgggaccactagcagatttaagttgatcataggccagttgcaactcgataatcaattgccgttgtccataatgcctgttgttttggcaactgagagcatgcctgattcaaatcatcctgttttcaaagcgaacattgctgtaagcaatgtaacttcgaatggtatncnngtctannngcatgtctatatacgggtaactgaccaaacatnnnnnnntgaatattcatgnnnctattgtttgggcactggttgatttctacaacaatcttcgctttaccggcacctccagcagctnnnctgtcactgannnngatcctgagatnngaata

SEQ ID NO: 80586 - DNA, 555 bp, Triticum aestivum
  unsure (1)..(555): unsure at all n locations
  Clone ID: PAT_TA_80586
ccacgcgtccggtcaaacgaaggcccgtcccccgtgtcgctccctggagcggctcgggcggagtcccagatcccgtcgccgccacctccattccctccctccccctcaccgtcgtcggctcacgccaccgggcaaagcccggcggcgaccggcggcggcgggatctggtcagtttcggcctccctcggacgacatggaggcatggggcgcatgtctgcggcggggcgtaggcgagctccgggcggcgcggaggtgcgcggacgcggaggccatggcttcagggcagcgctggtgtgccttggcacggcgctggttctggatgcgcgaatgccgcggatctggccgtcgcggatgcgtgcggcggcgtggatgcgcgtgtggcgggcggcactgaggtgcnnnggcgtggccggccggccgcgggtgggtcacggccgtgtggtggctggtgnnnngcggcgtgggcgggcgcgcgggatggcgnnnncggcgcggatctggcgcgcggcgggggtgagctgnnnntgnnnntnnnctgtggctgtgnnnncgtgn

SEQ ID NO: 80587 - DNA, 607 bp, Triticum aestivum
  unsure (1)..(607): unsure at all n locations
  Clone ID: PAT_TA_80587
ccacgcgtccggtgtcagcgagggagagggtgtaaaggcgaagccggataggataccgtaggtggaagggttatattgcagacaggatgaatctgcttcatctgtccagcgccacctccaggatgcagcggtagacgctgagaatagatgtgctgacatagaaggacgaggggaatgaaggcacacctccatattcgggtggtggtttgggtgcaggggtttctgggaggtgggaataaagatgagaaagtgtgagcgagggagagggtcgtaaaggtgaagccggataccagnngaagggttatagtgcaggcgggatggatctgcttcctccgtctagcgccacctccaggatgtagggaaagacgttgaggatagatgtgctgacagataannacgaggaagaaggaaaaggatggtgaaaaaatnnnggaatttttatagcactgatatgtgggacccgttaataataccacggtcccctttggtcactactcgtgaaccacatgtgaactgcactctgcaaaaccnnacaagggcgttaagtatatggaaatgacaagtttattgtgctagntngatacntttatagttcnnngggtgaact

SEQ ID NO: 80588 - DNA, 554 bp, Triticum aestivum
  unsure (1)..(554): unsure at all n locations
  Clone ID: PAT_TA_80588
ccacgcgtccgcagnntcgttcgacctcacgcgtcctccatcccttccctaccttaccctcaacgtctcgccgccgacgccgcccagctcctcccgccgaggaatttccgcggcgccgatctgaccggcccggccccctcnnncgcgggcgcctccccatctcgtgcctcccccgccgctcctccccgccacacgcgaggagggcggcgccgctgcccctgccccgccgcttgtcccccatcttctccgcgcggatccgcctccgaggtttcgacaatcataagccgtcctacttttatatggatttttcgtaaacatcaataaaggatgagattgaggagcataaatggactgcggtgcaagcagcttaaactcgtccttcttgctttcttcgtgatgtttattctctggaaatgnnnggaaggaacatactacaatactgaagatattcatccagattcatnnnnntnngtnncatccagatcagcatacatcctcagatgaagacttcccaagtnnnnnnnncgttgcnnnagcnngtagttaaagtacaa

SEQ ID NO: 80589 - DNA, 286 bp, Triticum aestivum
  unsure (1)..(286): unsure at all n locations
  Clone ID: PAT_TA_80589
gaactaatataggtatacatttatggggccaattttgatgacgggggtngntttnnaccaaaataaaagttttttaagggaaaccaagggaaaaccacctcctgtttaatttccaaaagttaattaaaattttaaaaacgttactcaacaacacatgatctgctaagtgctaataacctacaaaatcggagtagtagtttaatcccatttgatgtttctgtaaattctcctgacaaacaaaattgaccccaaatngccgatagcaccacaaaatantcctaacccc

SEQ ID NO: 80590 - DNA, 319 bp, Triticum aestivum
  unsure (1)..(319): unsure at all n locations
  Clone ID: PAT_TA_80590
ccacgcgtccgtacctaccaccactcccactccgggcgaggcgagaagagtcagccatggacacggccaccttgctcccggtggcgctggccctcctggccatccccgtcacggcgctcctcctcaaccggctccgcttcggcagggctgcccccggggccgcgcccgtggccggtgctgggcaacctcttccaaatcgagcccgtgcgctgccggtgcttcgccgagtgggcgnnncggtacgggcccatcatgacggtctggttcggctcgacgccgatggtgnnnnnntnnacgcnnnnnntgncgnnngagnngc

SEQ ID NO: 80591 - DNA, 399 bp, Triticum aestivum
  unsure (1)..(399): unsure at all n locations
  Clone ID: PAT_TA_80591
ccacgcgtccggaacgacttggtcgagggacggcgaggctcgctggcttggcgacgcgagtgccagacagtcagaggggcttggccgagggatcaaggattcgtgcaactcttccaataggaggatagaacacatgcacaaaacttcgaaagccacaaaacctgggcggaaatcatggactacacgttggtcaatattgtgcaggcaaccagttgccacaatcgaacacaataagcatcacgggagcctcctcgtcgtcggcgattctccggcgcctttgtctggtcatctctggctcctgccgtgctctctggtgctcctttgcctcatggatggcgctcccatgcctcggacgcacgcccctcnnnnnnncgagcnnnagatnnngaagnnnnnnnn

SEQ ID NO: 80592 - DNA, 656 bp, Triticum aestivum
  unsure (1)..(656): unsure at all n locations
  Clone ID: PAT_TA_80592
ccacgcgtccgggagatgtcaggcggatgagaactggaggatgtgggaggcgacgtgcatggccctatggcgctccgacgatgaccggatgttccccggttgctacggactgctacccttgtctgctgcactgaatatagaacacctaattccctaaagagtgaaaatgaggatctaaagattttatacaagtgtgagctggaaaacgaggagcttaagataagagccaacgaccgggaggaggaggaggacgcacggcagcgtcagaatcagcgcgtcggatccggccgaggcttacgtcgacacggatgcggaggctctagctgcagccgccgcgctctatgccccgcccctgctcgccgagccctgcctctctggatcttcagcaatggaggtcgcttctggcatgttccgcaagttcaaaacgaagaagatctctgtttgcacagcccttcaggggaacaaatggatttctgcactccgtcaggtcaacaccaccgagttagttcatgaatccatcaaattatggttgttgatcnnagnggtgcaaataccacaggccaagatgtcgtctcctgggtgttggacaacagatggaatgtatatgacgcgctcaacctacnnnnnatgttctggggctcttactcgnncacttg

SEQ ID NO: 80593 - DNA, 605 bp, Triticum aestivum
  unsure (1)..(605): unsure at all n locations
  Clone ID: PAT_TA_80593
ccacgcgtccgggacaccgacgaggtcttcgccaagatccgcctcgtccccgcccggccccaggacgccgacgccaacgacgccattgccgccgccgccgcgcaggaggacaagcccgcctccttcgccaagacgctcacgcagtccgacgccaacnnnnnnnnnggcttctccgtgccgcgctactgcgccgagaccatcttcccgcggctcgactactccgccgacccgcccgtccagaccgtgctcgccaaggacgtgcacggcgtcgtctggaagttccgccacatctaccgcggcacgccccgccgccacctcctcaccacgggctggagctccttcgtcaaccagaagaagctcgtcgccggggactccatcgtcttcatgaggaccgagaacggggatctctgcgtcggcatccgccgcgccaagaaagggggcatcggcggcccggagctgctgcccccgccctcgccggcggcgggcggcaactacgggggattctccatgttccnnagggggaggaggacggcggcaacaacaagatgatgggggcgaggggggaagnnnnnnnnnnnnntgcggccggaggannnnnnnnnnnn

SEQ ID NO: 80594 - DNA, 686 bp, Triticum aestivum
  unsure (1)..(686): unsure at all n locations
  Clone ID: PAT_TA_80594
ccacgcgtccgctcagnntaaggccgtgcaaatctcgaggccatccacgatggataatgctcaaaggtctagcagaagcagtgcaagcccaaataggcttagcctgtcaccacgctctatggcaaggacaaaatcgcctatttcagcttctcgtgctagcccaccactttctgttcaaccaccaacgccatcgcgaagaccttcaactcctccagctgctaagatattgacacttccacaaaggtctgcaagtccagtctctagaaggatgagtactggttcaagtggctcagcattaaatggaacaaggggagcctctccagttaaagctaatcacagatcttcttccccaaaacctcaaggatggcagtccaatgatcctgctttctcttataatgcacctccaaaccttcgtacatctctaccagatcgttcggtatcccgttcaaggggtggatctcctacatctttcagtggactnnatacaggttcaagaggtcgaaggcaatcaatgtctcctactccaactagaagagccagttcatcacatagcattgaacgagatcgattgagcacacacagcaaagcttctgcaacatcgtctggtgatgatgatctggactcaatgcagtctatatctattggctantccngcagcccagctgtnnnnnnnnnnnnggcagtgn

SEQ ID NO: 80595 - DNA, 564 bp, Triticum aestivum
  unsure (1)..(564): unsure at all n locations
  Clone ID: PAT_TA_80595
ccacgcgtccgcctctccccaagnnnattggaggggattggcgaggattgggacatattttgacttacaagtggtttaaatcctcctcaaacctcttcaatccacacggatccacgctcaaccgaacaagtcctagagcatctacagtcgcacacacaccaagtccgggccatcaaacatccgcggacgtgcccgggttcgcccacgggcagtgactggtcgcaccttaaattttcctttgcataacaggacacttcaattagcaaacctcaaatccataaaaacacatgcaacgtaacatgaacgatgcaccaaaaatcgtccggctactacatcaggacaatagatttagtaaaggaaggcctgtaacatgttgatgccatcagactaccaaaaattgtcatgctctacctacatactagctatggagaagatcatccatggctgccattttccttcccggcgcccttgctgtctttcttgcgaagtagcgctcgataacacaaaatggatcaagccggatctgctcgttcctagctaatgaaagtggactttatattgttt

SEQ ID NO: 80596 - DNA, 500 bp, Triticum aestivum
  unsure (1)..(500): unsure at all n locations
  Clone ID: PAT_TA_80596
ccacgcgtccgcaacaacatggagatgattgaggctctgttggaggacgactccgacgatgacctcaagctgcccgagcccgaggagcagccgcagcacctcggcctccccctgccgcagcacctcggccagcagggcgccctcccggtcccgcatcccgcggcggtcgctgacggtggcgggttcctccgaccggtcgccgcctccaacgggttcctgcccccgagcctcgggtactacccttcgctcccctcgccgcgcgccccgccgggcgccgattacttcacttccctttcctcgccgcgcggcccgcccggtaccgagtacctcgcttcgcttccctcgccgcacgccacgccgggcgccgactgcttcgcttcgcttccctcgccgcacgtcccgcctggcgccgactgcttcgcttcgcttccttcgccgcacgtnccgcctggcgccgaccagcagcagctccttccgccgcaccctcagcaagacnnnnt

SEQ ID NO: 80597 - DNA, 577 bp, Triticum aestivum
  unsure (1)..(577): unsure at all n locations
  Clone ID: PAT_TA_80597
ccacgcgtccgcaagnnttgtaagagcaaatcttccgttacaaccatccagtaccgtaccttctctctcgtagcacgttgtccagtacttctctcttgtgctcaagatggaaacctgtatttcttcagcattgcaacaaattcccatggatacttgactctcatatgctctctaaaattggcttcaccagtgcagaatatccgtgcttctttctgtccacttctttcccttgagaaaggggaattcatagttactggcagtggagattcgaatgtttacttctatgatttggctcggccaaagaattcatgtgtaaataaactgcagggacacggctctccagtaatgggagtagcctggaatcacggggaaaatttgctcgcctcatccgattcagacggtacagttattgtatggaaacgagcaaaaactaattagagtgaacgccacatctcgaggatgcttgtatacagcaattgtagaggctgatacattgtcccaacagaggcattgcctagcgcgcattgtacccgccaccatgttnnntgtnacataccannngnnctggnnnngaagn

SEQ ID NO: 80598 - DNA, 625 bp, Triticum aestivum
  unsure (1)..(625): unsure at all n locations
  Clone ID: PAT_TA_80598
ccacgcgtccgcgtcgtcagcccgccacgctccgacacgcgcccagccgccacgccacgccctgccctctctgctcctcgacgcagccgccacactcccctgcgctctcgtctgtccctcgggaatctgtggccggcacgagcgggcaagcggcgcaccaccgcggcggcggtagcacgctagtggggaagcgggggcggcggatccgggaagagcagcggcggcagatcgggaagagaagcatcagccatcagcaagaccccctcccttcaagaacgaaggctaaggctgcaattgccggcgtgatgaacaagcgaccccgcgaggacgagccttcctcctcccaaaagcgccagtttggtgcaggtggcggctatggggagcaagaagggtactcggaggagcggatcagtgcgcagcgggtggcggaccactacagtgcccggtcgaatcagacgctcgaggagcgtgagaacagccccatcatccacctcaagaagctcaacaactggtctcaccttcgtcagataaagagcgtcctggttcagctgtatgcacgtnnaggagactgcgttctagntcttgcttgtgnnnnnnnanntgatttgataaagnnnnatnnnnn

SEQ ID NO: 80599 - DNA, 637 bp, Triticum aestivum
  unsure (1)..(637): unsure at all n locations
  Clone ID: PAT_TA_80599
ccacgcgtccgtaacttttggtgggcagaccatcgccgtccgccgccggttcaacggcggcggagcacatgcccttctccctgcgccgcctcctccgtctcctccgcgacatcatgactcttcccgccgcggacgacgccgccgtctccgaaggagagcggcgtcagtgggagccgccgttcgacgcttccaggccggcgccgcccatctcctaccccatcaccgacctcgccgcgctcgcctcccgctcctacctctccgaggactccaacttccacctccccttcaaccgcgcctccatgccgctcccctcccccggggcgccgctcccgccgcggcggcgcctcctcgtctgccatgacttccagggcggctaccgcgnnnnngcggcgccgcnnggcggcgctaatcccgatgcctacgcgctctggcattggcacctcgtcgacgtcttcgtctacttctctcactacctcgtcactctcccgccgccatgctggaccaacgccgcccacctccacggcgtcaaggttttgggaacgttcatcacagagtgggataaaggtgcagaaatctgcangnngatgtttgcaacacaggattcagcacagatgtatgccgagnnncttgcnnngnn

SEQ ID NO: 80600 - DNA, 627 bp, Triticum aestivum
  unsure (1)..(627): unsure at all n locations
  Clone ID: PAT_TA_80600
ccacgcgtccgccagcaccactggagagctttgaagaactggtttcaaggtatgactgtgattcatatttggttgggaacttgtcaaaacttgggtttcaagaacctacacctatccagaggcaggccatttctattcttctttcaggcagggagtgctttgcttgtgcacctacaggctctggcaagacactggcattcctgctcccgatgcttatgaaaatcaagccagggtctaaaggatgtgtgaaggctgttattctttgcccgacaagggaattggcagcacagactacgagagagtgcaagaagttggcaaaagggaggaagtttggtgtcaaactaatgaccaaagatctgtcacaagatggcaatttcaaggatatgcactgcgacatccttgtatccaccccacttcgtttggaccatgctatacgaaagagagaccttgacttaagtagggtggagtaccttgtgttggatgaatctgataaactttttgagcttggattcgtcgaagtaattgattcaattgtcaaagcatgctcaaacccttcaataattcgttctttgtttagtgccacattgcctgaaacaatagnnnctcttgcacgtacaataatgcatg

SEQ ID NO: 80601 - DNA, 497 bp, Triticum aestivum
  unsure (1)..(497): unsure at all n locations
  Clone ID: PAT_TA_80601
ccacgcgtccggnnntgtagtctctggtagtctttcgtgtgggtgtggcggcggtctgagccgtgagtcaagtgaatacagaggannnnaaaaggccccggcgatccgtcgccgtgggtgttcgtcgcccaacaaaattcgtatcctcgtgttgttgtgattgttcgtctatccttggttccaacagtggcataccgtcctcctctctccggcaagcgggctgcatctccagcggcttgctgccccctggcgctgtgcgggatcctccccggctgcctgtccggctggttgcggtggcatggcagcccgcccttcctctctggctcgcccgctccggcagcagccgtcggctagctggcgcttggcagcgtgggatagccaattctcgagccccnncttctcccttcagatccaaatggttcctgcgcacacccacaagatgcgctccgggatggtggtgatgcggcannnngatggccnnntggnnnnnnctgttt

SEQ ID NO: 80602 - DNA, 661 bp, Triticum aestivum
  unsure (1)..(661): unsure at all n locations
  Clone ID: PAT_TA_80602
ccacgcgtccgcataaattggtgctgctcacgaatttatggagtccatgactggacaaatgaattcatatttttcagctaaatctgagtcagctaaccatttgaagagaagaatcgcaaaggccaaagatatgtatacctctggtgtgcaatgcatgaacgagcttgtcaatactctgcggcagcggtccatcacagactctgagcagatgaaactgaatatatcttcacaagcaatagctgttgacaattttatagcagtgatggtttcagagactgaacaagtattaactgaggttttgagatctacttctgaactcaaggagctattagcattttctgctgaacaacaagaattaggattgcaaaagagtcttacctcagcacaagccatgtcgaagacgtcaatagatttttttaatgatattagtacacatgcgtctaggctcatgaaacttatggagcaaagtcaaagaggatgctcctctcgtcttgctgaatttgagaagggttttgaggaagttgctattagagaagagcaagctgctgttgacaagattgctggaattttagctggcttgactgccaggaaaaggacaatggtcaacttatctattgtttaattgcaaaaaaaagcctccttttatgannnnnnnnatnnn

SEQ ID NO: 80603 - DNA, 652 bp, Triticum aestivum
  unsure (1)..(652): unsure at all n locations
  Clone ID: PAT_TA_80603
ccacgcgtccgcctccgcgaggcccgggagcggcaggagcccgagatccgcccgcccaggcagaggataaccgacttcgacgagctccgcgagcgcaagcgattcgaaggcctcgtcactcgcggcggcgtcccggcgtgggtcaagtatgcccggtgggaggaggggcagggggacctcgcccgggctcgctccgtctacgagcgcgccctggacctggacgccgcccgccgcgaccacgcgatgtggctcaagtacgccgagttcgagatgcgcagccgctgcgtcaaccacgcgaggaacgtctgggaccgcgccgtctcgctcctcccccgcgtcgaccagctgtggcacaagtacatccacatggaggagctgcttggcgccgtcgccagtgctcgccagctctttgagcgctggatggcatggcgtcccgacattgctgcctggaactcgtacatcaagttcgagctgcggtatnnnnnnngttgagcgtgcaagggcgatctatgagaggtttgtcgccgagcacccacggcccgacacgtttgtccgatacgccaagtttgagatgaaacatggaggagcagagcgggcacgtcgcgtgtacgagcatgcatcggaactgcttgtggacgatgangnnncnnnn

SEQ ID NO: 80604 - DNA, 218 bp, Triticum aestivum
  unsure (1)..(218): unsure at all n locations
  Clone ID: PAT_TA_80604
ccacgcgtccgnnnntgttcagggcctaagatctaggatatctcgtgttgtattactagtatagtgtttgcaagcacattattctggtgagcctgcttgattacacggtgtaaacactcgactccctcccctaaaaaaagtctcaactccctcggtatatcttgggcagatgatatgtagcgaacgtcagatttctggctcctcccaaaaaaaaaaaa

SEQ ID NO: 80605 - DNA, 321 bp, Triticum aestivum
  unsure (1)..(321): unsure at all n locations
  Clone ID: PAT_TA_80605
nnnnaataaactaaaccaaaccannnnntgaaggatctgcattacaaagggcacagntgaaatgcaagccaaaacaaaagttgctgttgtgcagactaaaccaaagccactgcaatggcttattacgggtaagggggagtgaaaacaaacaaaaacannnntccggcaccaggagcgggaacacccccgcccgggagcaagacccgggcgaaccccaaaaacccaaaaaattaaacttgaacagagcggggggggggccaccccatcaggcatgggcgttggcgagggtaactgccttggcgatgactnngcntatgcctc

SEQ ID NO: 80606 - DNA, 228 bp, Triticum aestivum
  unsure (1)..(228): unsure at all n locations
  Clone ID: PAT_TA_80606
ccacgcgtccggaaagttcatatttgtttgctatatagatgctcttcatagactgtggtttaaaattcaaaatcctttatatctcgttgttattatttggttcagtacctgctacgttcctatggctggctgcccttaagtagttaaaaataacgatggctcttcgacattattgattgtctgatgtctttgcnnnngagaatatagatgatnnnnnaatgggggann

SEQ ID NO: 80607 - DNA, 654 bp, Triticum aestivum
  unsure (1)..(654): unsure at all n locations
  Clone ID: PAT_TA_80607
ccacgcgtccgggagcggaccaccaaggcacccctcgccccctcccccgcgcgatctgatccacccgccggaggtccggcccggccgttcaggccaatgctgcggggatccgccctccgccgccgccgctgctgatcgcggtgaggagactaagaatggagagaatgactttgaagagaatggcagtttggatcccgtggtttaccagctagttcgggttgaaggtgatggaacgcttgttcctcctacggaggacgaagtcctgcagattgaacagtttcttgatgacaaggttgatctgccttctattgatgatgtaggaaatgtggaggatttttttactaatgactgcatgcttctgaaggagcctgactttgaagagggctattccgaattagagactaatggtgaaatacatacgcaacagtttgatgctgacctagaggtagacaggctaaaaccgtcggatgactcgcttgatattccctcgaagtgtacagttgttcatgatcacaaaccagataaactgaacacggaacaaggcgataacaacattgttcaccaggacaatgcttccactgagactccaaaatcaacagtattaaatgactcttgcagtgctgaaaaagaaaaggccgatgcttgttcaagann

SEQ ID NO: 80608 - DNA, 610 bp, Triticum aestivum
  unsure (1)..(610): unsure at all n locations
  Clone ID: PAT_TA_80608
ccacgcgtccgcacaccggcacgggcacgggaaccaaggaaccattcgtttgcggagcagagcagagcggtgcggagggcatggaagcctcgcggttcggcttcggccgcgacatggcggcggcgttcaagttcgaccccaccgacgccgacatcgtcgcctcctacctcctcccccgcgcggtcggcctcgacgagccccacggccgcgagcacgccgtgatcgacgacgaccccatgagcatcccgccgtgggacctcatggagaagcacaaccacgggaccagcgaccaggccttcttcttcgggcctcccaggaacgggggccgcgtcacgcgcgtcgtgcccggcaagggcggcggcacgtggcaaggccagaatggcnnngntcgggaccgtcaccctgtnnngcgatggcgcccgcgcnnnncgaggtggacattanctnnngnangnacgacctcacctacaagcgcgcgggcgacaagncccnnnnnnggctgggtcatgagcgagtaccagntcacctcgccgccgctcttgagcacggtgctcacccgcatcggattgatcgtcgcngccngggagcnnnnnaagcgacagccggnnac

SEQ ID NO: 80609 - DNA, 622 bp, Triticum aestivum
  unsure (1)..(622): unsure at all n locations
  Clone ID: PAT_TA_80609
ccacgcgtccggggaataggagaatcatcatcattgtaaaactgtaacttgtaaccatgtagtgtcaaaaaacgtcttatattatgggacaaagggagtatatattttatgagaggcctgaatgcctgctacgattgttgaagtgcccatttcaatcaggatttatgttccttttctcgtaattttaactaactactccctccgtccttaaataagtgttattttgggacggatggagtattacttcggcaaatgaggttctggactctgaaacgcctgaagcctgatacgaatgtcgattgcccatttcaaacaggatgtatgttccttgtctcgtaattttaattaacaattacttcaacaaatgaggttctggactctgaaacgcccactttactttgacattcccacatgatgtatatgtaacattttcttctaatgcctgatttgcaggaaggatccaaattacaaaaggatggtaatggcatgcttcattcnnnnagtctaccttcttgaaatagacagacaagaccagaaaggagaagagattggccttgctccaaaatggtggaagcccttcaagtacaaggtcacacagacactggtggacgagnnnnntggc

SEQ ID NO: 80610 - DNA, 628 bp, Triticum aestivum
  unsure (1)..(628): unsure at all n locations
  Clone ID: PAT_TA_80610
cgcggctcttgccggcagccgtgcctgcgtgcggcaccttccggctgcttggcattacatcccctcgcgtggtggtcgtggggagtctcctgactctgttggcggcttctccgggtggccagatctgggccgtgcgggtccacggccagcgagggtagtggtggtgtggccgcggtcgtcctggctggtggtggcggtggtgtggtgtttggcgctgtggcggtgcagacctgcagctgtgctggatttctcggcaatcggccgcagtgcaatgggagggcgtcattgcagatcggggggtaacccctgctccgtcaggagccggcgatggcgannnctgtgggcgccgcaatccttcttnnnnncgtcgctgtgaggctgctatccctcctcattgactccgggggaaatccctagtccaggtcctcctggttcggatgatggcggtgcaacatgcgtcgtttccctttgtgannncatcatcttggagtcgtgctggggttgatgagattgatggtcgcttgctgtnnnaatnnnnggagtgatggaatggggtgatggtgctctgtctgcgtgatcttggctcggccatgcannnnnnnnggtctgaattttcatncgannnnnn

SEQ ID NO: 80611 - DNA, 619 bp, Triticum aestivum
  unsure (1)..(619): unsure at all n locations
  Clone ID: PAT_TA_80611
ccacgcgtccgatcgcccattgaccctaagttcgttaccggtggcaatgaagattcaccgctggtggatggcaacgacatcggcgatgataagcacttctactgtgctaagtgcatgcatgtggtgccatgtgcatgtatacggtccaacttcaggacgtgcgaccacgacttctgctctaggtgtgtcgccgtgaagttaggccagaacatcgctcatgttggatattctgaaggtgaggacggtgatgatgatctgttctattgcaacatctgcatggagatggtggcgaggaccctcaagttcagcgtcaactcgtgtggccacgtcttctgctcaagctgtatcacccagtacgtcgccgcaaagctggacaacaatgtagctcgcgtcgaatgccctgacccaggctgnnnggcggtgtcgttgagctggagaggtgccatgacatcattcccctggacctcctcnnnaatggggtttcctgctgtgcgaatctgcgcttggcaccaagnnnatatactgcccatacagagaatgctcggcgcctctgcttgctgacagcgaggccggggtgactgcggtcnnngannnnngagtgcccgnnnctgccaccggc

SEQ ID NO: 80612 - DNA, 453 bp, Triticum aestivum
  Clone ID: PAT_TA_80612
ccacgcgtccgactgcatgatcagctactcccagtatcggaacatcttccctatctgggcgcttggcgagtaccgctgccgggtgctgggcgcggccaagaagtagtaccgtcttccttctctttggccgggttacgtgctggaacagtgtgtttctgtaataatgttgctaggtgcaggtggagatctggtagccgtatagatttttttttaccatttgatgagtagaggaataaactggagaggggtatatatgtcgcttgtagggcctgtttggttggatacctgaacaccgtgcctggagaaatggactgcctggattgagcctgagaagattgaaaatattgcctggcgaggctacgtgcgtttggttgatgtcctcggactgatgatgtgcatccgctgtgcgtcagagtacgtataaatcatttaaatacagccaaaaaaaaaaaa

SEQ ID NO: 80613 - DNA, 651 bp, Triticum aestivum
  unsure (1)..(651): unsure at all n locations
  Clone ID: PAT_TA_80613
ccacgcgtccgagtgagctgaagttccaagatcttccatgcggagtcaagcatttcttcagcacacatgttgtagatcaatgtcttagttcttcagaacacactgtaccaagattctctgtgaatgttgacagctctattagctgggatgaggtgctcaattcatgcgctttgcggttatcacatgacttaattcagcatcatgttcagttattgcatggcagggctcataacaatcatgatgaacagaaagaagtctttgtgcccatggaaattagtgcaccagatgaatctaaatcctgtgagaaccaggaatccatcatattggcgaagtcttctttgtatgttgacaaacggccctcatatcctacaaaactggccacgtgcagtgctcagctacagccatcagcatctgatgtgaaagataaagaggaagatcctgagaaacttgattttcacgagagtgtctcaagaaatccttctagcagaactatgaagggcaatgaatcactttctattattgccttcggaattcagatactgcagcacccacagttctctaaactctgttgggttacctcaaaacnnnnnggaaggcccctgcactgatataaatggaccatggaannnnnnggccgtnnnactcctgnnn

SEQ ID NO: 80614 - DNA, 428 bp, Triticum aestivum
  unsure (1)..(428): unsure at all n locations
  Clone ID: PAT_TA_80614
ccacgcgtccggaaataaattcggaaggccgtctccccaacgactcgctcgaaactgcgcggcgcgacgccagnnggacctgtcggacgcggctcgctcgctacaagtgcagcgcggtggccgtgcggcggcggcggcggcactnnctctcgtgggtttcttcgctctggcggtcggcgtcgggaggagggacggagnnngggcgagcgggggcacgtccggcggaggcgagcggaccggaaggcgagatcacgnnnctgagtgttgtagctggtgcgaccnnnaaatgagcttgcacagcagtccggccgcggccggggacgcgccgaccgggacggcggaggagctgctcgagcgggcgcggggcctggtgccggacgcgctggacgctgcgnnnnnnnnnnnnnnnnnnnnnngnncgnnnnnag

SEQ ID NO: 80615 - DNA, 538 bp, Triticum aestivum
  unsure (1)..(538): unsure at all n locations
  Clone ID: PAT_TA_80615
ccacgcgtccggtgtcgttcatgcaggggactactgcaagatcaagcaatactgcaacgagctgcacgccatggccatgtaccaccacccggcgacggtggcggccgtcgagggaatgccgcggtggacgccgtcagcagccgaggcgcagggctggcagcatcggcgacggtggggcctccagggcccagagcggagccgcgcgatggtggagagcgtgggcgaggtgtggggcagggcgccggcgaggagcggtgggaggccggcctcgtcggcgccgcgctggagcgcgccatcctgcaggaactggtcttggacgtcgtgacggagctgctcgcgcactccgagcggccgttcggccagtttggccgcgggcacgaccacggcggcggtgccatgtgccggaagaggctctgtttctgagcgatttggcgtgctctgttctggctttcatgcgtacatagtgctgtactacgagtggagcaagccaggcacgtacggtatgtagtccaaggggtggatgtnnntgactgacgcc

SEQ ID NO: 80616 - DNA, 262 bp, Triticum aestivum
  unsure (1)..(262): unsure at all n locations
  Clone ID: PAT_TA_80616
ccacgcgtccggacttgagtgattatgatcctgataccaaccaattcaccgagaagactattatgtattgtgatcagtgtgaacgtgaatatcatgttggttgcatgagaaacaannntgatcagctcacctgctgtccagnnnngtgctggttttgcagtaggggatgctcagnnatatttcagcatttgcaagagcttatcgggaaaccaattccaactcctgtcgnnnnnntatcatgcannntactcagnnnngacag

SEQ ID NO: 80617 - DNA, 464 bp, Triticum aestivum
  unsure (1)..(464): unsure at all n locations
  Clone ID: PAT_TA_80617
aaatccacaattcannnaannnccaacggaccccccacaaaaattacnnnnngattaatcttaaaaaaaaacatggttttcaaaacccaaaaaaggaaaaaaaaaaaaaaaaaaaacccctctaactactactataaacccggagggtctgaaggaactactcataccccatcttggaggcaccaagggtgaaaaaaatggcccccccaatgcccccctcctccgggaaaactccaaaacagggctccaaaagggatccctttgaaacaaaggcttgtcatgggaaaaaaattgtttcagggctttttccgaggggttctgantatatgggaatttggaggaaaaaaattagggcaatctgaggcttagggaccccacaagcatggggggggagctaccccaggcctcaccgtccacccttgggggacnnncatgggtcttccgnnctccttccaaaacttcta

SEQ ID NO: 80618 - DNA, 652 bp, Triticum aestivum
  unsure (1)..(652): unsure at all n locations
  Clone ID: PAT_TA_80618
ccacgcgtccgcgaatgatgtagcaaggaaactatgttctgaggcaataagatctctatttagaaatgaaggaaaacatcgcggtgaggcaactgttgaagcagtaagattgatatcagctagtgtgaagctcaatgattgccagctccatcctgatgtcgttgaggtctgcttgtctttgaagtttgatgaagaccttggaaaagatgagagcaaggaagaaaaaatgaaaccaaagaaaaataaacgatatcagaatcgggatgtcacaaaaccgagtgagaagaaaaaaataaaaaaggaattgctttctaaggccagacaagaggttcatgcagatcttagagctgtttcatttactcttgatccaaaggagaaaaaaatgatacaaagggaaacacttgcagctctttttgagacctattttcgaattttgaagcatagcatgaacacttcaaattcaaggtataaggccactagcgtcttccctggtggctcacaccctttacttgctccatgcttggnnngcttnnnaaaattctcacatttaattgatttggatttcatgagtgaacttatcgcttgccttaagaagctttctgggtatacagaccatcangnngaaattccaccggannaatacactctctgt

SEQ ID NO: 80619 - DNA, 661 bp, Triticum aestivum
  unsure (1)..(661): unsure at all n locations
  Clone ID: PAT_TA_80619
ccacgcgtccgcatttactgattgtgttaaatgtcttattacattcacaagtagtaaatttagcagcgatgccagtctcaatgctattgcttttcttcggttctgtgctgtgaaacttgccgaggaaggatttgtctgtcatgacaaggataccgaccatcaatcaaataatttggattcttcagaggggaatgccatagtgcacaaggatgatcatgtttacttctgggttcctttgcttgctggtctagctagattgacaaccgacacacggccaactatcagaaaaggtgcagtagaagtactctttgacattttgaaggaccatggagaactcttctctcagtccttctggaccaatatctttggatctgttatttatcctctatttaatggtgaaatccgtacacccaatggtcaaagtgacagcactgaggatgattcatggaattttgaaactaaaacagtggctgtgaaatgtttagtggatctgtatgttacattttttgatgtgatgcggccagaactcactagagttacctctgttgttaccagttttatcagaagcgcttatagacaatctgctatcactggtatgtctgtttttcagcgtttaacnnnnnngcttgcaagcaaactctccnngnncgaatggaaagnn

SEQ ID NO: 80620 - DNA, 631 bp, Triticum aestivum
  unsure (1)..(631): unsure at all n locations
  Clone ID: PAT_TA_80620
ccacgcgtccgggcgctccgggagaagtgcgccgcgtgcctcgcgcccgcggcggcgggggagcacgccgtgctgctggccgacctcgagctggccatcgagagcatcgagtgcctcgccgacgccgccccgtccccgcgggactccaagatccgctcgctgcggaactccatccgcctcctcggcgtcgtcgccgcgctccacgcgccgccgcaccccgccgcctccggcgactgcgagggcgacgtccgcggggtgcccagctcccacctctccgcgtgcgcgcagctctacctcgccgtcgtgtacaagatggagagcgacccccacctcgcggcgcgccacctcctccaggtgttcgtcgacgcgccccacgtggcccgcacaaccctcctcccggacctctgggcccacgtcttcctcccccacctgctccatctcganntctggctcgccaatgagtccgagctcgtcgccggctgcggcgacgccgacggccggagcagcagcaggacgangncnctgcagnnnctgtacgacgaccaaatggacagcggcacagctcagttcgcaatgtactacannnactggctcaacannnnnnnnnnntgcgccnnncgccnnncccnnn

SEQ ID NO: 80621 - DNA, 456 bp, Triticum aestivum
  unsure (1)..(456): unsure at all n locations
  Clone ID: PAT_TA_80621
ccacgcgtccgannnnncatgggtgctccagcgccactcggtaggcgggagcgttagaggcgacaatcacgtccgtgatggcggccaggcgtagtagcaccgtcaccagcacggcgctcagcgccttgcccgcgcgggtgattttctcgcagacgggagcaccgtctagttgccctggtggtcgggcgtggcggcggctgggtgcacggcatcagtacccctgggtcaccgcgcggatctggctggcagcaccatgaatcggtcatcagagggcaccccttgagaagtggcggcagatccatgggtgcccgatgcggtggacgaggccggggagaagaagagggggtcgaggagggcccgatggagatgcagtgtnnnnagcggggaagagggaggtaagccatgctggggagctggtggcggnnngnnnnnnnnnnnnnntannnnnnnnnnnnn

SEQ ID NO: 80622 - DNA, 657 bp, Triticum aestivum
  unsure (1)..(657): unsure at all n locations
  Clone ID: PAT_TA_80622
ccacgcgtccggggacttggttgagcgaccttggaagggaacgcaggttccctgtgatcgcatggacaaagcactttttgacgcttgcacttcaatcactcttgggaatgggcaaatctcccggttctggcacgatcgttggcttgcgggagaatctccaagagacatcgcacctgacatttttaagctggcctggaggaagaacttgacggtctcggaagccttgactgagggaagatggatgcgaggcgctcaacggatgagtgcggaaaatcaaatccaccaattcatctcactgtgggagaaggttcagacggtatagctaaataataatagaaacgtgatctcttggaaccgatcaagcaacggatcctactctaacaggtcagcttatgaagcacagttcattggccgcatcgaacaaccacacctggcgacggtctggaggataaaagttgagcccaaagtgcagttttacacatggctgctactgcaaaatcggaattggactgccgacaggctcgatcgtcgtgggtggcctcacagcccggaatgcccgcnnngtgaccnngctccggaaacagcactgcatctcctacttacttgcccctatgctcannnnntatnnnnnngctgcccgaagcttgcacnnncgnn

SEQ ID NO: 80623 - DNA, 666 bp, Triticum aestivum
  unsure (1)..(666): unsure at all n locations
  Clone ID: PAT_TA_80623
ccacgcgtccgcccttccttcttgttcccaatttcgccagccgcgacgctctttcgccattccattggatctcggtcagccggccggatgctcaggattaatagaggtggcattgaatattctgttatctaaactttgtaccaaataaataggtccaacaagacctttgatgcccttttctactccattttacaatgtccttatattctttttgctgtggtaacttccagcaactaaggaactcaataggacacatttgtagtatcagatttctcaagtatcacagcagaataagctctgaaaatgtacttcagaacagaagacataaaactagaccttttagtgcaacagtactagcgagaaatgcaggaaaaggaagtaagcaattcttcagcaatgaccgccatctacacggtggatcagttgaatcatcgattgaagtgttcaagcagtctgatctgcagcacctgaaatcactccagtgctacgatattcaggaaaaggtttctggaggcaagaccgactgccctgcaactatccttgtctttgatattgaaactactggcttctcacgccgtggtgatagaattattgagtttgctgcacgtgatcttatgggtggaaagaatagcacttttcnnncncttataaatcctgnnnnnnnnn

SEQ ID NO: 80624 - DNA, 610 bp, Triticum aestivum
  unsure (1)..(610): unsure at all n locations
  Clone ID: PAT_TA_80624
ccacgcgtccggcgctgcggcggatgagaggggtcaggcgggagcgagctgttcggcggcgcatgggctcttcatgcgcgtcgccggtcgtcggcccgatgggctccagngggcggtgtgaggaagatcgggccccggcttcctgttctgcgaggtggctgcgatgaccgtcgggcgcaaggggctggcggttatccggcgcggaccagcggcagcgatggagacctgggccccggcgtccagatctggtggctgcggcggatgttgggagcgtggggccaacggccgtcgggcgtgtgtctgcggtggtggcatggctcgggttggtggttggaggtgcagcgtcgggtgaagaccttgctgccagtctttgggctgggcaggcgacggcgacgcttgcgggcgccgcttccttcttgaaggcgtcgctgaggcattcctgctcgctccaccacgcaaggctgctcgagggaaacccttgatcccatgggatcggacgatgaaggcgatgtatgtcgcgcctcttggggcatcgtttcaggagctccttaccggccagggggaccagtgatagannnnnnnntgnntgttcgtgctgcttgggtcgtgt

SEQ ID NO: 80625 - DNA, 667 bp, Triticum aestivum
  unsure (1)..(667): unsure at all n locations
  Clone ID: PAT_TA_80625
ccacgcgtccgtgctagatgtgctataattactcatatgttggctgttgatatatgagctttgatgaacctagcttcaggaaagtcgttctatgcattccagtccaaaaataacttcagaaaactgattttcatttctgaacattattccgttatcgtggatttttccactctgtttcacgtgtgattaacattttcagtttgttatttcattactaactccacatagacagatagactggtagatagtcactcggagtgtttgatcctcctaatcacatcatatccgtctctacctgcagctttggacaaaaacgtctatgctcaacacagctggttcccccaagttcagcagtgaccgtatgatacacagtacgcaaaagatatatgggatatcatccccgtcatcatgctctgaataatttaagcagtttacagaaaccttgagtctgtgaggcgcaatcggtcacagatttgcctctactcctcattgggaaggtgttgctgcccccagctttgtataggaacatgcaagttctgacatggacctgagagctgagagcatgcagggtgatatgtatgaaggaaaaaagccagagcagcgcttggataaaagtcagtgttggaatttttttggcagatgcggaaatcttggtaaaggatnnnnn

SEQ ID NO: 80626 - DNA, 638 bp, Triticum aestivum
  Clone ID: PAT_TA_80626
ccacgcgtccgcgacatcagaaaggaccttcagggcttgctcgcagaggatgacctgaatgttatcatgagctcagaacaccggcctcgttgcatcatcgagttcatttcgcagagtctccagatgttggatttcgaggaacataagcggagcatcatggagtctaaactgtcttgtttccttgaaggaatttgtgtgtgcgagcagatcatcgggattcccgttcctctgtcatacactaggcttacttcacggtttcttgtcctgtggcatcttacacttccaatcatactatgggcagaatgtaaatggatagtcgttccagctacttttgtcagtgctgcctccttattctgcatcgaggaagtgggggtcctcatcgaggagccgttcccgatgctagcgctcgacgcgcagtgccagcagctccacgacagcatgcgcgacatgatgtcggtgcaaggcctggtccgaaagcaactggccgccaagaccaagggccgcggcagaggcggcggtaggctcccgcagaacggctggcccgtctccagctccaggggcgagcaggtgaaggtcgactgatcgagctggctggcggcgaatcattcaagaacagcggcggttggaagcaaccgaat

SEQ ID NO: 80627 - DNA, 648 bp, Triticum aestivum
  Clone ID: PAT_TA_80627
ccacgcgtccgataaaagccgccggtttgatacagatattggattacccaggccaaacgacttccatgatattccagaatactttgttcttgaggcaattcctcatgcagtagctcttgttagatcatcagataagagcagcccaagacaagctattgaatttattcttcagcttctaaagtataatgataacaacgggaatgtatactctgatgtctactggctagctgcaatggtccaagcaataggcgaagtagaatttggccagcagggcataggtctcctatcctctcttctgaagcgtattgaccgactcctgcaatttgacaactttatgcctggttacaatggggttttgactgtcagctgcattcgagctcttgcacgtatagcggagagggtatcatcttccatttgccttgatcgtatttgtgaattgattgcccctttccgtagcatggataaaccatggaaagtccaaatagaagccagcagggttcttcttgatctcgagcttcaccataaggggctagatgcagctctcttgttgttcttgaaatatacagatgaagaaagatctttgcgaggtgcgacaaagttggctgttcatgtcttgcgcatatgtcaagcaaatattgaatctaacgt

SEQ ID NO: 80628 - DNA, 612 bp, Triticum aestivum
  unsure (1)..(612): unsure at all n locations
  Clone ID: PAT_TA_80628
ccacgcgtccgggtatctccaagatggccagacccgtgagcacgctctccttgcgttcactcttggtgtgaagcagatgatctgctgctgcaacaagatggatgccaccactcctaagtactcgaaggcccgttatgaagaaattgtcaaggaagtctcttcatacctgaagaaggtcggttacaaccctgacaaggttcccttcgttcccatctctgggttcgagggtgacaacatgattgagaggtccaccaaccttgactggtacaagggccccacccttcttgaggccctggaccagatcaatgagcccaagaggccctccgacaagcccctgcgtcttccccttcaggacgtctacaagattggtggcattggaactgtgccagtggggcgtgttgagactggagtcatcaagccaggcatggttgtcacctttggtcctactggcctgaccactgnnntgaagtctgtggagatgcaccacgagtctctcctggnnncgcttcctggtgacaatgtcggcttcaacgtcannaacgtggccgtcnnnnntctcaagcgtggatacgtcgctnnnaactccnnnnnnnnnnctgccnnnnnnnntnn

SEQ ID NO: 80629 - DNA, 398 bp, Triticum aestivum
  unsure (1)..(398): unsure at all n locations
  Clone ID: PAT_TA_80629
ccacgcgtccggccgnnncaccggttgatgagaagcctgaaacaaattcgattgcgtgcgtcacatgtccaccttgatttaacgtgtgcccttcacatgtaagcatttcttgtaggaaacgacaagatctcggcaactattcactgaatttggaagaaatgcacacacaacaaagaagccattgtgagcgcacagataaggagcggacagagaagtagccaagcacgagaaacatcatcaacatactttatcttcttgtatttctggtggcacttnnntgtgaagaaatgtacacggtgattgctaggaagggagttgagtgggagtaagacaaaggaatttgtgaacaaatttaaattttgaagggaaagacctttcagttcaataaaaaaaaaaaa

SEQ ID NO: 80630 - DNA, 650 bp, Triticum aestivum
  unsure (1)..(650): unsure at all n locations
  Clone ID: PAT_TA_80630
ccacgcgtccgctttcctctctcgcccgatcgatccgtcctctcccacgccgctctcatgccctaactcagattcatcctatgcggctctgaaatccaccaccccttatcggccgtcagcgcggacggcttctccgccgctcacgctcgtcgccggcatcgccgccccgtctaactcatcgcgtgtctgctgtctccaccccatccgcaaccttggacactgatttctcagtgttgggaaatatgctgcaaagtaagagagctggtgatgctctaacagaaaatctcgcagaaagctccgaaaagaataggagaatctgcactggcggagcagagacacttgatttgttgatttcaggttacatacattcagatgtcaattcggaagagccgattgacagctttagtgactctagccgaagtgtttggagtgagctcagtaaagaagtcacttcaaaaatttctagaaatgttgtctcccttgctttgtcagatggacatgcggtgttatttgcatgctcnnncatagccttgcgaagcgggcggtatgtgacaagctttctgacctcagcaagtttggttagagctttcaatgatattaacannnnnnnnnnntataccttgaaaatcgaagtgcgtcgcaacggnnnn

SEQ ID NO: 80631 - DNA, 533 bp, Triticum aestivum
  unsure (1)..(533): unsure at all n locations
  Clone ID: PAT_TA_80631
ccacgcgtccgcccgttcttctccccgctcccccgccccgcctctgcctctgccctgcacgccacagcacccatcttcccagcgcccgtcacccacctccacggacggacgggcgcccgtcgccatcgccatcgccttttccccctccctccctgcctccgacgataagtacgcagtctcttgcaagggacgcccgaccccgagttcccaccggcaccccctcgctcccttccggtccgtcccggcagattggttcctgcgcgaattgctgggggctgcagggagggacaagcccgctcgctcactcgcggccctgggcgttgagtgcgcatttggagggcgaggtcttgtgttgccggcgggggatggggatggatcaggcggaggaggggcggaggatggcgagcctgcaagcggcgcggagcgcactgcgggcgggggtggagcggtcgcgggcgctgnnccacacgctggcgcggnngggggccagnnncggggagatccnnncgcggctggcggtcannnnngccggg

SEQ ID NO: 80632 - DNA, 489 bp, Triticum aestivum
  unsure (1)..(489): unsure at all n locations
  Clone ID: PAT_TA_80632
ccacgcgtccggnnatcgcgagcggtgccctctcctctcgctccgctccgccactccccgtcccctccccgacagcgcgctccgtccgtcccgccatccaatgccgacgccaggcgcacgatccctcatcctcctcccgctcctcgtcctcctcctgctctccgccggcgccgccaatgccgcgacggaggccgaggcgctgctggcctggaaggccagcctcgaccgcccgctcccggacgcgctctccacctgggccaagcccgcgggcctgtgctcttcctggaagggcgtgtgctgcgacgccgccggccgcgtggactcgctcgcgctccgggggctgggcctcgccggcacgctcgacaagctcgacgccgcggcgctcccggccctcgccgcgctcnnnntcaacgggaacaacttcatcggcgccatcccagcgggcctctcgcgcctgcgctnnntcgccacgctcnnncncnggagcaa

SEQ ID NO: 80633 - DNA, 609 bp, Triticum aestivum
  unsure (1)..(609): unsure at all n locations
  Clone ID: PAT_TA_80633
ccacgcgtccgtgcatacgcagccggcggatgcagtgaggcggatgcagtgaggcttcgtggtagcctttgagcgacatggtgggactggggggaagccctcctcgacaagttcgcctacatggtccacaagaaagaccaccaaaaaaaccatacttccgcccgctgtacattcaagaggaatttgcacgacgacagggtggtggaggtggagatgcaggtcagcctgttcttggcgccgccgcctcgcgtctcctacttctgctgctccgccaacctcaccgaagacgaccacggggaacaacaaggcacccgccgcctgttcgtctgcgagccttgggtgatcgccacggagggtaaccttgccctcctcgccctctgccacggctacaaccctgcctactacggcgaaagcaataactacgactacttcctctacgaggcagcagcctcaccggcggggacgccgaaactcacctgcctccctcaaatccaacccgagatgttgccagctatgggaactcactgcttctctaccggcagtattgctgtcgtgcgttacagcnncaacatccccaccnnngccacaannnnnnnnnnnnnnnnnccc

SEQ ID NO: 80634 - DNA, 643 bp, Triticum aestivum
  unsure (1)..(643): unsure at all n locations
  Clone ID: PAT_TA_80634
ccacgcgtccgcatttgacgccgaacgtatcagattccacaccaccacactcctgtcgcctatgctgccatacgcgacggcggcggaagcggaagcggcgctgggccgcgccatgacgcgcgccgaggcggcctggctctgctactccgcgtccatgcccgaccacctgctctactgccacaacgtcgccatcctcctcctcctctacaccctcgcgccgctccccctcgcgctgctcgagctccgcgctcgcgctgctccggacggcgtcgccgccgccgtgatgaggccgtccacgtacaagctgcagccgcgggcgcacctctcgcccgctgcgttcctgcgctgctacctggacaccggccgcgtcctgctcctcaccgtcgggacgctcagcctcgtctcctacccggccgtcaagatggtcggcatccggacggggctgccgctgccgtcggccggggaggtggcggcgcagatgctggtctacctgctggtggaagactacctcggctactggatccacnnnctgctgcacaccaggtggggctacgacaacatccaccgcgtccaccacgagttcacggcgcccttcggctacgccgcgccctacgcgcactnnnnccnnnntcctcatcctcgn

SEQ ID NO: 80635 - DNA, 549 bp, Triticum aestivum
  unsure (1)..(549): unsure at all n locations
  Clone ID: PAT_TA_80635
ccacgcgtccgcatcattgaagagctaaggcaacatttgaaaaagaagaggtacctgatagttgtcgatgatgtgtgggatcaaccaacatgggataccatcaagtgtgcttttccagaagatattaatggaagtagagtagtagttacaacacgagtggaagatgtggctgcagcagcctgtcagaatgacggcgagggcatctacaaaatgcaacccctgagtgagcaaaactcaagaatgttattgttgaatagagtattcgggtccaaaaatgattgtccaccccaattgaaagaagttatggctgagattttgaagaagtgccatggattgccacttgcagttatcacaatagctagcctattagccaataaagaaccgtcaaggaagggttgggacagcataagggattctttcggtacccagcttgccacaaatcccaccttggaagagatgaagagtatattaaacttgagctacatgcatcttcctgctcatctgcgggcatgcnnnnngtactttggtatgtatcccgnnnacagtgac

SEQ ID NO: 80636 - DNA, 585 bp, Triticum aestivum
  unsure (1)..(585): unsure at all n locations
  Clone ID: PAT_TA_80636
ccacgcgtccgcgctgcggcannnnngaagaacaaagagtaaacaaagagacaagcaagcaagcagntccactgcgacagtggctgctgcggggcactgtattttactactcctggtagnagatttgaatcgagtccaggtccaacactgacaggagcctgcccgagagagaaaccggccacgggaagacaccaaccccacctccccctctctcgcctcacctttcaaaccactccactccgccgcaaccctccatctttcccggcgccggcgtcacgcttcctctcgagctaccgttgcggcggccatggctgacaagccccccgtcgtcgtcgtcgtcgtcgtcttcctcccgctgctcggcctctgctcctgcgccaatgtgcacattgtgtacatgggggagctgcacccggagctggtccgggactcgcaccacggcatgctcgccgccgtcctcggcagcaagcaggcggccgnnnacgccatcctctacagctacaggcacggcttctccggcttcgccgccgtgctcaccaacgcgcnnnnngcgcagctctccgattggcctnnnnttgtgcgggt

SEQ ID NO: 80637 - DNA, 659 bp, Triticum aestivum
  unsure (1)..(659): unsure at all n locations
  Clone ID: PAT_TA_80637
ccacgcgtccgggtgaatagaagcctgatcctgcctgtggagaagaaaggaaagaatgtcatatatgcttgccgtgttcatgatatggtacttgatacaatttgttggttatcgaaggaagaaaattttgttaccatagtggatggtaatgggaaatactcatcttcagaaagcaatgttcgtaggttggctgtccaaacaagagaggaagagcagggcaaccatttggccaacacaagaatgccaaaattaaagtcatgttatgccagcatctgtcataaaagtatgatgccaccacttttgagctttcaagtgttacgtgttctagacatgaaaaactgcatatttctggaaaactgtcatcttaagcatcttggaaggttacaccaattgagatacttgagtctggagaacacaaaaatcgatataggagatttaaagtttctgcagacactagacttgaggaactcctggatacaagaattgcctcagggtactagtttgctaaagcaacttaagtgcctgcgtgttgacagcaagcgcttgcgcaatcatagaattgaacattttggtatagaagtgacgaattggatagggaacctgataacccttgnnnagctatctttgaaaattagtggcgaaatttctaccttcgttnn

SEQ ID NO: 80638 - DNA, 461 bp, Triticum aestivum
  unsure (1)..(461): unsure at all n locations
  Clone ID: PAT_TA_80638
aaaaaaaaaaaaaaggaaggcccccccccccttggggaaaaaaatttttgggttttttgggacaaaaaaaaaaaacttggtttccttttttaaaaacccggcccaccaaaaaaaaaccaaaacttgtttaaaaaaaaaaacccacttttttttcccctttaaaaaaaaaatcccccccccgaaaaaaaaaaccggccttttgtttccaaaaaaaaccctttaagggggggaaaaaacggggccccatttcccccaggggaaaagggttttccaaggacccccaaatttcacccncccaaaaaaaccccccgggggccnagaccaaaaaaagaagaggccccggggggggcccaaacccccccccgggttttaaaaaaccccggggaattggcccgccggaaatccccgggtttaacanttaaaactnggccaagggttnaaaaatttgggggggaccccnn

SEQ ID NO: 80639 - DNA, 527 bp, Triticum aestivum
  unsure (1)..(527): unsure at all n locations
  Clone ID: PAT_TA_80639
agcagcttaacaatatcatcatatcaaatatagtgaagtatgtttttttgaagactagtacacctgaatacgtcaaaatagataagagatacagtgatgaactgctgatgttcagggggctatagtttggcatttgaatgctagaaacttaaaaagactagtgatgtagtcttgcattactcttcaacagtaaagactggttccatatgcaaagaacaacatgatccatttctagtgattacgagcacactttgttttacccctgacacttcacaaaaatgtcagaaataaccccatccttaaaaagatatactcagtacaggggcatttccaataggaaatcatgtcatgaacatgaagttgatcaccaactgntgttcaatcaccaaaagtcaccgcaagaacaatttccatccttaaaatgggggaaacgnnttgcatcacgcataacaatctctctctcanctatctttgaaataaattttgttaccnnnnnnnagtcaacacaaattcgannntttttcatc

SEQ ID NO: 80640 - DNA, 565 bp, Triticum aestivum
  unsure (1)..(565): unsure at all n locations
  Clone ID: PAT_TA_80640
ccacgcgtccgtaaaagtatcagaaggaatcgaactcggcggcggcggcggcggcggcgatgggcaaggcgaaggggaagcagcggcaggacgagtactaccacctcgccaaggagcagggctaccggagccgggcggccttcaagctgcagcagcccgacgaccgcttccggttcctcccggcggcgcacgccgtgctcgacctctgcgcggcgccggggggctggatgcaagtggccgttgcccgcgcccccgtcggcgccttcgtcgtcggcgtcgacctcgtgcccatccgccccgtccgcggcgcgcactccctcacggaggacatcaccaccaccaagtgccgctccgccgtgcggaggctcatggactccaagggggtcgccgccttcgacgtcgtcctccatgacggctcgcccaacgtcggcggcgcgtgggcgcnnnnnnccaccgcgcagtccgcgctcgtcatcgacgccgttcgcctggccaccgtgttcctcgcccccannngcaccttcatcaccnnnntcttcnnnnctcnnnnntacagtgctatcat

SEQ ID NO: 80641 - DNA, 646 bp, Triticum aestivum
  unsure (1)..(646): unsure at all n locations
  Clone ID: PAT_TA_80641
ccacgcgtccgattccttttctttgaagtgtaaaaatgaagttaatatgaagtgtgaggggacaagaaaacaacacttgctctaactgaatttctttgctccatagatatcagtgatggacactttgctctaactgaatttcacattttcacaatttgtgatggatacacacagaaatagagctgaatattgctcatgtacacttggccatggcattcagttaactgaatatttctactacagcagggctcagaaacaatagtgtgcctcacagcatttggatttgaacatgaatttcttagattgatttgctttgatatgatataaggaaatagttgtctgcgcgtatactaannccttttttggtcaatgagttggacccacaatacctgcttcatgatcacagcaaagtatatgaggttgcctcaccgtaccgactggccatggaattcagttcagtttcagtccgagttacggtggctgacagcttctttgccttgctgcctgcgttttccgcccgatggcggattcacgctcgccccttgtcgcgtccaaccnngccgtcgnacgtcgatcgagcgccatgggccgtctgcaactgcaactgcangnnnnntgctgccgtcctcgacacgacgacaccgnn

SEQ ID NO: 80642 - DNA, 643 bp, Triticum aestivum
  unsure (1)..(643): unsure at all n locations
  Clone ID: PAT_TA_80642
ccacgcgtccgccccccnnttatatactccaccaaccagcctcttctccatctcaaaaaccccaacgccggcaacgccgctccaaaaccccaatctctcggccggcggcgaccgcgcctccgtcctccgcgggcgcttcctcgcgcatcggcttcgtctccctgggcggttggcgtaagagagtttgtcggcgctccgccgctgggtaacctcgagacgaggcctggctgtccagatccccgtccccgcttcgaatccctcgcgctggttaatttttgtactgaagactgaagaggatggcatcttcaaaggtttgcaaggaaagatttgatgctgctgtcacatatctgggtgctattggaattcagagagaaactgtttcaccagtgttgacgaatctactagacttgtatgatcacaactgggaatttatagaagctgatcactttcgggttctaaccgatgccatattcgacgagccagatcccaaagaagaacagcaaaggcaagctaacaagaggatgaatcctgattcggatcactgtaaaaagaagcttaagataaaacatcattctcgaaaacctacatccnnnnngcgtgtcaatgagaagncngnnntgacnnnnngtncactgcagcaaga

SEQ ID NO: 80643 - DNA, 476 bp, Triticum aestivum
  unsure (1)..(476): unsure at all n locations
  Clone ID: PAT_TA_80643
ccacgcgtccgaaatcgttctctaaaacatgaggttaatatagctaggtacagcaagaagaagatgaagacaaagatcagatccatcaagaacaagctaattattgctacatatgaaaagaagcaaaacgctatgggctggttcgtcttaacaaggtacatgcatggattatctgatcatatatccaacgtaacggtgttgaatatgtcatctgggaaaggacccatagataagattatcaatgaccctcttatcaacatagagaagaaaagaagctaagagccatcannatgggtttttagaacctgggcctttcaatctatgttgtattctgctccttttgcttaccgtagctgcagaagctagatgcaattgtataattagctttctctttaaaccaagacttgccaaagctatgtgtgtaagaagtaatggtaccatttaatatattcctatatgaacgatgtagcnnnnnn

SEQ ID NO: 80644 - DNA, 626 bp, Triticum aestivum
  unsure (1)..(626): unsure at all n locations
  Clone ID: PAT_TA_80644
ccacgcgtccgactgaataaaaggtatgtcaaaccaaatggtgtctcgggtcctagcatacctgtttgtgaatccacttggtatcttatagtttcaatacggcattttaaatctcaatttggaaatctatagctaaccgcaatctgattttatagttaaagaatgctgttattatatttacatgtcggtagcattagtcttccatgtggtgttggtcaactgatcaagaaatattaaattagggatcccattatattatagagacttgggttggatacaatataacaggaactgatattgcttaagcttgcataggctatacgctgctttcatgtttggcgggagtttggctgacagattcatagctgaaagtaaagctgcctagagacagatctgttttgattaatggcgtgcaatattgtgccttaaattaacatcatgtccactattggtggggattgaacacctagttctgtaaaaatgttcaaggttctgatgcacggactaaggggtatggcaaaggcaccttttagtcttaactctagggcctctaaacgttgtaaatttagataggcaactatcttactcgagcatgactccttatgaaggtttagntcaatataann

SEQ ID NO: 80645 - DNA, 651 bp, Triticum aestivum
  unsure (1)..(651): unsure at all n locations
  Clone ID: PAT_TA_80645
ccacgcgtccgaaatctcggagccgatcacgtgacccatcggccagcgacgtaataatcccgcagtcgacccacaagctgccggcgacgaaatcccaaactcgatcccgcgacctaccggccggcgactcccgccggcgcccttggtacgatggccgaagacgatgttgactggacacaaatctttgacagggtcaaaggatccatcttctccatccggttcgttccgaagcaagacaatcttgaacaactccaagtcttggctgatggggtgaagacagttaaagatgaagagttgcggcggaacaagctcaggaaaggacatgcttcaactggtttcgtctactactctagaccaaccggcctgctaatcatgactagtgcacacggtttgaaccatcttttcgacgcttctcgacctttgacactagagacactgggcatgatggatataactgttctatgcgatcatcaagaagaagttattcaggaagccagattggttaatgctgtcaggaaatatgccactgcaagggcagngggggttaattcaaataaagacacaattgttctcagtgttgacagcatcaacctcaagaattactcggatgatggcgtatgcgnnnangcacanncnnncattgacatctnn

SEQ ID NO: 80646 - DNA, 505 bp, Triticum aestivum
  unsure (1)..(505): unsure at all n locations
  Clone ID: PAT_TA_80646
ccacgcgtccgaagcagtcgagtaggcgggcgccagcagcggcagcagcacggggaggagggagggagtaggagtaggcggaaaaaggaggcgtaagcgcgagggggacggaggcggagagagggacgcgcggatcaaacgcccgcccgcccgcccgcgcgcaccaccggcagctcgagccctcggttcctccgccccgccgcgccggaggaggaggtggtggtggaggaggggcgcgcggctggcggcctccctcccgatccggatcgagcgggcgctctccggagcggcggatctccccctcccgcggcgagagtggaggctccagtggctgtacatatagtttcagatcagcgatcatcagttctagaataggctgacccctgatcatttaggctgcatttgcggagaatgtcagagagcaatatcgatggcatagagatatctgtcagtaatgacgagaggagggacagagcggatgccgagaactcnnnnnatgagccaa

SEQ ID NO: 80647 - DNA, 543 bp, Triticum aestivum
  unsure (1)..(543): unsure at all n locations
  Clone ID: PAT_TA_80647
ccacgcgtccggggattctccgcctgggtgggttgtgcgtgctggaactggaagaaggccgagaaggccccggcggccaagaagcccaaggccgagaagcggctgccggcgggcaagaccgcctccaaggagggcggcgagaagaggggccggaagaagggcaagaagagcgtcgagacgtacaagatctacatcttcaaggtgctcaagcaggtgcaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccccggcgagctcgccaagcacgccgtctccgagggcaccaaggccgtcaccaagttcacctcctcttagattgccatgtttgcgtctcannaactgtagttggctgccgtgtatctaaaactggtggaatgctgatttttggtttgattgctgaaaaaaaaaaaa

SEQ ID NO: 80648 - DNA, 639 bp, Triticum aestivum
  unsure (1)..(639): unsure at all n locations
  Clone ID: PAT_TA_80648
ccacgcgtccgggcctccacggcacccacgccgccgtctccctcctgccccccgacgcagcccacgcggcggcgccgccacaaccccacccattgtccactcgacgggccaggattccaagtgctcactcgcgtcgaaaccccaagcctaatccccaatccggcaattccccctccacctcaaagctctccccttacctcacctaaatcctggcagatggctccggcgatgccgaagcagcgcgcggtgcatctccccgacaacgaggaggttgcgcgcctcctcctggagaagcaccggtcgatgctggaaaaagacatcccagacaacctgagcctcacgctctccaacgcctaccgcaacgtctgcgccgccaaggagcccatccggaccctcaaggacctgctaaagatcannngtgttggaccatgggtcatccgtctcataaaagagtcctttccagcgtccagcccagatttatctcctccaaaatgtaaagagnannggaaaagggggannnnnntaaaaagaccagagcatagtcctgaacttgtttgcagcaattctgcttctatggcatcccaagaactgatacagttgaccantnnngnncagctcagttacagttctgaagnnnna

SEQ ID NO: 80649 - DNA, 657 bp, Triticum aestivum
  unsure (1)..(657): unsure at all n locations
  Clone ID: PAT_TA_80649
ccacgcgtccgcacaccacagcgccgccgccgccgccaactccgattccgggaggctccggtggactcccaacccactgctcacggatctccccgactccctctatgttctcccccgatacttcgcacccgtccaccgcgcccctgcacgcacgccacgcaacaaccctagtcgccaggcgtcgccggcgtggctccggtagctctggtttatcagccaactaccactgcatcacctcacgcgcagcagccggctcgggattgacattgatttatctactacactagtgcattgcaataaagagaaatccatgaatatgcagaagaagccttgggaattatttaagtcagttgtttatagcatggtgaggatcctttcgatagttcatgttgttcatattaatgtaaggaaaacatgaatttgtatcgtattctattttttcggttgatatttttccccctgaccaaaagttacattagtttcagcttcttattcagtaaaaatgggcatactgcaatctcgaattttatgcaaaatctcagatggaaataattcttacactcatgttatccaaataatttataaaatctgannntgagttacaagaacaccataccttgatattctcatcatatgtatatgactcgtactcttgnn

SEQ ID NO: 80650 - DNA, 602 bp, Triticum aestivum
  unsure (1)..(602): unsure at all n locations
  Clone ID: PAT_TA_80650
ccacgcgtccgcatttccttcgtgccgtccgcctccgccgtctcgtctacccctcgccaccctccccacctcccgaggaccgcagccgcggagcccctcgcccgtctcccatggcggcctctctcctccacgccgccgcctcctccccgctcgcggggcccagcccggccgcccgcgcggccttccgccccctcgcttcctctccattcctgcgcctcgcgcgctcctcccccgaccgccgtgcccgactggacgccccgctccgggcgctctcgggcggcgctcgcctcgccgccccccgttctcgtcgcttcgtcgccgccctcgcgggggaggagccgatgagttcagaattgggtgatgacaaggaaaaggaaacggaaaagattgaaatagagcccgnnnaggcccnnnaagtgtggagggaaatgctcaagcagttcaaggccgaagccatccgaatgcaggccctgacaacgcanncatacgatgtctactccaagagggcgagggaggtgctgttagaggcctcggagaagctaaagatccaggcagataaagcacaaaaggacctgaccatcatcgctgcnnnnnntggtgnn

SEQ ID NO: 80651 - DNA, 475 bp, Triticum aestivum
  unsure (1)..(475): unsure at all n locations
  Clone ID: PAT_TA_80651
gctaatgatggtcccaccagnttaacagtaaatacaaaggacgggccaacttcctgtccagaaatgagtactggcttgcagcaattacctcaaaatgtggaatctgccacttctcagacatctaatgcaaatgttccaattgctgacaagaccaaggaggcgtgcaaagaagcagaaagagaattggctacaacatttgaagagaatggcagtgtaaatagaatggaagggaaagactctagagaaaggagatcaaaggcagaaccaaagcatcaacattgtcatctggagaagagtgacagtgctacttctcagacatcttatgaaaatgttcctggtgttgacaagaccaaagaggtgtgcagagaagcagaaagagaattacccacagaaagacgtacaacgtttcaagaagagaaaagcagggtaaatacaatggaatggaaatctcagcgtttttaccaaaaaaaaaaaa

SEQ ID NO: 80652 - DNA, 562 bp, Triticum aestivum
  unsure (1)..(562): unsure at all n locations
  Clone ID: PAT_TA_80652
ccacgcgtccgcgnnnnnngtgataaaccgcatgtcttcatggctggtgatcgtgtccacccacagtcagacgccatctactcgtacttggagaagctaactacaaagatgatcgaggctgggtaccgacccgacacggaggcagcattgtacgacgtcgaggaggaagagaaggagcatatggtgaaagtgcacagcgagaagctggccatcgcctttggattgctcaatacggaacctgggacagagatcaggatcatcaagaaccttaaggtgtgcctggattgccataacgccaccaagattatttccaaggtgacacagaggctgattgtggttagggatgcgtcgaggtttcaccatttcagagatggagtttgctcctgtggcgattactggtgattcactgggatttgctctgatctcttaacagatgattagtcgattctttagaggtaatcctctctggagagcatttgctgagctcaaataatttgtaaccctcgggtgccaattttatgctaattttttttaaannnnnnnnnnaaaaaaaaaaaaaaaa

SEQ ID NO: 80653 - DNA, 641 bp, Triticum aestivum
  unsure (1)..(641): unsure at all n locations
  Clone ID: PAT_TA_80653
ccacgcgtccggtgcaggttctagcagatgatctcctggaagaaaactaagcttagctcaaatcagttccatccaaactttatatattgttaaggtatgcccgacacgtacttgtctagcatgtcattcttgaagcgggtgcagttctggcgttatacttattttgccaatctgtgcatattttttactgagggaggctacattgtgttagtgtatcaaaatgaacccctccatgtcatcgttatcaccaaggtgccagcagcaaccatctccaacaacgaggctcttattatggccgggttatggccagttgctttaatgtatcttttggagataaaatgacagatcattcagcactgatggcttttcataattaaagacatgacaatctcatggagagaactaggcttagctcacatcagtttgcatccaagctttggatatatcaaggcttgcttggcactgtacttgtctagcgggtcattctcaataaaaaaagtgggtgcaactttggtgctctactcatcttgccaagttgtgcgcatgatttcacttacaatgcagtttcattggttcaacaggaccatcattgcattactctgaccnnnnnnatgctcatcgccagcagtannnnntaccat

SEQ ID NO: 80654 - DNA, 655 bp, Triticum aestivum
  Clone ID: PAT_TA_80654
ccacgcgtccgattgcaagtcgccatttgacttgcaaactgggttttttgtatagttgtagtcatgccaattgcaagtctatcaatgactcacaactcagctcgtagtttttgtttcacgccacttgcaagtcaaccctcgacttgcaactggggtttttatatagttttaatcgccctagttgcaagtctaccatctactcgcaactcggacccgtagttctttgtttcatgtcacttgcaagtcgaccctcgactctcaactaggtttttttgtagtcgtagtcaccctagttgcaagtgcaccatcgactcccaactcggcttgtacttttttgtttcatgccacttgcaagttgaccctcgacttgcaattggggtattttttgtagttgtagtcatgccctgttgcaagtccaccatcaactcgcaactcggcttgtagtttttgtttcacgtcacttgcaagtcgaccctcgacttacaactgaggtttaatgtagtttataatcaccccagttgcatgtctaccatcgactcggacccgtagttacatgccacttgcaagtcaccctttgacttgcaaactcggttttttgtgtagttgtagtcacgccagttgcaagtccaccaacgactcgcaactcgactcgtag

SEQ ID NO: 80655 - DNA, 643 bp, Triticum aestivum
  unsure (1)..(643): unsure at all n locations
  Clone ID: PAT_TA_80655
ccacgcgtccgtttaatctggttaagagtaagttgcactttgttattctgggatgaacgatggtttggcaatgctattggttcttcatgagttcagaggaggatttctgatattattttattgttaaatagacatgacagtaagattcttgtatctgttcgccgtgaggagcaatggagcattgcacacttatgtgtactgctacctgattatcgttggtcttttgtataaaggccttgctataattttgtatggtccttccctaaggtgctatttggatcatctggttttttatacagagcccgcttctcgaaggtgctaaccaggccaacaaaaagggctcacctgctaatannntttgaaaatcctcttagtggtcaatagaggtgtattcaggcccaaaacttacagagctgtgacaagaagtgtggtcaacataggtgtatttaaccaaactaatgtgatcttattttaaattttgctcgagnttaaattttcacagagatctaattaagatttattaaatcgctgttatattatatgttggtttgttcctttatactccaaaaggaaaacnntatgagtaaaaaaactatgtcaatgaattgnnnnntcagttngnnnnccttttattgcactcatt

SEQ ID NO: 80656 - DNA, 575 bp, Triticum aestivum
  unsure (1)..(575): unsure at all n locations
  Clone ID: PAT_TA_80656
ccacgcgtccgggccgcggcagccccccaccacggtacgaccgaggaggaggcagaggtgggtatgatgatgaccggcaccacggcaggcatcgtgcttcagattggcctgattctagatttggggcaccgaatgatggtcctgggaatacccaaaggttttcatcgagtcggacatgattccatttttaaagtgtagttggacagttccaagtatttgttttcatcatgtcgggatctcggaaatatttgctggaggaagtactgcagtactgatagaggctctttctcttaatttagatcactttgttgggcttctttcaaaatcacatccatgctattgatggtgtgatttctctattttttgcttatttagtactcgccactcctctctaattgcctgttggttatctcatttttccctttttctgttgagcaattttttctattgctgtggtnnnccggaatcagttttttgtttaaatcgtagatgaatagtcagttctacatatatgtaacatatgctatttttgttgcctcatattaacatgggaatcaaggaagtttctgnnnnnn

SEQ ID NO: 80657 - DNA, 211 bp, Triticum aestivum
  unsure (1)..(211): unsure at all n locations
  Clone ID: PAT_TA_80657
ccacgcgtccgggggggggggggggcaaacccccaaatgacccanttttgtttcaaataatccaattttttancgtaccgccggcccaatttgggctagggttattcctgctttggtaaactgctacgtgttgacatgttgtttctactttggggggggggttttttattgttaacaggctggggttttaaccggatttaaaaaaaaaaaa

SEQ ID NO: 80658 - DNA, 462 bp, Triticum aestivum
  unsure (1)..(462): unsure at all n locations
  Clone ID: PAT_TA_80658
ccacgcgtccggacctgtgtcctgcatgtgtcacctacgggctatgacaaagtagaaggataaattggctaagtcacaattggaggaatggtttggaagcatcaatttgaataaagaaaatggcaaagtgattgtcaaacctacgagagctggatcaagcatcggtgtagttgtcgcttatggtgctaatgaggcagctgagaaagccgagggaatattttcagagggaattgatgataaggttatcatcgaagtttttcttgaagggggctgtgagtttacagccattgttcttgatgttgggacagctaataatagtgagcctatcgttttgcttccaacggaagttgagcttcagtcatcaatttctagtgatattcnnnnnnntacaatatttaactcccgtnnnnaataccttccaactcaacnnnntgcttatcatacaccnnnacggtttccgnc

SEQ ID NO: 80659 - DNA, 614 bp, Triticum aestivum
  unsure (1)..(614): unsure at all n locations
  Clone ID: PAT_TA_80659
ccacgcgtccggcaacggatgtacatgccagtcccgagctagtcgaagaagaggcagcaccagtggcagaagattgcacggttgtttcatcagtggatgagcagcagaacgatgtccagcagtgtgagcagtctccagtcgccctgaatgttgttgatcaggaaggccatttcccggctgaaactgtctccagcgaggggccactggacgtggagattcatcatgccggtgaggccgctgaggaagccgaggatcatctgtccactgaagagactgaaatggtgcccatggaagcgccggaatccggtgaggccactgaggaagatgaggataatcagtccactgaagagactgaaatgatgatgcccgtggaagagaccgctgaggaagttgaggagattcagctgtccagtgaagagactgaaatggtgcccgttgaggaagctgaggaggttcatcattccagtgaagagacagaaatggtgcccgttgaagaagctgagaagattcatcagtccagtgaagagacagaaatggtgcccgtcgccgagtnnncggctcnnnccacaccggtgccgcnnnnnnctgatgtggaagttggtttcacctgccat

SEQ ID NO: 80660 - DNA, 590 bp, Triticum aestivum
  unsure (1)..(590): unsure at all n locations
  Clone ID: PAT_TA_80660
ccacgcgtccgtaaggggcttttctgcactttatacaatggggatgtacagaaaggaactatacacatctaacaggggttacatgggttagcaccctatcagtgaacatcccagtcaatgggaaggactaccctgaggcccaatgcgccggcttgtgcccaacatttggcttcggccttaatcctatctacaagtgtgtgaaccgaggggcgcgcattctcgaagacgcactcattccgctgcttccaaatactccctctgttccataatactcgtcgcggttttagttcaaatttgaactaaaaccgtgacaagtattatggaacggagggagtaatattcttttgagggaaataaataagtggttgctatgcattacataaattaaacatatggcactttaataatgcataccacttatgcccaaaggaatgaaaaagggcagagttagttggtatagctccctccgtgacaagtattatggaacggagggagtaatattcttttgnnngaaataaataagtggttgctatgcattacataaattaaacatatggcacnnnaataatgcataccacttatgcccaann

SEQ ID NO: 80661 - DNA, 646 bp, Triticum aestivum
  unsure (1)..(646): unsure at all n locations
  Clone ID: PAT_TA_80661
ccacgcgtccgacggaaccgnnctgnncggcactcgcgaccgagcaaaccctaacttgctgaccattcttcgatggccaacccctctatggcggccggcggcggggtgccgtgggcggagggggcccgcgccgtcggggcccagatccgcaaccgcctccgcgtggcgcccgtcgaccgccgctggctctggcgccgccccgagggccgcgccgcctccgaggccgtgcgccagtggtccgaccgcctccgcgccatcctgcagcgggacaagcagaaccagggacccgaccagcagcaaggccccggttccccggacgccagcgccgccgcggcggcgaagccctcctctagcgccttcaagttctacaggaagaaagtgggcaaagaagttaacggggtcgaagactccgtgattttccgctcgctccaagcgctggccgttcctcttatcgggaatgcttgccatgtttttatgcatggccttaactctgtccagatttatggtgcagagaaacttcagcaggcgttacaagagaggcctaaagacaagcctctgctaacggtcagcaatcacgtggctgctatggatgacccttttgtgattgcctcccttctgccaccatctgttatgttggaagcacaaa

SEQ ID NO: 80662 - DNA, 642 bp, Triticum aestivum
  unsure (1)..(642): unsure at all n locations
  Clone ID: PAT_TA_80662
ccacgcgtccggcataatgagccaaggttctcccgccgcgacggggtccggttcaaggacagcagaaccggcccatgggcagcccggggactcctcctccaacgccgccgccgccgccgcctcctcctcgctgccgcctctcccccctgcagcgcccctccagcggccccgagaagagcgggacggcaagcaggcaggaagctcgagctccgccgcggcgggggtcgaccggaagggcaagaatctcccctccgcacccgcagttccttcttcggagtcttcatcttcgagctccgggggcagcagccccgaggacgccgacgccgcggcctccggagcccggccgttcgacagcactgtggtgttccagcagctggtacgggagcagacggccatcannnaggcgggcgggccgttggccgagggggcgggcaagaagannnagccggaggaggcgcaggtgaaatcgtcgcacgtcatagcggagctctggcacaatcttataaagttttttcttggagaagaatggcactattcagaacatgtgaattaccagncacatcccatcactgaagtcanaanngtattatcgggttcctgatttggctannnnacaaggagtggaccatcttgatgcctatt

SEQ ID NO: 80663 - DNA, 651 bp, Triticum aestivum
  unsure (1)..(651): unsure at all n locations
  Clone ID: PAT_TA_80663
ccacgcgtccgatatgttctgatggaaaacgtcgtagacattctaaaatttgcagatggattcctggggcgatatgcgcttagtcgtcttgtctccatgagataccaagctaggcttggattgatggttgcaggatgttatgggttacctcaatttaagatgcgggcctttctgtggggagctcttccttctcgggttctcccaaaattcccgcttccgacccatgatgttgttaagcgaggagtcgtacccaatgcattttcgcaatgtctcgttgcatacgatgaaatagacgacaaacgtttaaagaaagctcttgtccttcaagatgcactatctgatttaccaaaggttccaaactatcaacctaatgatctcatggaaaatcgcattaaccccaaaacagagttccagcgctacatccggctcagccgtaaagacatggaggattactcatttggagatgctactcctagtcctaaggcatgtcaactgtttgatcatcaaccgctagagttaagcactgatgattatcaaagagtgaagcaaattccttttagaaagggggccaacttccgtgatttgnnnnntgtccaggttggggaaaataacactnnngagtttaatccacacattcctcgtgtgtttctg

SEQ ID NO: 80664 - DNA, 629 bp, Triticum aestivum
  unsure (1)..(629): unsure at all n locations
  Clone ID: PAT_TA_80664
ccacnnnntccgaaaaacgccaccacatctttggcaacttgcaggtcaacatcgtgccaccttccaaaggcgtggtgtccattaatttgacttgacaacaaacgggcctcgtattctacgttaggcggcgaacaaaggttcagcaggatagtaattatagataacaaaagaaaaaaaaggcacaagcccgtgatctactattggtaatactattttgttgttgacgtgacgagcttatggatgaataaaccatcaggctgtgacattgacaacatttgagcaaacttgaatttaacgggtgctactagagcaaacatccttgtggttatgttatgccagttagtagagtatttgttttggttatttgttgagccgttgagggagccgtagagtgcttttggcagccagttgctattactaggaaaatttccacacacacaaaagaaaaatttccacccggtttaaattcccacggagagcagaagaaacaaagggaagctggaccctgtggcccatacggcggtctctttcgtgtactcgccgctatcatttgtnnngcctggctgtcgtttgatcttatcttatcttgtactnnnnagatgcactaannnagtagcatcnnnnnnnnn

SEQ ID NO: 80665 - DNA, 632 bp, Triticum aestivum
  unsure (1)..(632): unsure at all n locations
  Clone ID: PAT_TA_80665
ccacgcgtccggttataagctttcacgcctaatagttctcctcacgttactccttgccactgccggcagcttccgcggtggccaccatgcagttcctccaatataccctctctatatgtattcataaaactcgcacacatttcacatttttttttactttaaacatgataaaagtaagtatgatttatcttccacataaagtatattgtcggtctcataaatatgagttatattccacacagagtatttaagttaaagacaatccaaatggtatggcttttatagcatgttactcatatagtatcaatctgattgatggtcgaaatataatattgaaggcctagtttggcagcacggttctaaaaaaaacctgtagtacactaaatctacggcattccagtgcatggacaatgaagactccggtttttataaaccgtaattttcctcatttttgccaaaactatcgaagcatctgggtggcgttgctttgctggcgctgtggttctttactgatagttacgcatggatgacagctgaactacctnnnnngctccacggcttgatcaatcagcatgtggtaactcggctacacggaaggngctacacgannagntnaatcnncgtgtgannnn

SEQ ID NO: 80666 - DNA, 364 bp, Triticum aestivum
  unsure (1)..(364): unsure at all n locations
  Clone ID: PAT_TA_80666
gcgccaaaaggngacaaatatttgggccaacaaccntacaaaattcccaattatcaatggttatgggccctggattatattctgaacaaacgcgggaaacccaaaacaaaacaaaaatagcgctttcaacactttacaaaatttattcttccatctctggacatttataaacacaaatgtcccccaaatgcctccaaaaagggggcaccttcaagcaagcgaaaaacgctcctaattaattcccttgggctttttgccgtcggggccggacttaaccttgtcgggcgcattcttttcctgttcgaactttttcttgaactttttctggctcttccttttcattttttggatgtaaannttctcc

SEQ ID NO: 80667 - DNA, 615 bp, Triticum aestivum
  unsure (1)..(615): unsure at all n locations
  Clone ID: PAT_TA_80667
ccacgcgtccgcccaaaagcctccctactttttatgctgcctccctgccctgcgagccggagccgtgccaacatccgatcggcaccagctgcactttgcacgttccaaagccgacgcgtgccgttcggccatcgtctcaccgtcaccaccagttgagcaggaccaggccgggttcagtccacccggccctgcctgccttccctcgcctgccccgaacgccaccgtaaaaccctaccgccgtcgccaaccagggcacggcaccccaccatttcacaccacacctccccaccaacatacgccgcgcacgaaccaccgccaccgcgccgagccagcctagcctagatggcgtcggccacgtcgcccacgccgccgtgggtcatcctgggcagcgtgccgcgggtgctctcggccgccgccgcagccgcatccctcccgccgggcccgggcagcgccgacttctccctcgagctgccgccgcccccgcgcgtcgcgctcctcaccatcccgccgcgcatcttcccgtcccgccccactcgcgccagctacccctgcgtcctcgccgccgactcctccgcgggccnnnnnntcctcnacgccgaccagggccacgccacg

SEQ ID NO: 80668 - DNA, 620 bp, Triticum aestivum
  unsure (1)..(620): unsure at all n locations
  Clone ID: PAT_TA_80668
ccacgcggnnnnnacnctgtaagtcgcaccagtaacatgtctggtgacaaattggtgactaagattcttcagctcatggaaggagggagatctctagtagtcctcgatgggctgtcagcagacgaagaatgggatcaggtgaagtcgtgcttatgggatgatggtaatgctaaacatagctgcactatagtcgttaccacgacaaatgctgcagttgctcattattgttcagggaataaagacactctatgcaagttggatcctcttgacagcgccgcagtccgtcaattgttctatcacaaggtatttaagcgtgatgggctaattgagttgcataaaccaatgnnngatcttgctgatcacatcataaaaaaatgtgatggggacctttgtgcaatcactatcataagtggacttctaggcaccaaaactcggacatcagaagcatggaacagcgtgctagaacgttatgactcagagttaagaaataaacctgaccgggttgctacagcagcagcaaaattgagctatgttgatttacnntcccatatgaaatatttgctacaatatattagnatttttctgannnnctacagcataacgcgcnnnnnnnnggcaag

SEQ ID NO: 80669 - DNA, 663 bp, Triticum aestivum
  unsure (1)..(663): unsure at all n locations
  Clone ID: PAT_TA_80669
ccacgcgtccggcgccccgctcacgtcgaccacggcggcggcggaagaagaagaagaagcgtggtcggcgacggcctggaccagggcggccacctcccgctctcgcatggcgccgtggcggtgcgaccgggcggcgctgaggacgtgctcggagcagagccggcggacgtggcgccagtgctcgccgtggggcgcgaagacgaggtcgcggaagccgcccatggcgcgcggcggggggcgtcacccgcgccatgctcgcgcgcgcccgcgccaccgccagcttccgcctcgtcgtcctgaacggccgcgcgttcgtgcagcggttccgcccggcgttccagacgcgcgacctcttcactatctgggggattctccagctgctccgccgctaccccggccgcgtccccgacctcgacctcatgttcgactgcgtcgactggcccgtcgtccgcacgcacctctaccgcggggagcacgccctcttcatgccgccgctgttccggtactgcggggatgacaggacgctcgacatcgtcttcccagattggtcattctggggctggcccgagatcaacataaaaccatgggatgccctgcataaagatttgannnatggtaatagtaaagtaagatggtncagtagagagccttatgcttactgnn

SEQ ID NO: 80670 - DNA, 670 bp, Triticum aestivum
  unsure (1)..(670): unsure at all n locations
  Clone ID: PAT_TA_80670
ccacgcgtccgtgcagatgcttgtgcataacaggtatccaagtgcagttgcagaaaaagtactttctcaagaatcagggaaaagctnnnttgtcnnnnttccaannnnaaaaaatgattttggatctggttccgatcatgctaaggctcatggttctggctgcctcagtggagatatgcatcatcatgttttgaaggatggggagttgcagaaggataaacaagacaatgaatgctcaaaaaatgatgattccgaacttggtacaaggaatggtctgctgaatccagtaaaggtacagaaagttaattcacatgtcctttcaatacgtggcaatggtgatgacaaactgccaccatcccttcaaaacgggaaaacatcacctcatcttaattcaaaccaatgtgaccatgcaaagttgacttctgggaaacatccagtacaggttaagcctgataaaggggatgcagaacagaaggatatgaaaacaaatccatcaactgttaaaggaagcaagcagcatccagcattaaatgattcatcaaatggcgatctttcgtacaaggcaaagcaactaaagnnnnctgttctcgaaaatacaaaacaagcaactcttagtcgtgatgctttgaatccagtaaacacatctgtgctactgnnnnnnnctcgggat

SEQ ID NO: 80671 - DNA, 666 bp, Triticum aestivum
  unsure (1)..(666): unsure at all n locations
  Clone ID: PAT_TA_80671
ccacgcgtccgaacttctttaatggcaagggcaaaaagcagaacaagaagcccaacaatccatgaatttagtatgcatgtcacacaaatatgcatcctcgtgttgaggcagtactagtttatgttcagttttccatgcttccaactaatactaattctgttcctagatcaatctttccatgcttcttactcaaggagcttcctagtaagatgtgtcatgttgagataacaggcttttcatgcttcctactaaaggagcttccaaataattttacatatgcttcttctgtctagatagtttgcttccatacttcaacatttttggtatctagttgacacaaacattcatccccatgttggtagcaatcttacttaatttctatttccaaatttctatgcttcaaaataagactagttatgttaagataacacattttcatgcttcgtgctgtcagggcttccaaattatactccatatgctcctttggttacatagaatgcttccatactttctgcttcatctttcatagaatgttgtannnngccatgcccatattatattaaccgtgtctctgtggtatacaaagttttcttacatagtctttgtttctacttttgtgtgtgattctaatgttttattatttttcaacaccattttaatcaannn

SEQ ID NO: 80672 - DNA, 623 bp, Triticum aestivum
  unsure (1)..(623): unsure at all n locations
  Clone ID: PAT_TA_80672
ccacgcgtccgatcccagcaagcgtgcctttgcctactttgttctgagtggtgggagattcgtatatgcatcactgctgcgtctccttgtcttgaagtttgtcttgagcatgtcagcaagtaaggatgtgcttgcacttgcttcccttgaggttgatctatccagcattgaacccggtagcacagtgactgtcaagtggcgtggaaagccagtcttcatcaggcgacggacagacgatgacatcaagctggccaacagcgtggatgttgcatccctgcgccacccagagcaagacgctgagcgtgtgaagaacccagagtggctggtggttattggtgtctgcactcatcttggttgcattccccttcccaactctggagactttggtggctggttctgcccgtgccatggctcccactatgacatctctggcagaatccgcaagggccctgccccgtacaaccttgaggtgcccacctacagtttcttggaagataacaagatgctcataggctaagagcctaaaaccagtacctaccgacatatattatccacaggagtgaattcctgttgcgctgttattttgttttcaatgtggctaggagtttttgtttcnnnnctat

SEQ ID NO: 80673 - DNA, 638 bp, Triticum aestivum
  unsure (1)..(638): unsure at all n locations
  Clone ID: PAT_TA_80673
ccacgcgtccggatgaccaccgtggtgggagcggtgctggttatgggggaagaggccaagagaacccagactccttctgcgaggacgacacccccagtctggccacttcaagtgaagaagaggaagaagagtaaggactagactagtatcttgttgtcggcttatatattccctatgtttgatactttctcattattacatatagctgatataatgttgtctcttaatgattatctggtgtcgtttacacatttggtgggatgctaatcagtaaatgttccagtttattatttatgtcaaagtttgagctagaatgtgcttaatgctccaatgtaactgcttggagtggagagaagatatcatgtgtctttctcttgcactgatatctgactatccgctacaaagtaaataggatgcagttgatgctttcctgcaaaagcaaaacctgccaacatagaagccagtgcatcttctgataatctgatggaatcgtgaggatacggacaaccagccataatagggattagcagtgatgaggaacttgtggcttatacacagatcttatttctcagtacacacttagcatgttggtttctgttgcttcctgatgtcagaactttacagaaatcagntcgcga

SEQ ID NO: 80674 - DNA, 470 bp, Triticum aestivum
  unsure (1)..(470): unsure at all n locations
  Clone ID: PAT_TA_80674
ccacgcgtccgcaaggccgtggtgttccatgacggccgtctcgcgttccggccaaccgctggcagcacgctcgccatgttcatgtggctgcccttcggcgttgcacttgcctccgcccgcctcaccatcgcgctcaccgtgccatatcgatattccacgccgatcctggcggccaccggcatgtcatggcggctcaaggccggcgatgggccaccgctgcagaccgctggcgtcgagcgaggttgccggcgcgggcagctgtttgtgtgcaaccaccgcaccctcctcgacccggtgtacgtgtcagtggcgctggaccgaccggtgcgcgccgtgtcgtatagcctcagccggctctcggagctcatctcaccaatcggccgcaccgtgcggctgacacgagaccgcgacgccgacggacgtgccatggcccgactnnnnnnnngggggggnnnnnnnnnnntcgtctg

SEQ ID NO: 80675 - DNA, 652 bp, Triticum aestivum
  Clone ID: PAT_TA_80675
ccacgcgtccgaataaaacggagttttcagacccattccatgccacggaccttccgagcaacattgatacgtgtactttcttgggacagaaggcagacaagaagaaagaagataactttgactctctcaagaaatcaaatgcagacatatttcattctgcgagttctgtaaatgaaactgtggttggtcaacacactacatgttctcagcagtctggcaaggattcacgaaggcaagggtttgatcctggtattgattttcaagagtccagactacattcattctgggaagatggccatgttagtgatgacacttttcagggcgatactgagctgagtagtctgttggcaagaaaaaatgatgagaagaataaaggcgggattgagaggctcgagaagccagaaacaaagacgtcgacacaaagatctaaaccttctggagatttcagaaatgagatgagtgaagctgaaacatgttctgatggctcggaagtgaccaactatcctggggtgcagaatggaaaatcagcagcagcagcaacacaacttcctgcaaacttgtgtcttgaggaaacctcaagaggaatgttccaaattcatgctcaagttgattgtgtaaaaacaatagaaaatcccggtgttgactttgaagc

SEQ ID NO: 80676 - DNA, 633 bp, Triticum aestivum
  unsure (1)..(633): unsure at all n locations
  Clone ID: PAT_TA_80676
ccacgcgtccggtcgggcagctggtggtctcccttggtgcggcgctggcgaaagagacagctatctttggcggggcactgctcggcaaggaagccgccgccctcaggggcctcttcggcaagatccgcgactccaaggtggagctggagagcatgcaggcctacctgcaggaggcggagcggttcaaggacaccgacaagaccacagccatttttgtcggcgaggtcaagggcttcgccttccagatcgaggatgtcgttgacgagttcacctacaagctggaggagtgcaagcacggagggttcgctggcaagatgaagaagaggctcaagcatatcaaaacctggcaccgcctagcagccaagctccaagaaatcaaagcccagctgaaagatgccaagaggaggaagcaggattacgccgtcactggcagatttgcttcttctgccagatcgataaatcaaggtcaagctcttcacttcaccagggatgaggaccttgtggggatagaggagaacagggacaggttgatacggtggctgaccatcggcggttgtagtggtcatggtctagcgcagagcagcagcannnttacctcggtgtgggggatgcctggtgttggtaaaaccactn

SEQ ID NO: 80677 - DNA, 213 bp, Triticum aestivum
  Clone ID: PAT_TA_80677
ccacgcgtccgatggagaacaaatggtcgtctctctcacagaaggcatggattccatttgcttaatgagctttttgcatcggggcaaagagtgataatcgagaggaagagcctatggattatgggtatagttggtgtgctctgacctgatctccatcggggcaaagagtgataatcgagaggaagagcctatggaactagttctagatcgcga

SEQ ID NO: 80678 - DNA, 248 bp, Triticum aestivum
  unsure (1)..(248): unsure at all n locations
  Clone ID: PAT_TA_80678
ccacgcgtccgctgagctttcagagaagaccttagccgactttagtcagatagttgattattgtgagagctctagctgcttgcaagcatcacatgttgatagctttggagaannaggacnnncaactttatgccaacgcacatgtgatgcttgcaagcacccaaatcaagtgtccttgcgttgggaggaccttctgcgagtgcccaactctcgctctaacaaaatatctccnnnnttcaaaagctcat

SEQ ID NO: 80679 - DNA, 236 bp, Triticum aestivum
  unsure (1)..(236): unsure at all n locations
  Clone ID: PAT_TA_80679
ccacgcgtccgnnaatacactttattcaactcgcactttgcataggaggctaagatgtgcattgaaaacacaaaagctggtgatgccaaatacccatacaggcatgtacatttttttcttttgcattcctcttgataacatgcatatcttacacaaaagcttgtatttgatgcaaagntctaacagctgcatctacgtcatnnntnnnncgannntgacagnnnatttgggtcatg

SEQ ID NO: 80680 - DNA, 359 bp, Triticum aestivum
  unsure (1)..(359): unsure at all n locations
  Clone ID: PAT_TA_80680
ccacgcgtccgcttttgattcatgtacccaggagaaattttctcttcgagctgcactattatggactttgaatgattttccagcattagcttacctctatgggtggagcacgagcggtaaatatgcttgcccgtcttgtggtcctttcacaagatcatattggctaaagaagagtaagaaattttgttatatgggtcatcgccgacggctaacacagaatcatgtatttcggagacgaaagaaggagtttgataacaccaaagagatggaacttgcacctataacaatgagtggtagctcagctttgagaatgttgtaaggcagagtgtttgtcttaagaaaaaaggtttttgtggcnn

SEQ ID NO: 80681 - DNA, 598 bp, Triticum aestivum
  unsure (1)..(598): unsure at all n locations
  Clone ID: PAT_TA_80681
ccacgcgtccgctnnntaccaatatgannaaaaaatgcgactgtggtcactcatccgtcnngcacttttgctggtggaataagtacatagcgacaccaatattgtatggatccgngnnntttgagggcagannnaccatgactcttctcaannnnnaagtcttgaaaggcatagtgttanngcggacaaaaatnngccgagctgcagntcttgctcttccaccaaagactgtgacattgaagcgggactcttttgatagaaatgaaatggaattttatgaagccttatatactcaaagctgcacgcagtttgattcgtatgttgttgctggaacgttgctgaacaactatgcacatatctttgacctcctcacgaagttgagacannctgtcgatcatccataccttgttgcattttccaagacagcagaatctcgggaaggatgcaaaaatcaacaaaatggtgccatggaaagccagtgtggaatatgtcatgaattggcagannntgtggnnnnnacatcttgtgatcatgtattctgcangacntgtttgatggagtactctgcaactttggggaatgtnncatgnnnatcttg

SEQ ID NO: 80682 - DNA, 189 bp, Triticum aestivum
  unsure (1)..(189): unsure at all n locations
  Clone ID: PAT_TA_80682
ccacgcgtccggtgtaattgactattcattactgtattaaatacagcattataaacatataaacaatgcggcaaaattatacaaatgtgtgcattactttctttagatgctgtagcccctttactgttgctgttgcatgattgcatatctttagttnnnattgcannnnnngaccaaaatattttgtga

SEQ ID NO: 80683 - DNA, 650 bp, Triticum aestivum
  unsure (1)..(650): unsure at all n locations
  Clone ID: PAT_TA_80683
ccacgcgtccgccaagcccatcgggctccgcgagcccaagtactccccgttcggccccggtcgcctcgaccgcccctggaccggcctgtgcgcgcccgccgtcgacaccacgctccggagcgtcgacgccgaggaccctgcccccgccgccgaganngacctggaggaggcccgccggcgtgagcgagagcgcgtgcttggcgagccgctcacacccgcggagcgctccttcttggtcgacaaatgccagaagaaccgcaccaagaggcagatcaatctcgggcgagatgggctcactcataacatgctgaatgacattcacaaccactggaagcatggcgaggcggtcagggtgaaatgccttggtgtgccgacggttgatatgcaaaatgtgtgccatgagctcgaggataaaactggtggccttatcatccacaggcatggtggccagttaatactgtacagagggaggcattatcatccaaagaaaagacctgttattccgttgatgttatggaagccagctgaaccgatctacccaaggctaattaaaacaacaatagannntctgacagttcnnnagacaaaggaaatgnnnaagaagggcctacatgctcctgtcttgacaaagcttgcaaagaatgggtann

SEQ ID NO: 80684 - DNA, 653 bp, Triticum aestivum
  unsure (1)..(653): unsure at all n locations
  Clone ID: PAT_TA_80684
ccacgcgtccgatacacaatgcagatcctggcagttgacaagctggtttcggtccaggttgctgagaacacagctcaagacgtggctgggaatcccaatctgccatcagaccgcctccaagtgagacactattctgtccctgcatcgtcttcatcaatcgcaaccatcgccactgtaatatttgcagcaaccgccatcgtcgccacactgctcaccgtctccacatcatcgctcattgcatccggcgccatggcaaggccttcgtcttactccatctccgagccatcacgaaatcttctgagaatggcatgccacatccagatcttcgctctgtcgagatggctgtcgataaatttgccggtggagtactacgagctggccaaggggatagagtggacaattccgtacattcggcttccgtgggagggtccctctgcagatccattcgtgggctactccaccatgccggccattgcgtactcggagctggtggacaggagtgatgtagtacaggctgatccctactaccctggagctgcaccaggtggtcagcagcagcagattatgccgatgcagatacctgtagannggaagcccccggcgaccccgctgcagatcccggcattggatgggaagccgctgacagccatgnn

SEQ ID NO: 80685 - DNA, 652 bp, Triticum aestivum
  unsure (1)..(652): unsure at all n locations
  Clone ID: PAT_TA_80685
ccacgcgtccgaagttgtgccagactgccagtcccatgactttggataattcattgtaattgccttttgatgtaaggtgtaattgtatagatgttgcatttgtgacaacatacgacatgtgggtagtagcgtgtcctaagctattcaaagttattgtgttcaaggaaaaattaagcgcaaggtgttaggtggccaactttgcctctgcctagcacctagcttgcctaaattttgcctttccctagggcattctgtacggacatggcagaatgggcttgcctaaatttgccttgattttgttggtaaagtctacttattcttttcccgaataaagtacccttggatcgttctattctgttctattttccatgtagaattacctaccattttagcttacagaaattctttagctgctatgttctaagttctacctccaaactaataacaagtttatatttggccacactaaatcaaatgtctttcattttgtgttcaccgtattgcatgttcttacattgctggattgttgatcttcaaagtaacttccacatgttgaaagaaaataactcaacacttgggggaagaatcccaatagcattttttnnntcgataaaacaccctgaacaccggcttcactggctanggcagtgnn

SEQ ID NO: 80686 - DNA, 628 bp, Triticum aestivum
  unsure (1)..(628): unsure at all n locations
  Clone ID: PAT_TA_80686
ccacgcgtccgaaccaattgattttgatttcataccacaagagtcagttgctgcacaaaatcaacatattactctgaatctgaatctggtctgaagaaaatgtgctcttcactctgaatgaatgaatgaatgaatgaaccctggtatgtatggtagagcccatggcagcaagagcaatccccttcccatgctggctcatcttgctgctgctgctgccgctgtcgcacgccgccaccggcgatttcacccactgcggcggctgcgacgacgccgacgagggcagcctgtggagcaccgacaacatcctgcagtgccagaaagtcagcgacttcctcatcgccaccgcctacttctccatcccgctcgagctgctctacttcaccacctgctccgacctcttccccctcaagtggatcgtcctgcagttcggcgccttcatcgtgctctgcggcctcacccacctcatcaacgtcttcacctacgagccccactccttccacctcgtcctcgccctcaccgtcgccaagttcctcaccgccctcgtctccttcgccaccgccatcacgctgctcaccctcataccgcagctgctcnnnntcannntcnnngagaacttcctcnnnatcan

SEQ ID NO: 80687 - DNA, 195 bp, Triticum aestivum
  unsure (1)..(195): unsure at all n locations
  Clone ID: PAT_TA_80687
ccacgcgtccgaatccctagcacttccctcctccgccgccttcatgccgtccggacgccgccgccgccgccgcnnnnggcgagcacnnnnntctgcgcctttcccgccgaccngcctgccatgttacatgccacatcttcccttggctacttctaagccgccgccttggaggccannnntgacctgcacttctcc

SEQ ID NO: 80688 - DNA, 381 bp, Triticum aestivum
  unsure (1)..(381): unsure at all n locations
  Clone ID: PAT_TA_80688
gggccaaccccaaaaaaacccaaaccttttttagacccttccaaccccccaacccccaatccctgttccaaccaaaaaaagaccccttaaatttccaaaacccccccccccaaacccccgggtggcctttcccccaaaaaaaccccccatggggcctgccccacaaaccatcctggtgaaagggggaaaaaccaccccccttgaatggccgggccccttctgggggaaaaacgggaacccaccccttttcaaaaaaaggggggttttccctttttgaaattttggttcccccccgggtggtgggaaaaacccccccttgggaagcccaaaaacggccggaacccccccccttaaaaaaacccccccctgcggttgggntnc

SEQ ID NO: 80689 - DNA, 347 bp, Triticum aestivum
  unsure (1)..(347): unsure at all n locations
  Clone ID: PAT_TA_80689
attaaacccgggctagggtaacttaactgggttggcttttggaaccggggcttatggacatgggttttgcttcatgcaagggcccccctgggaaaatttgatctggtacggccccctggaacgggaactggggggggcggggggaataacggggcccttcccggggaaaaaaaaacctaaacgggttgaaaaacccccccaaaactgggggttttggaaaaagcccgtgttcccccgcgggccccccttgccgggcaggntaaacgggccccccccggggttgaacgacttgtccatggagcccatcccgggcttgtccaacctccgcccggggnnnnccnnttttt

SEQ ID NO: 80690 - DNA, 570 bp, Triticum aestivum
  unsure (1)..(570): unsure at all n locations
  Clone ID: PAT_TA_80690
gcacaactctatttgttactcattcccaggttctcattttcccaggtttttagactcagttcttcaagctcttatgtgaaatgtgatcacatgggagatcagaataaaacatacctcccgctcacggctccttgcaattcatgacaagccaattggttttaaattttcggttaaactatcttgatggtttcttaaggctaaagatctcctcttctttgaggcgctgttgaaaccttgctaagcgtgcctggagactgaccaagccggacgccttccgtgacaggagaaaattcagttgtgccacataattgtcaataaggctacctggttggtcaacatctgctaatannttcatctcttcccgcactatttccatagtattttcaatttcctttctgtgagctgctatcaatgcctcctcttcctcaagtattgcatttatttcctcatcacacgaactttccttttcagattgtctcgatgaaacctgtgatgccgaagtagacggtggtctttgctgctgctgtttcagttgctgtttgtgaacaatccgatttacatctgccccnn

SEQ ID NO: 80691 - DNA, 645 bp, Triticum aestivum
  unsure (1)..(645): unsure at all n locations
  Clone ID: PAT_TA_80691
cgaaaaaanngagaacagacacagcgctccggtcgccggccgcaacgcctgccatcctcctcgacagcggcggcagccatctcatcgtcttcccctccccgcgtccaatcccaccctcccatctcctttcccctagcagccgccgcatagaacacagatccgactcccctcccctcccccgccatggaaatttggatctagacctccccctcgtcatctcctccccgcccacagcacggtcgggcggcagatactcacgatggatggatacgcaatcatctcctctgatcaggaacaaccagtaatcggtgcagattggagttcaagggcactgtcagatgaactggtgatacatgcaaactcagcggacctttcactgcagcttgctgaagaacaaagccagttacatgatattatgggaatcaatgaaatgccaattaatgacatanncagtgcaagtgattcagacggcagctctgggaatgagacagataaagaaccaggaaagtacttctatcctggttttgnnnagttggttaatccaagaccaccagaagttggaatgagattcccaacccttgaagatgcgacccgatactatagtgcacatgctctcctgtcnnnnnnngtggcaattaagggacn

SEQ ID NO: 80692 - DNA, 385 bp, Triticum aestivum
  unsure (1)..(385): unsure at all n locations
  Clone ID: PAT_TA_80692
gaaacccaacaaggggccaacaaaattttggctgaaggcaaaaggacccttcggggggaaaaaaattggggggttgaaccccaaaccaaaaaacctggtcctcccggggggggttcatcggggggggtcccccaaaccaaaaaaaatcccaatcaaggtccaattggtttccccccccaaaaaaagggaccgggggcccccctaacctttttttttgaaaccaccntccctgggggggccttgggcccccgccctgaccccaccctgggggggggaagggccaaaaaaattgggttattttttctggaggggggccccctttaaaaatttaacccccgcgggccccaaacnnggcctaacccccccgtccaaaaggggaccccgg

SEQ ID NO: 80693 - DNA, 651 bp, Triticum aestivum
  unsure (1)..(651): unsure at all n locations
  Clone ID: PAT_TA_80693
ccacgcgtccgctcaaaactccttccaccgccgctgctccccttcttcccctctcggttcgaagcaccagggtgggtagggttcctctcgaggggctagggttttttcgaccgcggcgatggcggaggggttcgcggaggagggccgccggggcgaggagccggagtcggtgaccccggcggcggcggctgggtcccaggggctcgaggacagccggctgctgcggtcgcggtacctcgccgtcaagagccagatcaacgacgagaaggatgaaatggcgagtgcggactccgtcaagttccagtccgtcatttcgcaggtggagagcctgcacgtacatgttcataagcccagggagcaggtagctgatgcagaggcattgctggacattgccagcagtttggcagcatctgtaaggtcccagtcagcactaggaatcacgccttctcatttagttgccgcactcctcaacaagtttgggacacaaggagatgccgatggtgagggtgcctcgttgagatggtctgctgttgggcttgctgcgtctcatgtcttcatggctgtgcctggatgctgcaccatgtttggtcccatgacgacagaagtgaagcnnnggagaacacataccantannaaannnactgcnnnnnn

SEQ ID NO: 80694 - DNA, 648 bp, Triticum aestivum
  unsure (1)..(648): unsure at all n locations
  Clone ID: PAT_TA_80694
ccacgcgtccgaatgatccagcacgcactggaccaatcagtgatccaccagtaatcggagcaatgacagatattgcattgattggacctgcgcgacccatcggagcatatacggggcttggacttgaattcagtcctgccaggactacaaacggaggagaagggagaagacgcaaccagaggacgatcaacgagaggggagcaattgttgagtcatgggaggtggatagttataatgatgagccaagttttcatcgcaaggaaattgctggggagtgggaaggtcagaagatacaaatatcttatatgattgtgcctgatacagtggaagccagaatcaaggtgaagctactgctcgcaggaggaagccgctatcatgtgacaggtttcataaaggcatgggatgacaacatgggacacgaatttgtaaggctcttgtcagattcagaccaaacagtggaggtgccctctgaccaatggactccacttcctttgatgatttctctgttgtgtctgagcaatgctgaggaagttcagttgaaagtcgctgcatatctcactttccgttcatgctcgaacagtgaggagcaagcactgaatgtgtctcctgatcaatgcttcaagctcannnnaagagctgnnagncnnn

SEQ ID NO: 80695 - DNA, 651 bp, Triticum aestivum
  unsure (1)..(651): unsure at all n locations
  Clone ID: PAT_TA_80695
ccacgcgtccggctaggtctagtctggaagccagtttcgccaacgaagcagaaattgtttttacaacagtgtcaagcagcgggcgcaggttattttctcgccttagtcatggttttgatatggttgttatcgatgaggctgctcaagccagtgaagttggagtcctccctccacttgcacttggtgccgctagatgtgtcttggtaggtgatccacagcagctccctgccactgttattagtaaagcggctggaactttactctatagcaagagcctttttgagaggtttcagcaggctggttgccctaccattttgttgtcagtgcaatatcggatgcatccccagatccgagagtttccatcacgatacttctatcaaggccgccttacagacagtgaaagtgttgtcaaactgcctgatgagttgtattacaaagatgcattaatggcaccttacatattttatgacatctcacatggtcgtgagtctcatagaggtggatcatcttcataccagaatgttcatgaagctcagtttgcattgcgtttatatgagcatcttcagaagctcgtgaaagttaatggtggtaagaaagcatctgttggtataatcactccatataagttgcagttgaagtgtcttcagcnnn

SEQ ID NO: 80696 - DNA, 628 bp, Triticum aestivum
  unsure (1)..(628): unsure at all n locations
  Clone ID: PAT_TA_80696
ccacgcgtccgcaaaagcagcaggggatatgcaatctgaagaaaattcaaaatcagatggtatctcaagtggacaaaatattagaaaaaggaaacaggttggcaaagctggtgcacaaggtcagccctccaggggagctgagcctgagcaatcacatatactgcaaggtgctactgctcaggtgccacccttacctggtggtgcatcatttttcagggctcaccaggaaggtccaccagcttctgctgggaggactattgacaatactaaaccatcaaacccgttcgcaatgtcacaagtttcaaattttgctgaagggctggcttctggtagtatccccactgagttgcagaaaagtatactgggaggaacaaatatgtttaacactggttttggctggaatcaaagttcacaaggttcagctattaagaatactcaaggttctgttgccaacttaatgcggccaggagttaatgttgaagggaaaattaatgtagggtcacaaggagcttttaaccctactcccacatcgcagatggatttccccaaaatccctccttacatgtcttcttcctttggnnntggctcacagtttctggacnnnnncnnnnactcggcttctggcaat

SEQ ID NO: 80697 - DNA, 642 bp, Triticum aestivum
  unsure (1)..(642): unsure at all n locations
  Clone ID: PAT_TA_80697
ccacgcgtgcgggcatttcaaatcacagctagacccgtatatgataggtgcccttgcagaaattgcgagtggaaggaggctctttgtggatgactatgatcgcaagactaaggagactaagatgggcataatgcaggtgacaccagaagttgctcaatggcttggcagggaactgggttacaagaattatgacattgaacttgaagacaatattgatttgctctactggccttttataaatgtctactttggcgctgcttatgcaaagtggctcttctcatgtgatgaaaaagaaagaactgaagaatttgtcgttagagcttacaagggaggcagaaagaaagctactcacaagtcatctgcccccattttcgaacgttatctttatgtgaaagagaccttgctctctatgagacaaccagacagtttcaatgagctcgctcctgatctcctagaaaattcctcaactgcagctggtatattgggattccaaagtgtcagaggaagatatgggtggaatgtggagtcagcctgacgtgttgaaggagtggacaaattctggcgagcggcgtggaaatgtcagattttcgcatgatgcnnngaagnnnccgtatctttctcgagttgnnntcannnntgttg

SEQ ID NO: 80698 - DNA, 612 bp, Triticum aestivum
  unsure (1)..(612): unsure at all n locations
  Clone ID: PAT_TA_80698
ccacgcgtccggnnagagagggagagagagaggagcagttagttgagacccgaggcggagatggatctgctggagaggagcgcagccaacggcaggtctggaatgttgcgaatgtcgagccctccagcaaatccgggacagcttaccattttttatggtgggtcagtatgtgtgtatgactcagtgccaccagagaaggctcaagcaatcatgctcattgcagcagcagcagctgcggcctcaaaaagcaatggcaccactgctgttaagcctccagcgatgtctgcgaccaatgctatccaagccatgcttacgcggtcgctctcactccagagcacttctgtagcaaatggacaacctcaggctgtcgcggatcctggctcgatttgcaagcttcaggctgatcttcccatcgccaggagacactcccttcagcgcttcctggagaagcgccgtgacagggtggtgagcaaagctccttacggcgccgggaagccatccgaaggcatgggagcatcttctgggatggaagtggtcgcggagggcaaggcccagtaaccatgaaagaagaaagacggccctgcccctgatgtttggnnnnnnnnggcgtgt

SEQ ID NO: 80699 - DNA, 682 bp, Triticum aestivum
  unsure (1)..(682): unsure at all n locations
  Clone ID: PAT_TA_80699
ccacgcgtccgcaccaccaccaccaccccaaccccactgtgtgcgcaaccgatagataagagccgcccgccttgcccgaccacccccctctgactcgaagccgccaccgccgcctgcgacgagcccccaacaccccagaccccgcgaggcgaattcaaatctcgccgggacacgcacgcacgcctccccgccccgacctcggaccccgcggagccctccgggctcgcgcgcgcgcacgccccgtgggcagatcgggttggaggcggcggcaatggcgcctggggccgccgacagggtcgccattggcgtctgcgtcatggagaagaaggtgttctgctccccgatggagcagattctcgagcggctccgcgcgtttggagaattcgagatcataatatttggagataaggttattctcgaggatcctattgagatgtatgtaatgagaactcagttggccaaaatgtgactgcttgattgccttctgttcgtctgggtttcctcttcagaaagctcaggcttatgcagctttacgaagaccatttttagtgaatgaacttgagccgcaatacctccttcatgaccgtagaaaagtatacgagcatcttgagaagtatggaattcctgtaccgaattatgctcttgtcaatagagagtatccataccaagagctagnnnactt

SEQ ID NO: 80700 - DNA, 623 bp, Triticum aestivum
  unsure (1)..(623): unsure at all n locations
  Clone ID: PAT_TA_80700
ccacgcgtccggcgacgcgggaggcgaagaacgacgacggtttctatgccatgcccgatgtgaggctgccgagcgacgcgcggggtgtcgtggccgcggcgagcgctcgtgactgcgagctcgcgtgtatcggggagtgctcctgcaccgcgtactcctacaacggtagctgctggctctggcacggaggcctcgtcaacctccaagacatgagcacgagcagcagcactggcaccggaggcggcagtggcaccatcctcatccggctggctgcgtccgagttcactagcccagggcacaccaagacactaatcattgcactcgtcgccgttgcggcggccgtggccgcagtcaccgttgccgttttcgtgtcagtcttcgttctgaggaggaggaggctgaaggcgcaaaggagagtcgtggaaggttcgctgatgccgttcacgtaccgcgacatgcagtccgtgaccaacaacttctcggacaagctcggcggcggctccttcgggtcggtgttcaaagggtcgctccccgacgcgaccgcgacgctggtcgcggtgaagaagctcganngcgtgcgtcagggggagaagcagttccgcgcgnnngtgagcaccatcggc

SEQ ID NO: 80701 - DNA, 649 bp, Triticum aestivum
  unsure (1)..(649): unsure at all n locations
  Clone ID: PAT_TA_80701
ccacgcgtccgcgccgacacaacactttatacctcttggcgctggatgttgttaagttaggtgacagcaatgtggaagcatatgctcttgctgaggaaaaactgcgacatgtcaaagtgcagctggagccagttgctgctgtgagggatggacttgggttgtttgataaggagctggccgcagattcagcgggttccggcgttggtaacaagcagcactttggtcgacctgagtctgagcacaccatttcacagggatcggatgtgttcccagctgcatcaaagaagcggccggctgggcgccctacaaccagccgtgacaaggctccatatgaacaaccatcaaagaggactaggttttgttcaatatgcagacttcaggggcacaagagcacgacatgccctgcaaggggtgatgtgccaaaggcgccccggaaatctcctcgctgctcaaaatgtggtttgaccgggcataggaagaacacatgcagcaaccccccgaaagtatgaaaattcagaaattttagtgtttttttcgttgttatcctgatggtatgcatttgtctatgtgacccctctgctgttagaagccatacctaatttgaacatctagnaaagcgagggtcgtgcactgtgtctggcactatctg

SEQ ID NO: 80702 - DNA, 282 bp, Triticum aestivum
  unsure (1)..(282): unsure at all n locations
  Clone ID: PAT_TA_80702
ccaagtccaagaccaagacaaggttaatccatggccacgtagtacctctaccctacaactcctattcggctgttcatgtcccctaccgcccttcaccccgacgtacgtagtaccggcacgcccgccaagattagctgtttttaattagagaagaagaagaagaagatgttaattaattaattagttcctcggtcgaccctccttcagtcagtctcgtgtgtgttgatgctgctagcagtgacgagctgtgctcctccttgtaatcgtgctcttgaattnacc

SEQ ID NO: 80703 - DNA, 488 bp, Triticum aestivum
  unsure (1)..(488): unsure at all n locations
  Clone ID: PAT_TA_80703
cctacatagcacagccatggcccccaccgtgatggcctcgtcggccacctccgtcgctcctttccaggggctcaagtccaccgccggcctccccgtcagccgccgctccaacggcgctagctcggcagcgtcacaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtacttgacaatgtggaaactgcctatgttccggtgaaccgacgccaaaaaagtgatcaaacgaagtggaagangtcaagaaggngtaccctgangcgtagttcggattatccgatttnanaaatgggcaaggtncatgcgt

SEQ ID NO: 80704 - DNA, 556 bp, Triticum aestivum
  unsure (1)..(556): unsure at all n locations
  Clone ID: PAT_TA_80704
accataagaatgtacaaatgaaatgttcaactattatgttctttagttgttaaaagttatccgttggtttcatctagctatgaactatggtctggcgaccaaatagccactttaacttgttttggaaagtcttggctaatagttccgtatgaccagtaggtgatgtgacaagttatttatatgattcatttactctgattcaacttgaataattgattgttgtatcaggcaacatctattgatgctgtactgaaggatgctggtttggaaagcaaaatcatggaagtgcctaagaagtcgggttgggatctaaacacatcgtgtctttcctactattggttattgatcctccaagttattaacttatgtaatttcaaaatttctttgaaggcgacgtcactgggaacaacaatgatctgacgatgatttactgcaaccaattggaaaacgcgggataatattgnatgtctcccctctgtttcaggaaaaaacaatgcttattttcntgngttttgntcnatttgagaatctgatgtgaactcaattcctttttcgt

SEQ ID NO: 80705 - DNA, 541 bp, Triticum aestivum
  unsure (1)..(541): unsure at all n locations
  Clone ID: PAT_TA_80705
cggcatcctcctctcctccagttaatagaataccatggcccccgccgtgatggcttcgtcggctaccaccgttgcacccttccaggggctcaagtccacagccggtctccccgtcagccgccgctccagcgccagcctcggcagcgtcanaatggcggaaggatcaggtgcatgcaggtgtggccaattgagggcatcaagaagttcgagaccttgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcccatgtttgggtgcaccgacgccacacaggtgctcaacgaggtggaggaggtcaagaaggagtaccctgangcctatgtncgtgtcatcggttcgacaacttgcgccagtgcagtgcgtcacttcatcgctttnaggcaacgggttgcgaganttc

SEQ ID NO: 80706 - DNA, 444 bp, Triticum aestivum
  Clone ID: PAT_TA_80706
cttccctgactggacgctgcaccccatcttcaatgacgatgacaattgctgttacacggaagacgacgatgaagatgttggtgatgtgctactcgatgggtgcgatggccaccacgacgagccctctgtgatagatgtgatcaggagcaacatggaagtccaggggttggagctcaacatggaggatgagatcgaccaagctgccgatatgttcatcaggaggttccgggagcggatgagcaagagcatttagtcacctgcttgtgtttcatctatacctgattgcacgaatgtgtgccgctgactacttgacagtagatgtcgcgagggagaatgttagattgacaccgtagcatatagtagggggcactaaactagtacacgggtctgaacatgttcgccctactagatcttttccgggcacccacaattttttttttaaaa

SEQ ID NO: 80707 - DNA, 548 bp, Triticum aestivum
  unsure (1)..(548): unsure at all n locations
  Clone ID: PAT_TA_80707
ggcctccccgtcagccgccgctccaacggcgctactcggcagcgtcacaacggtggaaggatcaggtgcatgcaggtgtggcccatcganggnatcaanaanttcnaaacccnntcctacttgccaccgctcagcacggaggtcctccttaagcaggtcgactacctgatccgctccaantgggtgccttgcctcgagttcancaangttgggttcatcttccgtgagcacaacgnatcccctnggnactacgatggccggtantngacaatgtngaanctgcctangttcggatncaccgacgccangcaagtgatcaacgaggtggaggaagtcaagaaggagtaccctgacgcctatgtccgcatcatcggatttcgacaacatgngtcaggtgcagtgcgtcagtttcatncgccttcaaagccaacnggggctgcgaagagttccggcaaggctaaancaggtcacttcacgaaagggcatatataaagtgcnattgcggtttntcnaatctgacattgctttgggttttncttctccatnta

SEQ ID NO: 80708 - DNA, 550 bp, Triticum aestivum
  unsure (1)..(550): unsure at all n locations
  Clone ID: PAT_TA_80708
caagaacggcatcaagttcggcgaggccgtgtggttcaaggccggcgcccagatcttctccgagggcggcctcgactacctgggcaaccccaacctggtgcacgcgcagagcattctcgccatctgggcggttcaggtggtgctcatgggcttcatcgagggttaccgcgttggtggcggccccctcggcgagggcctcgacatcatctacccgggcggcgccttcgacccgcttggcctcgccgacgaccccgacaccgccgccgagctcaaggtcaaggagctcaagaacggccgcctcgccatgttctccatgttcggcttcttcgtgcaggcatcgtcaccgggaaggggccagttgagaacctcttcgaccacgtcgccgacccagtcaacaacaacggcgtggggcttcgccaccaacttcgccccggaagctaaatgtgtttagccatccgtcgtccgtccgtcatcgganagatatgatgtgtaattgtacgtcgtggattaaagtgtaactgcacgtactttgtgtgttaattgtaaccan

SEQ ID NO: 80709 - DNA, 578 bp, Triticum aestivum
  unsure (1)..(578): unsure at all n locations
  Clone ID: PAT_TA_80709
actccgccatggccccagccgtgatggcttcctccgccaccaccgtcgcgcccttccaggggctcaagtcgaccgccggcctccccgtcagccgccgctccggcagcgccgncctcagcagcgtcanaaacggcggaaggatcagatgcatgcaggtgtggccgattgagggcatcaagaagttcgagaccctgtcttacttgccacccctctccactgaggccctcctaaagcaggtcgactacctgatccgctccaagtgggtgccctgcctcgagttcagcaaggttggcttcgtcttccgtgagcacaacagctcccccggctactacgacggtcgatactggacaatgtggaagctgcctatgttcgggtgcaccgaacgcaacgaggtgctcaaacgaggtggaggaggtcaagaaggagtaccctgacgctatgtccgtgtcatcggcttcgacaacatgcgcaagtgagtgcgtcantttcattgcttcangccacaagctgcgangaatctggaaggctaagtgcaagttgaagtaacgatatnatgccatgttagttcactttgtcgg

SEQ ID NO: 80710 - DNA, 573 bp, Triticum aestivum
  Clone ID: PAT_TA_80710
cagcagcagcaggaagttgtgaaaacatagtggatttgaaccggaatcgtctcaaaaagaccaaatacgaggctggcacactaatggcaacttcacgaggtcatccaccaaagcctggcaagagtcgaataggacattatcctgattcaaaagatttgccaagacagttggacatggtggcatacttccaggacgagcctccttgtcagaaaactcactgcactaatgtggcggttgagcagtacaacgcacaacagcagagtgatgataagaagataatgcgtgcagttggagttgacagcaacatgtttatcttggaccagaatgacccggtgagctactggcatgtgtactttaaagcttatgtagggagaaaccggtacaggtgttttgctgagttgagtggggaaaaaggacccgaattgctcagatattgcaccgccgtgaataaagcttctgttgtgttgtgcaagtactgctttggaggaatatatcaccctcccggagtagatttcacgggttcaccacgtcttccactccaaatgtataggcagttcctgcgaaagaaagacc

SEQ ID NO: 80711 - DNA, 581 bp, Triticum aestivum
  unsure (1)..(581): unsure at all n locations
  Clone ID: PAT_TA_80711
ccggcatcctcctctcctccagataatacattaccatggcccccgccgtgatggcttcctcggctaccaccgtcgcacccttccaggggctcaagtccacagccggtctccccgtcggccgccgctccagcggcagcctcagcagcgtcanaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcagcaaggttggcttcgtcttccgtgagcacaacagctcccccgggtactacgacggccgatactggacaatgtggaagctgcctatgttcgggtgcactgacgccacacaggtgctgaacgaggtggaggaggtcaagaaggagtaccctgacgcctatgtccgtgtcatcggctttcgacaacctgcgccaggtgcagtgcgtcantttcaatcgctttaggccaccgggttgcgangagtcggcaaggctaaactaacgagttgaaacaatggcn

SEQ ID NO: 80712 - DNA, 575 bp, Triticum aestivum
  unsure (1)..(575): unsure at all n locations
  Clone ID: PAT_TA_80712
gcagctcatcgagccaacagccggctgaacgctccagtggtacgattagtcggggcttgatgccggaaaggatgaggccgttggctcgctcgacctggccgtttgactgcgggtgggcgacggatgctagatccaaccggatgccttgcgtcgcgtagaaacgtgccaaggctcccttggcgaaattcgtgccattgtcggtgatgatgctgtgtggcacgccgtaccgagttgttatatctgcgataaatgtgatggcagtcggcccattcagcttcttgatcggctttgcttcaacccatttggtgaatttgtccatggcgacaagcagatgtgtcatgccgccgcgcgccgtcttgaatgggcccaccatgtctagtccccaaacggcgaagggccaagtgaggggaatggtcttgagtactgaagccggcatgtgttgcttggagctgaagagttggcaccctttgcaatgtttaactaactcttggcgtcatccaaagcagtcggccaaaagaaacccatggcggaangctttggcgacgagtgatcttgaggccgcatagttggccgca

SEQ ID NO: 80713 - DNA, 574 bp, Triticum aestivum
  unsure (1)..(574): unsure at all n locations
  Clone ID: PAT_TA_80713
cgccggcctccccgtcagccgccgctccaacggcgctactccggcagcgtcacaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgcnacacaagtgatcaacgaggtggaggaggtcaagaaggagtaccctgacgcgtatgtccgcatcatcggattcgacaacatgcgccagntgcagtgcgtcanttcattcgccttnaagccaccgggctgcgaggagtccggcaaggntaaaaagctcactcacgacaggccatatataangtgccattgcagttttgtnaactctganattgctttggggtttccttcnncatttatcttctnatntgtnccnaanaatatgtg

SEQ ID NO: 80714 - DNA, 577 bp, Triticum aestivum
  unsure (1)..(577): unsure at all n locations
  Clone ID: PAT_TA_80714
caagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtngactccctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatnggcatcaacccaattcatgatgaantgccggagagctggaaaattggcaacgccgggagaagccagccaagctcatcagggcagcggtaccgtgaggctgcagacatgttcaagaagggtaantnttgctgc

SEQ ID NO: 80715 - DNA, 542 bp, Triticum aestivum
  unsure (1)..(542): unsure at all n locations
  Clone ID: PAT_TA_80715
ccgtcagccgccgctccaacggcgctagctncggcagcgtcacaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgctatgtccgcatcatcggattcgacaacatgcgtcaggtgcagtgcgtcantttcatcgcttcaagccaccgggctgcgaagagtccgcaaggctaaacagctcattcacgacagggcatatataagtgcattgnagttttgtnaatctgaaattgctttgggtttccctcccaattancttcctaatttgt

SEQ ID NO: 80716 - DNA, 579 bp, Triticum aestivum
  unsure (1)..(579): unsure at all n locations
  Clone ID: PAT_TA_80716
ccggtcngccccgtcagccgccgctccaacggcgctagctcggcagcgtcacaacggtggaangatcaggtgcatgcagtntggcccatcgagggcattaagaagttcgagaccctgtcctacctgccaccgctcagcacggaggccctcctcaagcaggtcgactacctnatccgctccaagtgggtgccttgcctcganttcagcaangntgggttatcttccgggagcacaacgcatcccctgggtactacgatggccggtactggacaatgtggaanctgcctatgttcgggtgcaccgangccacgcaggtgattnaacgaggtggaggaggtcnagaatgatgtaaccctgacgcgtatgtccgcatcatcnggatttcgacaacatgtgccatgtgcngttcgtnantttcatcnccntcaagtcancggggntgcnagnagtccgnnaaggcctaaaanagctcattcaccacgggcnacatataaaggtgccattgcggntttgtnaactctgagnattgcgttgggtttttcctttnccatttanctnncctggtttgttcctaaagnt

SEQ ID NO: 80717 - DNA, 527 bp, Triticum aestivum
  unsure (1)..(527): unsure at all n locations
  Clone ID: PAT_TA_80717
gtcatttctcccttgggggcatcattcttggaggtgcacatgggttcncgggaccggaagacggcgtctttgatggagcggtgcttcatcttacacattgatgatggcggatctcggtggcgtggcgctgtagagactcggcgtctgangcgcggagatggactcgcgcnngaggaggaagctgtctggcgtcatggtggcgttgatggcagagaggcctggcaaggtcggtgcatcagttctgctctgaggatggaccgatggaagatggaggtgacggcccttgcagcgtgcggtgctcactgtgagtgtgccagaccggtgtnggacccattccaggtagttgttggatgggacacccggcttaaatgtagtttggncantttgttngattagccngaaattccgacacttaacaagggatagagnacaaancgttncaaattgtgctcancttattatgatacctggatgtcttgtaatataataatggntcatcatctcacatncaaagcngnaaaaaaaaa

SEQ ID NO: 80718 - DNA, 553 bp, Triticum aestivum
  unsure (1)..(553): unsure at all n locations
  Clone ID: PAT_TA_80718
ctcctagcaagctatatacctacatagcacagccatggcccccaccgtgatgncctcgtcggccacctccgtcgctcctttccaggggctcaagtccaccgccggcctccccgtcagccgccgctccaacggcgctagctcggcagcgtcagaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgcttgcctcgagttcagcaaggttgggttcatcttccgtgagacaacgcatcccctggtatacgatggcggtactggacaatgtggaantgctatgttcgggtnaacgacgcacaaggtgataacgagtgaagagtaagangagtaccctnacgctacgtcccatcatcgattnacantgcgcagtnagtngtanttattgctnnagcacgggttcagaatcngaaagctaaantatacacggccattangncattngtttnaa

SEQ ID NO: 80719 - DNA, 533 bp, Triticum aestivum
  unsure (1)..(533): unsure at all n locations
  Clone ID: PAT_TA_80719
nccgggagctggaggtgatccactgccggtgggccatgctgggcgctctcggctgcgtcttccccgagctgctcgcccgcaacggcgtcaagttcggcgaggccgtgtggttcaaggccggctcccagatcttcagcgagggcggcctcgactacctcggcaaccccagcctcgtccacgcgcagagcatccttgccatctgggcctgccaggtcgtgctcatgggcgccgtcgagggctaccgcgtcgccggcggcccgctcggcgagatcgtcgacccgctctaccccggcggcanttcgaccccctgggcctcgcgatgaccccgaggattcgggantcaangtgaacgaatcaagaacggcgctcgcatgttctcatgttcggttttcgtnaggcatcgnaccggaaggccctcgagaactcgcgacaactcgccgacccgtaaaaaacgctgggcttgcacaatttgnccgcaataactctagtttgngacntcatttgaantatcacgtgagtagactacccatgaa

SEQ ID NO: 80720 - DNA, 254 bp, Triticum aestivum
  unsure (1)..(254): unsure at all n locations
  Clone ID: PAT_TA_80720
gtgactcatctgttnntctcttttaanattccttttnttnttgncatttcaacaaacaggtaatngncttatcagcacactgggcgccgccggcgggctcgccgcccttnctggtcnacgnccatctnanacctggccgccgatntcaagctgccggagctcccctcgccggcccnatntntttctcctcctcctncctccccgatttcccnctctctcaaacangancaactgncattcccncnccatgnata

SEQ ID NO: 80721 - DNA, 486 bp, Triticum aestivum
  unsure (1)..(486): unsure at all n locations
  Clone ID: PAT_TA_80721
cctacatagtacagccatggcccccaccgtgatggcctcgtcggccacctccgtcgctcctttccaggggctcaagtccaccgccggcctccccgtcagccgccgctccaacggcgctagctcggcagcgtcanaacggtggaaggatcaggtgcattcaggtgtggcccatcgagggcatcaagaagttcgagaccctgtcttacctgccaccgctcagcacggaggccctcctcaagcaggtcgactacctgatccgctccaagtgggtgcttgctcgagttcagcaagttgggtcacttccgtgaacacaacnatctcttggtntacgattgccgtanttgacatgttgaacttctatgttcggtcactgacgcaccagtgatnacgagtggagagtnanaaggtnctacgcgttntcgatatcgatttanaattgtagtcanggtaattatgctttaacacggttcaagantcggaagctaa

SEQ ID NO: 80722 - DNA, 201 bp, Triticum aestivum
  unsure (1)..(201): unsure at all n locations
  Clone ID: PAT_TA_80722
ggaancgcaagncttcagggacggcgnctgngaggtgcatcntnnacaagaatncgggaagnngcgtgccctacctgnacagtccagctacaggnngaagtccnaaactcaggctctgaaacagtcgagttggagtgtnccagcatgcatttctcgacagcgccaatagatacacagggatangnngcgtgacctgtcnaa

SEQ ID NO: 80723 - DNA, 554 bp, Triticum aestivum
  unsure (1)..(554): unsure at all n locations
  Clone ID: PAT_TA_80723
ccggcttcgccctcgccacctctgccctcctcgtctccggcgcgagcncggagggggcgcccaagaggctgaccttcgacgagatccagagcaagacctacatggaggtgaagggtaccggcaccgcgaaccagtgcccgaccatcgacggcggcgtcgactccttccccttcaaggccgncaagtacgagatgaanaagttctgcctngagcccacctccttcaccgtcaaggccgagggcatccagaagaacgagccgccggccttccagaagaccaagctcatgacccgtctcacctacacccttgacgagatggaaggcccgtcgaggtcggcgccgacggcaccctcaagttcgaggagaaggacggatcgatacgcggcgtcacgtgnaanttcccggagcgaacggtgccttcctttcacgtaagagtcgcgcaccggaagccagagttagcggncttctgtgcagtaagggtctttcttgaccaaagcgtgngttattgtagaaagcatggtacgcgagagagaagagagattgcagaacntancc

SEQ ID NO: 80724 - DNA, 551 bp, Triticum aestivum
  unsure (1)..(551): unsure at all n locations
  Clone ID: PAT_TA_80724
acggcgctagctcggcagcgtcacaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtngaggaggnaagaaggagtacctgacgctatgtccgcatcatcggattcgcaacatgcgtcaggtnagtngtcacttcatcgcttaagcacggntngagagtcgnaaggctaaacagtactcacgcaggcatnntaaggcattgagttngnaatctaattctttggttctctcattactnctattgtctaagaagggatgcatgtcatgncacatgtnaaaantcncgaggatcangngcattattccg

SEQ ID NO: 80725 - DNA, 487 bp, Triticum aestivum
  unsure (1)..(487): unsure at all n locations
  Clone ID: PAT_TA_80725
gatgcagaggccctagcagctttcaaacacaacatccgcgatgagtggctatcccggcaccttggtcaggaaaagccgaaatctatggcagccctcatgacactgatgacccacttttgtcccggagaagacagctggcgggctcacagtaataacatatcaaagaaccatggtactttggataccaaggacagcaatagcaggtcacgtcgcancaaacataagcnccgcattgacagcgataatactgaagatacggcagtaaatgccgtattcaaangctctaaaccntgtcagcggaaaaagccattcaaacaaagaactttgggccngtccagtttggaccgatatcatagtcgtgccaataacggaccccganaagccagccancacnccaatgggttgttgggtttaagcaggcagcaggtnaatngcggaacaagntaggggccnntaccatgcnagnaggcccgnagcngacatngag

SEQ ID NO: 80726 - DNA, 160 bp, Triticum aestivum
  unsure (1)..(160): unsure at all n locations
  Clone ID: PAT_TA_80726
acttcccaaccaaggncgnagagtgcaggactgaatncgcctcgatacctttcaagtagccagtgcaccatcctcggcncaangaccatgaacntatccctccgagacctcttaacctgcccgttcatcganaggggntntgtccagcgaagccctcaag

SEQ ID NO: 80727 - DNA, 370 bp, Triticum aestivum
  unsure (1)..(370): unsure at all n locations
  Clone ID: PAT_TA_80727
cgacaagctcgctttcctatttgctgtcaaggtttgcacctattaccgcgtgcctctccgggtccaagggtatcttctttgtttccttngccggcttgaacgagccctcaacctccgactcctgggggatgggtgacatttctggcttcttgcctgccaacgccaccacccggtcaaggagccgcttctcagctgcaatcatgagggactcggccagccggctgctatctgcggcacaagcgaccgacttcttgtagtctccgactacggtcaggattcccttggtacttggcgtcttcatcttgaggtaagcatagtgggggataccatgaactttgccaaagtggtcggccaagcagtgcatggtagg

SEQ ID NO: 80728 - DNA, 201 bp, Triticum aestivum
  unsure (1)..(201): unsure at all n locations
  Clone ID: PAT_TA_80728
tttttttttggaaacaaataaaacaatttattcgcagtaagcagatcatatatcaagagttcaccacatgatctcaagtgccatgtgttgcctgntattatntatatantaaaattacttaacttcatttttatcctatgatagccatggttatnantctttattganatcgcaagananaagcaganatacattcccctc

SEQ ID NO: 80729 - DNA, 559 bp, Triticum aestivum
  unsure (1)..(559): unsure at all n locations
  Clone ID: PAT_TA_80729
catccatccgcccctcgctgccgctgcatctcgtctccaccaccccacttgcccccggacccaggaggatcgtcggacatgtcggacaccgatgagcaccacttcgagtccaaggccgactccggcgcctccaagacctaccctcagcaggccggcgccatccgcaagggtggacacatcgtcatcaaggcccgtccctgcaagttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagttatcagtgattgacataactgatgtggtatgtcagctttaatgagatggaaactaaggtactgagttccactgatgatgtctgttggcagataanctggatttctgatggaagactatctgntgtatgtcgcatggtaaacaattggtgtaagaancgtgtggaagnanagttgtgttctactggaacttgtacannttgggttaaaana

SEQ ID NO: 80730 - DNA, 383 bp, Triticum aestivum
  unsure (1)..(383): unsure at all n locations
  Clone ID: PAT_TA_80730
ctctcctccagttnaanagaacaccatggcccccgccgtgacggcntcgtcggcnaccaccgtcgcacccntccaggggctcaagtccacagccggactccccgtcagccgccgcaccagcgccagcctcggcagcgncacaatggcggaaggancaggtgcatgcaggtgtggccaantgagggcatcaagaagtacgagaccttgtcntacttgccacccctcgccacggaagccctcctgaagcaggtcgactaccnganccgctccaantgggtgccctgcctcgagtnagcaaggtggcttcgcttccgtgancacaacagtcccccgggaacnannacggccgaantggacaatgnggaagtnccatnntggggcac

SEQ ID NO: 80731 - DNA, 542 bp, Triticum aestivum
  unsure (1)..(542): unsure at all n locations
  Clone ID: PAT_TA_80731
cccgtcagcngccgctccaacggcgctagctcggcagcgtcacnacggtggaaggatcaggtgcatgcaggtgtngcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtnagcacaacgcatcccctgggtactacgatggccggtactggacaatgtggaagctgcctatgttcggatgcaccgacgccacgcaggtgatcaacgaggtggangaggtcaanaaggagtacctgacgcctatgtccgatcatcggattgacaacatngtaggtnagtngtcanttcatcgcttcaancaccggntncgaggagtcggcagctaanagctactacacaggcatantnagtgcattgagntttaactctgaattnttggttcttctcanaanttctattgtctagatatggagccagtatnnngacatgtga

SEQ ID NO: 80732 - DNA, 583 bp, Triticum aestivum
  unsure (1)..(583): unsure at all n locations
  Clone ID: PAT_TA_80732
gtcagccgccgctccaacggcgctagctcggcagcgtcacaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccnttagcacaacgcatcccctgggtactatgatggccggtactggacaatgtggaagctgcctattttcgggtgcaccgacgccacacaagtgatcaacgaggtggaggaggtcaagaaggagtaccctgacgcgtatgtccgatcatcggattcgacaacatgcgcaggtgagtcgtcanttcatcgcttcaagcaccgggctgcgaggagtcggnaggctaaagtactcacgacaggcatantaagtgcattcagtttgtaactctacattcttggttcttctcattaacttctattgtccnagaatgtgatgncatgtnattacacatgtcagaacatccgataaatctacgtgcattttaagacc

SEQ ID NO: 80733 - DNA, 217 bp, Triticum aestivum
  unsure (1)..(217): unsure at all n locations
  Clone ID: PAT_TA_80733
ccccgtcagcngccgctccaacggcgctagctcggnagagtcancaacggtggaaggatcangtgcatgcaggtatagcccatcgaaggcatcaagaagttcgaaaccctgtactanttgcaaccgctcagcacggaggccctcntnaancaggtcgactacctgaaccgctccaagtaggtgcattgcntcgaatncagcaaggntggnttcatct

SEQ ID NO: 80734 - DNA, 579 bp, Triticum aestivum
  unsure (1)..(579): unsure at all n locations
  Clone ID: PAT_TA_80734
ccgtcagccgccgctccaacggcgctagctcggcagcgtcacaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaactgcctatgttcgggtgcactgacgccacacaggtgatcaacgaggtggaggaggtcaagaaggagtaccctgacgcgtatgtccgcatcatcggattcgacaacatgcgtcaggtgcagtgcgtcanttcatcgcttaagccacgggctgcaggagtccgnaggctaaaagtactcacacaggcataataagtgcattcagtttgtanctctaattctttggttcttctcattaacttctattgtctagaaattgatgncattcattacaaatgtcagaacatccgattatcnacgggcattaatn

SEQ ID NO: 80735 - DNA, 597 bp, Triticum aestivum
  unsure (1)..(597): unsure at all n locations
  Clone ID: PAT_TA_80735
tactgccatttttgtaccccacacaaactctacaacactaaggccaaatttttaatattgatcatttgtgtattttttcttcatgtataatttccagtgctgacagcataaactaatctgatccatcaagcatttataaaataccatgggaatatttcatcaagcaccaccaaactgacaattcttcacttgacactttcaatgcttgtcattgagtgtatgattgtttctaaccgaataagatttgcttttcatccactgcagcttatgataatcttgtaatctacaacctaaattctattattgtttgctttactttcaacttttattgtttactttatctcacttagtgcaatcttcttctgtttagtctgttttctgtcaaacctcacttaacattttatctaaccacacaatttgagagatcccttattagccggcgggataaacacaccatcctcgcgagtcaacagcacacgcacaatgtgctgcggatatgatgcctcctcgtgcgatcagctttcgactgcatcgggacgctttgatggcatgccncttcaaaggtactacaganagttgtaggcactaactctggtg

SEQ ID NO: 80736 - DNA, 316 bp, Triticum aestivum
  unsure (1)..(316): unsure at all n locations
  Clone ID: PAT_TA_80736
gggtggaaaggagtctgctgaatgtgcgctgctttgtaggattaggccaaggcagtggaggcccgcccttgacaccatcttcgaggcttagatcgatcatgattcatggcacccgtctgtagggtagaataggaaatccaattcattcattcgttttgttattttttgttgagtattgatcatccttctttttcaagcaaggagagaaggtattcggttgacgtgtacatttgtattgtaaaccttcaacttatttnggagtagaaggttgtnagagctagaaatagtactaattgtnaaacctaaaaaaaaaaaa

SEQ ID NO: 80737 - DNA, 560 bp, Triticum aestivum
  unsure (1)..(560): unsure at all n locations
  Clone ID: PAT_TA_80737
ctccagcggncagcctcagcagcgtcanaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcagcaaggttggcttcgtcttccgtgagcacaacagctcccccgggtactacgacggccgatactggacaatgtggaagctgcctatgttcgggtgcactgacgccacacaggtgctgaacgaggtggaggaggtcaagaaggagtaccctgacgcctatgtccgtgtcatcggcttcgacaacctgcgccaggtgcagtgcgtcanttcatcgctttaggcaccgggttgcaagagtccggcaaggctaaactacgagttgaaacaatggctatctcgtatgaaggtctttgtgacttcactttgtcaaaatctgctgacganctgcttttgaccgagaacctttgttcnaatatttgtgaagatgacnaaaaaggggg

SEQ ID NO: 80738 - DNA, 562 bp, Triticum aestivum
  unsure (1)..(562): unsure at all n locations
  Clone ID: PAT_TA_80738
catttattgaggctcctccgaaaatcttaacatttttggacacttctaaatcctagtccttgttcaaaccttttgaattaaattcaaatgactttgaatttaattcttgcaatcatgtccactcctatttttcatggaccgtgcacatttttgtgagtccggggaaattatccccgtgcccaagttccttctccaaccttttctttctcttatttctttctttgctatttgctgtttttggcaaataaagagagatgagaacgagagtaggagagagaagcccaacctaggccggcctncttgggcctccctaggccaaactccagcgccgtcccatccctatcctaggcccagtcactcctaaacctaaccctccggccgatcccctctctccccatcgttcctcccacaccgccgctagcacccacacgcacgcacgagagagcagcacgatccccatgccatccgctcgacccctctccctctcgatctccatgccaagcacatgcgccgggccggacatcttgtgacgatcctcaagctcctccggtggtangcctaa

SEQ ID NO: 80739 - DNA, 177 bp, Triticum aestivum
  unsure (1)..(177): unsure at all n locations
  Clone ID: PAT_TA_80739
aggccaacgcaagcnccactagtntttatnccagcaaggntcatnatgtnatgacaactgtaatcgcaangagttcagcaattcgacaagatgctgtaaataaagctaaatnatttaaagngaagcatcantaaanggctaatgcatcnnaaggatcanttccttcnataggngtgt

SEQ ID NO: 80740 - DNA, 557 bp, Triticum aestivum
  unsure (1)..(557): unsure at all n locations
  Clone ID: PAT_TA_80740
ctagcaagctatatacctacatagtacagccatggcccccaccgtgatggcctcgtcggccacctccgtcgctcctttccaggggctcaagtccaccgccggcctccccgtcagccgccgctccaacggcgctagctcggcagcgtcacaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgttagcacaacgcatcccctgggtactatgatggccggtactggacaatgtggaactgcctattttcgggtgcaccgacgcacacaagtgatcaacgaggtggaggaggtaagaaggagtacctgacgcgtattccgatatcgattcacaacatgcgcaggtgagtgcgtanttcatgcttaagcacnggctcnagagtcggaagcctaaaagtcatcacgacagcatnataa

SEQ ID NO: 80741 - DNA, 557 bp, Triticum aestivum
  unsure (1)..(557): unsure at all n locations
  Clone ID: PAT_TA_80741
cgccgctccaacggcgctagctcggcagcgtcacaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccnttagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgagtgcgtcanttcatcgcttcaagccaccgggtgcgaggagtccggcaaggcctaacagctcactcacgacaggcatatataagtgcattgagttttgtnactctgacatgcttgggtttcttctcattatcttcttattgtccaagatatgtgatgncatgtcatgtacgaaan

SEQ ID NO: 80742 - DNA, 236 bp, Triticum aestivum
  unsure (1)..(236): unsure at all n locations
  Clone ID: PAT_TA_80742
agtctacnccgccccgancagtggcggcttcncnctcanccgcagcngttccaccacagcnttngctggcaagcaagancaatgaagaagctgcnaatngnagcnagcttaacccatttagaattcnaaaggatcctggtgatggtgctgctaagcntggtgatggtgctgctaagcntggatctaatggaaggaaggttgccagaaccagttgcatgcatttngggtttnccttg

SEQ ID NO: 80743 - DNA, 534 bp, Triticum aestivum
  unsure (1)..(534): unsure at all n locations
  Clone ID: PAT_TA_80743
ngggtctcaagtngaccgccggcctgcccatcaacngccgctccagcagcgccggcctcagcagcgtcacaacggcggaaggatcaggtgcatgcaggtgtggccgattgnaggcatcaagaagttcgaaaccctgtcttanctncaanccctttncacggaagccctcctgaaacangtcggctnctttanacgctccaaataggtgcctgcctccanttcagcaangttngnttcntcttccgtgagcaccataanncccccggatactatganggtcgaactggncaatgtgganctncctattttcggtgcaccgacgccacacaggtgctccacgaggttgaggaagtcaagaagagtncctgangccttntccgntcatcggnttcgnaactgcgccaggngcatggtcantttctcgcttatgcnccgggtttcaagagtttgnaggctaactacggttnaanatgcttttatnaggctttntgnctcctttttcncgctctctgngncnggctttttattttttgt

SEQ ID NO: 80744 - DNA, 533 bp, Triticum aestivum
  unsure (1)..(533): unsure at all n locations
  Clone ID: PAT_TA_80744
gatttcnttttatcggattgaatacttttatggatttgagagcacttgatatatgtnttgcatatgaatacccatggtgacaatggggtattatattgattcacttganatatgttttggcactcaactcacggattcccgaggtgacattggggtaatctatgcataggggttgatgcacgtnctcgtctttatttctccggtagaaatctnggggcactctttgangttctttgtgttggattaagtattatgaatctnaaannacttgangcaaatngtataatcaactcanggatactcgcagtgacattggagtatccaggtgacattaganttggttgangtgtatcatatggngttattttagtacgaccttggatagtcgtcagaaagatacttggngttatttnnnacgacctggatgattgatcgaaagatacttnaagtgttcgacccncaacaattcnctatgtctccgcnganggacttggaggatctcaccncgtgaggtggtntgatcaatatatagc

SEQ ID NO: 80745 - DNA, 561 bp, Triticum aestivum
  unsure (1)..(561): unsure at all n locations
  Clone ID: PAT_TA_80745
gaaatccatccacaaccccaggccaggcaaaagatgctcaagacgcaagccaaactgaccttatatctccctggttcacacatacacatgtctcgctcacgctatacatatagacccatccaacactgttcgcccttgttctctctgcatgtgacacgcacacccctaagtaccataatccctcactccatcataggcgcaanactccccccctcctaagtacgattatctcttactagccatcaggaacacaagtattgtatccttccatccatacgtctatctcgatatctctcggggcatcttctatcacgcacacaccttgtcactcgatctcccacccatgtagtgccatcacgatctccgggggatctctctatgacaaatatacactctctcctccccatgttgattttctccgtacgtctctctcgacctctctcccttgtttgtagacccctcttggcacgtgctaggggnttttgtttgttcaaaaacacacactattctaacttgcttgttgtgagatgatgtggaatgttgatagaacgacactttttt

SEQ ID NO: 80746 - DNA, 492 bp, Triticum aestivum
  unsure (1)..(492): unsure at all n locations
  Clone ID: PAT_TA_80746
gtccgttctctctttttatctcattttttagaacatatcatgaacctcatccccactttttggaggactcatgagtctccatcattctttaccccactgggacaatgctctaataatgataatcatcacacttcttttttacttacaactcgataaactgaaacgatatgactctatatgaatgcccctcacagtgtactaggatgtgcaatgatctagtgtaaaatgtattacaatgatgaatggtggctttgccacaaatatcatgtaagctctatatgataatgcaaagcaatatgatgatgaacacacatgtcatatgacagaacggtggaagttgcatggcaatatagctcagaatggctatggaatgccatgataggtaggtatggtggtgttttgaggaaggtataatcaggcttatgtgtgatagagtgtgtcatatcaaggggttgaatcaccggtgaagtttgcaccgactcngaggggggg

SEQ ID NO: 80747 - DNA, 546 bp, Triticum aestivum
  unsure (1)..(546): unsure at all n locations
  Clone ID: PAT_TA_80747
atcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcagtcctacgagtacgtcagccagggactcaagaagtacgcttcgacaacaccatgggaggctttacatcgctcctgctttatgacaagcttgttgtcatctctcaagaacttatacctgccaacataagatccactatttggtttggggagcaaggtaagaaatattcagtggactttttgcaaatggana

SEQ ID NO: 80748 - DNA, 563 bp, Triticum aestivum
  unsure (1)..(563): unsure at all n locations
  Clone ID: PAT_TA_80748
tttttttttttttttaagcatganagacgctccctgttcacgtcctatcacatccgagtagtcgcgccgatttccacactgcaaagatgaagtggcatgcaagcaaccggaaggaggccgctgccgcaaacccaaacaagaaagaacatagagtagtataagtaacatacgtacgtntagtctaccacgtgtacgaccacacataatcacatttnacagggtggccatgcgtgcnctgcacttctactaacgangcgcccctgcagcngccgcncggcagctcgcngcaggcgcggaggtnacggcnccgtgcggcagtnggctggagaacacggcctcccacacgtcgccgaaagcatcgacgatgtcgcggcggtngcntggtcgtnnagcgccaggaacaccgcagcaggcgtccagccgtnggcntcgtaatgccgcggcccaccaccatctcgccatggaccgccggagtnggcccggggtctcgancgttaccaccggantcccggccccaccngggggccggtnccattcgccttgtngngtttcgcggctcctgn

SEQ ID NO: 80749 - DNA, 544 bp, Triticum aestivum
  unsure (1)..(544): unsure at all n locations
  Clone ID: PAT_TA_80749
agaataccatggcccccgccgtgatggcttcgtcggctaccaccgttgcacccttccaggggctcaagtccacagccggtctccccgtcagccgccgctccagcgccagcctcggcagcgtcacaatggcggaaggatcaggtgcatgcaggtgtggccaattgagggcatcaagaagttcgagaccttgtcttacttgccacccctctccacggaagccctcctgaagcaggtcgactacctgatccgctccaagtgggtgccctgcctcgagttcagcaaggttggcttcgtcttccgtnagcacaacagtcccccgggtactacgacggtcgatactggacaatgtggaagtgcccatgtttgggtnacgacgcacacaggtgtcaacgaggtggaggaggtaagaaggagtaccctgacgctatgtccgtgtatcggcttcacaactgcgcagtgagtgcgtanttcatcgcttangcacgggttcaagagtcggaangctaactacgagttnaaaatggctattctataagtnttttna

SEQ ID NO: 80750 - DNA, 557 bp, Triticum aestivum
  unsure (1)..(557): unsure at all n locations
  Clone ID: PAT_TA_80750
gtgacacgggctcatcttcgggcccgccctcacagaagcgtaagatatggatcccgaacagcatgtaccgtccaaatgcatttgccccaaggcagacctatgctgcacctcgtctgcctccaccaccatctaggcagtcaagacttccagctccaccatcccaagctcctgttcccactccgaataatggcttgtgcttcaggtgtggtcaaccaggacaccgtgctagagaatgcaaccagaaccagaatcaactggcccttccaacaactggccgtggtaacaatcagccccgcaacaacaatgctaagtcttatggtcgtgctcatgccaaccacattgatctcaacgaagctcaagaccagcctgctactgtgatgggtnactcctcgtaaattcagtaccanatcgtttttttgatacaggtgatgattattatgtagaagattttgcatcaagacgacgttaattgaggagtgaacacctcggnctgtaaaanccctggacagtgtaaactcttgttggatgatgtcccgtgaatgaaggtgatcntgcnc

SEQ ID NO: 80751 - DNA, 552 bp, Triticum aestivum
  unsure (1)..(552): unsure at all n locations
  Clone ID: PAT_TA_80751
catcatttcactcttgaatgacacgtatgcaatataaaatggttgatatggagagaaaaataaaaccactatactccctcctttccggtttataaggctcaattcaaaattctcaccaaccaaggtagatggtgagtggtggaatactttttgtagtttgcaaaagcaacaaattaatgctcttgttttcctcaaaaaagtatgtttaccaacgcattaattgcaatgcatgcatgcataaattacatgcattggtcaattttntcttagtacttgcatgcaatgatttaatgcaccttggaatctgaacatgtgatggaaaacaaccaaattgagccttatgaaatggaaaaaactaaaattttgagataagcctataaaccggaaaggagggagtatatacactagcagggtcgtgtnagagatggtcagaggtgaatgacacgtggcccagggggtgctgccncttcatacagccaaggcaggtgcagtgaggccaggagtgtcgaatcctcgcactcgcacgtaccaaggtggtgtacttgatcgcaa

SEQ ID NO: 80752 - DNA, 601 bp, Triticum aestivum
  unsure (1)..(601): unsure at all n locations
  Clone ID: PAT_TA_80752
tagcaagctatatacctacatagtacagccatggcccccaccgtgatggcctcgtcggccacctccgtcgctcctttccaggggctcaagtccaccgccggcctccccgtcagccgccgctccaacggcgctagcttcggcagcgtcacaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgatcatcggattcgacaacatgcgtaagtgcagtgcgtcactttcatcgcttcaagccaccgggctgcgaagagtccggaaggctaaacagtcactcacgacaggcatatataagtgcattgngtttgtcaactcn

SEQ ID NO: 80753 - DNA, 581 bp, Triticum aestivum
  unsure (1)..(581): unsure at all n locations
  Clone ID: PAT_TA_80753
aagctatatacctacatagtacagccatggcccccaccgtgatggcctcgtcggccacctccgtcgctcctttccaggggctcaagtccaccgccggcctccccgtcagccgccgctccaacggcgctagctcggcagcgtcanaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagtgcctatnttcgggtgcaccgacgccacacaggtgatcaacgangttgangangtcaagaaggagtaccctgacgcgtacgtccgcatcatcgattcgacaacatgcgcaagtgcatgcgttagttcattgctttnaagccaccgggctncaagaatccggnaagcttaaaagntattcacaagggcacatttaagtgcattgcat

SEQ ID NO: 80754 - DNA, 295 bp, Triticum aestivum
  unsure (1)..(295): unsure at all n locations
  Clone ID: PAT_TA_80754
ggccgatgagctgagagagctggagcccgaggagaagggcgacctccaggcatagacaaacaatagccgcgtantttgtgattctgagaaactcttgggagggtctcatcagacggtccagagaaacatactacagtagtaaactgggatagctctactttatttcccttttttctgaatagttttattcgtttgcttccttttttttctgttggcgtggaaatgaagtgtaaaagatggttctattgtacagcagaaaaaaaatactccgtcaaactgaaataaaaaaaaaaaa

SEQ ID NO: 80755 - DNA, 536 bp, Triticum aestivum
  unsure (1)..(536): unsure at all n locations
  Clone ID: PAT_TA_80755
gccacctccgtcgctcctttccaggggctcaagtccaccgccggcctccccgtcagccgccgctccaacggcgctagctcggcagcgtcanaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtatacgatggccggtactggacaatgtggaactgctatgttcgggtgacgacgcacacagtatcaacgagtggaagagtaagaangagtacctgacggtacgtcgatcatcgatcgcacatgcgcagtcntggtacttatgcttaagcacggctcnagatcgcaagctaaantactacacggcaattaagtcattcgtttattaatgcttggttctctcatactttgtttcaaatatnatncttnat

SEQ ID NO: 80756 - DNA, 572 bp, Triticum aestivum
  unsure (1)..(572): unsure at all n locations
  Clone ID: PAT_TA_80756
tcgcttgcccccttcgttttcttcttgcccgaggcgctcatggccgcgccgccgtcgtacgcgcancaccgcacgcccctcgccgcctctccatgtccagaagctctgcgggggtcgacttcatcggctacaactccgaatcggagctgggaggccgccaccccgtcgtcgactgcatcttcttccccaactacgaccgccactgaactccgtcgatttgcactgctccgccccgtccaaggcctcccagaccacacctccgagttcgcgacatcgagaccgacgccgctgcaacccagtacgactacggagttgacgacccccctctcttgccagagaaccagatgtcagagccaggagcagacgcaccgtcgacgacgcctactacgtggaggtgctatatacgtgagccgtgacgacgacaggagtgttaggagatcacgagaggctcgcttttgattgatcagttttgcagctttnaggaacttttaatatctganaatatgtnctcgtacngtatatnnatttatnagctgagcctgtgatatantganatatttnatnatggttat

SEQ ID NO: 80757 - DNA, 604 bp, Triticum aestivum
  unsure (1)..(604): unsure at all n locations
  Clone ID: PAT_TA_80757
ggagttttattttaaaagttatagccagtcaaacatcagtcaaagttctgttttaataaaatcagaaaaaggaaaacgcttcgaggaaaatacgctttcaaagcagagaagacatactcgggactccgcgctttcacttaaacagagangacggccgcgcgggtcactgacagtgggtccagggggcccactggtcaggtttgaccgttcttcctctccctcccttctctctgcccgaacggtgcggggctccggcgatcgccgtcggcaatggcagctccccacggggtcccgagggcagggatagatccgccagccggggcggtcctcccggtgggcgtaggcagnggggacgganggggtcaccgcggcgaactctcggcggacggaggttcgggacagatgggttttggctcggtgtcttgtcaactagcctaganctccgacactatgggaactttgtgcttgattgcggggaacttgttcacaatgcttgantcgcgcaccactgncgaacagaaaagattcccacattctactagggaacatgggtgctggttctatcngagaacggctctttnacnaggctnnccgcgtganaana

SEQ ID NO: 80758 - DNA, 584 bp, Triticum aestivum
  unsure (1)..(584): unsure at all n locations
  Clone ID: PAT_TA_80758
gtcagccgccgctccaacggcgctagctcggcagcgtcacaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaantgcctatgttcgggtgcaccgacgccacgcagtgatcaacgaggtggaggagtcaagaaggagtaccctgacggtatgtccgatcatcggttcncaacatcgcagtnagtngtacttcatcgcttcaagcacgggtgcgagagtcgcaaggctaacagcnactacacgggcacatanagtgcattcgtttacttaattcttggtttctttcataacttctgttgtccagaaaatatttntcatgtcgaatatcaaanatccgnttatcncgtgtattttccancctattntagnactcnctagtttggatann

SEQ ID NO: 80759 - DNA, 591 bp, Triticum aestivum
  unsure (1)..(591): unsure at all n locations
  Clone ID: PAT_TA_80759
ccgtgatggcttcgtcggctaccaccgtcgcacccttccaggggctcaagtccacagccggtctgcccgtcagccgccgctccagcggcagcctcggccgcgtcacaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagcaaggttggcttcgtcttccgtgagcacaacagctctcccggatatacgacggtcgatactggacaatgtggaactgctatgttcgggtnaccgacgccacgaggtgtcaacgaggtngaggagtaagaaggatacctgatgctatgtcggtatcgcttnaaactcgcaggtcagtcgtacttatgcttaggcacagttcaagatcgcaagctaacncanttnacatgcntgatatgcatttactatttgcagnttnttcncaanatatttgtcaatattgtttcnnaagttganatcttgaatcacnaantttaatnangccggnctca

SEQ ID NO: 80760 - DNA, 589 bp, Triticum aestivum
  unsure (1)..(589): unsure at all n locations
  Clone ID: PAT_TA_80760
ggagaattagggttcgattccggagagggagcctgagaaacggctaccacatccaaggaaggcagcaggcgcgcaaattacccaatcctgacacggggaggtagtgacaaaaacaacaaaaacgagcgcaaacatataatagcgtattcggaattgtacccaagcccctcccatgggttctatacccgattcataactagaaagcttctctggtccttcactaaccggggctaaaagtctcatgaacagcaaactcatcagcattggtcgtcctttgacgccaatcactcaagatgcttcatgcgctgatcactcacaacaagactgaaagtacatatagtacccatgtatggttttggtaattaaatgacaatcctaatggcctaatgtttgcattgagatatacatttgaaggaaagttccatttgcaatgcatgaagaatattggatgaattgatggatgaaatcctcaacataaatatgcattgagacttgataatgaatgacaattcctatgaagnaacaattaaatccagttatatacgagggttgttccatgggtgatgcaagagattgatggttcagaatn

SEQ ID NO: 80761 - DNA, 352 bp, Triticum aestivum
  unsure (1)..(352): unsure at all n locations
  Clone ID: PAT_TA_80761
nggtgggcgatgctcggngccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacancatctacccaggcggcgncttcgacccacttggcctcgccgacgancccgacaaccgcagctgagctcaaggttcaaaaagggggggggaaaaaaaac

SEQ ID NO: 80762 - DNA, 356 bp, Triticum aestivum
  unsure (1)..(356): unsure at all n locations
  Clone ID: PAT_TA_80762
gctgcctatgttcggatgnaccgacgcnacgcaggtgatcaangaggtggaggaggtcaagaaggagtactctgangcctatntncgcntcatcggattcgacaacatgcgtnangtgcagtgngtnagttcatcgccttcaanccaccgggctgcgaggagtccggcaaggctaaacagctcattcacgataggcnatatataaagtgccattgcagttttgtcaactntnaccttgcnttgggttttccttctccatttcancttncttatttgttcctaagaatatgngtatnctccatgttcatgtncgaacatngccncggnaaanggggcccccnaccanaaananaacg

SEQ ID NO: 80763 - DNA, 332 bp, Triticum aestivum
  unsure (1)..(332): unsure at all n locations
  Clone ID: PAT_TA_80763
ggctcgtgaggagcaaccccttcgccacgtgtcttcagctaccccaacactccttcgacaaccaaaccatgtaacattttccaagtttatttagctgggagcgccccctgggctacattattcccagtccgtgtgggtctgtcccggcggcatgtatccacttgcatctttagttcaccctgctgggggcgcccctcgggctgcatcatccctaggtcgcttgggtctgacccagtggcatgtatcattcttgcatttacctaatctagttcactttccatgcatgatctatctatggttatcacctacttgattgtcaccccccccnaaaa

SEQ ID NO: 80764 - DNA, 469 bp, Triticum aestivum
  unsure (1)..(469): unsure at all n locations
  Clone ID: PAT_TA_80764
ccaactcacaaccttagagcatgttggatactccggcaggtggccaaaattggcgaagatctcctaattccggaggccacagaaagacaccccaaagacaccaatacggtattaacagtcgtcgagacttccgcatcaaataacatgcgaaaaaggacactccgcagccttgccgaaatctaccaagtggcaacaataaacccatggagtgacacggctattacctttaacgccagtgantgaacctaaattccgatcaacctgagtaccagccgcatcggtcctcagcccaatagtggacggctttcgtcttaccaaggtactcatggacggcggcagggattgaacctcatttatgaggaaatccttcaaaaaatggaaatagactggaaccgcattgagcgaanagncacaacctttagaggaataatccccagtcgggaagcgtgctgtacaggaaaaatcacac

SEQ ID NO: 80765 - DNA, 547 bp, Triticum aestivum
  unsure (1)..(547): unsure at all n locations
  Clone ID: PAT_TA_80765
tagcaagctatatacctacatagtacagccatggcccccaccgtgatggcctcgtcggccacctccgtcgctcctttccaggggctcaagtccaccgccggcctccccgtcagccgccgctccaacggcgctagctcggcagcgtcanaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaactgctatgttcgggtnacgacgcacnaggtgatcaacgaggtgagagtaagaggagtacctgacgcgtttcgatatcgattganaatgcgcagtcagtcgtacttatgcttaagcaacgggctcgagagtcggaaggctaanagtcacnacacggcaattangtcattg

SEQ ID NO: 80766 - DNA, 553 bp, Triticum aestivum
  unsure (1)..(553): unsure at all n locations
  Clone ID: PAT_TA_80766
gcaagctatatacctacatagtacagccatggcccccaccgtgatggcctcgtcggccacctccgtcgctcctttccaggggctcaagtccaccgccggcctccccgtcagccgccgctccaacggcgctagctcggcagcgtcanaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaantgcctatgttcggatcaccgacgcacnaggtgatcaacaggtgaggaggtaagaaggagtaccctgacgctatgtcgatatcgattgacaatcgtagtcagtcgtanttcatgcttaagcacggctncgagagtcgcaaggctaanagtactacgcaggcattannttgcattnag

SEQ ID NO: 80767 - DNA, 368 bp, Triticum aestivum
  unsure (1)..(368): unsure at all n locations
  Clone ID: PAT_TA_80767
ngttaatcagaattaatcggcctccgtatgacatgagcttacccttccagcaactcagtttcttctnaaatctgtnctcgatgcacttccattctctgtttgtcagcctacgatggtggattggaataccgaggtaaganaaaggtaactctgccaactcncacccanacaattgcctataagcctcctgttcgtctttggcnctaccaaaacagaacagctcgctcttnttaaaattaatctttaacccggtcaattgttcaaataggcataacaccngcttcatatttctcgccttggcnaagtcatgctccataaagatgtcgntcatcngcgtactgaagtatggaaanacctcnatnaacaag

SEQ ID NO: 80768 - DNA, 536 bp, Triticum aestivum
  unsure (1)..(536): unsure at all n locations
  Clone ID: PAT_TA_80768
ctccgataatacaataccatggcccccgccgtgatggcttcgtcggctaccaccgtcgcacccttccaggggctcaagtccacagccggtctccccgtnagccgccgntcaacngnaacctnggccgggtnaanaatggnggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagtcctccgggtactacgacggtcgatactggacaatgtggaactgctatnttcgggtgaccgacgcacgaggtgtcaacgaggtggangagtaagaaggagtacctgacgctattccggtatggttgaaactcgcagtgagtgcgtanttatgattangcaacggttcgagattgaangctaactcgantaaanatgctattatatnttttgtaa

SEQ ID NO: 80769 - DNA, 552 bp, Triticum aestivum
  unsure (1)..(552): unsure at all n locations
  Clone ID: PAT_TA_80769
gtctccccgtcagccgccgctccagcgccagcctcggcagcgtcacaatggcggaaggatcaggtgcatgcaggtgtggccaattgagggcatcaagaagttcgagaccttgtcttacttgccacccctctccacggaagccctcctgaagcaggtcgactacctgatccgctccaagtgggtgccctgcctcganttcagcaaggttggcttcgtcttccgtgagcacaacagctcccccgggtactacgacggtcgatactggacaatgtggaagctgcccatgtttgggtgcaccgacgccacacaggtgctcaacgaggtggaggaggtcaagaaggagtaccctgacgcctatgtccgtgtcatcggttcgacaacctgcgccaggtgcagtgcgtcacttcatcgcttcaggcacgggttgcgaggagtcggaaggctaactagagttaaacatggctatctgtataagttttggaacttacttttgtcacaactctgtgacacttgtttggacgganatactttgtcaatattgtgntgatgaca

SEQ ID NO: 80770 - DNA, 556 bp, Triticum aestivum
  unsure (1)..(556): unsure at all n locations
  Clone ID: PAT_TA_80770
cctacgtctgcggcgtcaacgccgacctctacacccacgccgacaccatcatcagcaacgcctcctgcaccaccaactgcctcgcccccttcgtcaaggtgctcgaccaaaagttcggcatcatcaagggaaccatgaccaccacccactcatacaccggcgaccagaggctgctggacgcgagccaccgcgacctgcgccgtgcccgcgccgcggcgctcaacatcgtgcccacctccaccggcgcggccaaggccgtggcgctggtgntgcccaacctcaagggcaagctcaacgggatcgcgctccgggtgcccacccccaacgtgtccgtggtcgaccttgtggtgcaggtctccaagaagaccctcgccgaggaggtgaaccaggcgttccgnangcgccgcaacgantcaaggatctcgacgtctggagagccgctcgnatcgtngacttagtgctcgacgtgtctcacatgacgcgtgcnagatgtatggagacaatgtaagnatggtgtagcaacagtgggtatccagagtgtgactnanaatgtgna

SEQ ID NO: 80771 - DNA, 552 bp, Triticum aestivum
  unsure (1)..(552): unsure at all n locations
  Clone ID: PAT_TA_80771
cggcctccccgtcagccgccgctccaacggcgctagctcggcagcgtcacaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtnagcacaacgcatcccctgggtactatgatggccggtactggacaatgtggaagctgcctatnttcgggtgcaccgacgccacacaagtgatcaacgangtggaggaggtcaagaaggagtaccctgacggtatgtncgcatcatcggattcgcaacatgcgcaggtgagtngtcacttcatcgcttaagccacgggctgcgaggagtccggnaggcctannagctactcacgacaggccatattnnttgcattcagttttaactctaattcttggttcctctcattatcttctattgttctagatatggatgncatgtcatgac

SEQ ID NO: 80772 - DNA, 544 bp, Triticum aestivum
  unsure (1)..(544): unsure at all n locations
  Clone ID: PAT_TA_80772
cctagcaagctatatacctacatagtacagccatggcccccaccgtgatggcctcgtcggccacctccgtcgctcctttccaggggctcaagtccaccgccggcctccccgtcagccgccgctccaacggcgctagctcggcagcgtcanaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaantgctatgttcgggtgacgacgcacnaggtataacgaggtgaggaggtaagaaggagtacctgacgcgtttccgatatcgattcacaaatgcgcagtcagtcgtanttatgcttaagcacggngcnagatcgcaaggctaanagtactacacggcaattaagtc

SEQ ID NO: 80773 - DNA, 616 bp, Triticum aestivum
  unsure (1)..(616): unsure at all n locations
  Clone ID: PAT_TA_80773
acactacgatcagagacccttcgatgacactgtgtgcgatgcaataatcacaaacggtggtgtaaaaaatcatcaaaaaggcgcaaaacatttgcgatgacggatgcatcaaacacggttcagattttagttgcgtgtgcgattcagggcatacggttcagttcaactaaccattttcgatgaggaggaacaaaagaaacgggcagccagatgaaggtgtgtacgatgtacagcatacggttcactcggatgaactgtttgtgattaggcaacactaaataaatggtcagccagatcaaggtgtgtgcgatgtacagcatacagttcactcggatgaactgtttgtgattaggcaacataaaagaactgtcactagatcaaggtgtgtcgtgtacgcatgcggtcacccggatgaactgtttgcgttagacangagacagaaacggtcatatacaatncatancatgcagtcaatcaagatacatccanttcaacattcagctcatattctnnaggntacctgcagctttggttnccatactcatgcttcctatcnncatcgatcgctttgngcntcatcnagacncgttntacncatgttctataanngtccccn

SEQ ID NO: 80774 - DNA, 503 bp, Triticum aestivum
  unsure (1)..(503): unsure at all n locations
  Clone ID: PAT_TA_80774
ggcaagcaagcgcagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggtaaaanccnatttananccccgangaatgtnttatttgtgaccctacccggcgaacaccggnttnttatttgggcgtaacctcgnggctctcggggggggtctctcgttaaaaacanngtnttcccggtaanaggcntttcnttaaaaagggcgggtttttttatnanttttnaataggggcaccnccngaanttttnccangtnaatatttttcaaatntttttttc

SEQ ID NO: 80775 - DNA, 539 bp, Triticum aestivum
  unsure (1)..(539): unsure at all n locations
  Clone ID: PAT_TA_80775
ctcattttgccctcacctggataaactcgtgtctctcgtcccgctcaacccctttaaactagtcaccacaacgatggcctcgcacctaagccctttcgctaaggcatctgttcactcattttactccgtatatagtttgtattgaaatctctaaaaagacttatatttaggaacaaagggagtagaaataatataggaattgcatggcgattaatcttctgtacatgtcagaaatatacatagaccagaattgttcctctaaaatttctccaaaatttagacttatttgaaaagcttccccaaatatcctggaagacactgttttaatcaaaatataacacgcgagcaacatacttcgattttgtatgancacccctaacatggcagccaataaacccacatagctcagtactgctaataacagtcgcccaggagctatatttgtntncttctcacattacagtatctagggtgtataatcacgactggtacaaatcatatnttaagaggtnctcctccgtcccataatatagaggttt

SEQ ID NO: 80776 - DNA, 535 bp, Triticum aestivum
  unsure (1)..(535): unsure at all n locations
  Clone ID: PAT_TA_80776
cccacactccacctggtgctcagactccgtggtggcatgcagatcttcgtcaagaccctgaccggcaagaccatcaccctggaggttgagtcctctgacaccatcgacaacgtcaaggccaagatccaggacaaggagggcattcccccggaccagcagcgtctcatttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctggaggtcgagtcctctgacaccatcgacaacgtcaaggccaagatccaggacaaggagggcatcccaccggaccagcaggtctcatctttgctggcaanagcttgaggatggcgcactttggcggactacaacatcagaagngtcacacttcacttggtgctcgtctgcgcgtggcagtaagntctggcatgattgtttgtctctggtcanagtctcgttgtctcgg

SEQ ID NO: 80777 - DNA, 372 bp, Triticum aestivum
  Clone ID: PAT_TA_80777
aagacaccttgcccccctagggtccatcacttcatgtggagatttgctctaaacagccatcctctcctccgtaatgtcgaaagacttggcgtcgagctagatatcctgtgtccactatgccaccgtcaggcagaagatgggggtcatctattcctgcgctgtaaggaggtcaagatcaggtggcgttactgtggtcttgagtacaccaggcaacagctcctgctatgcgacaccccttctgaagtgctagcggcagttttcaagcttcccgaggaaattaagttgcgtacaatctgcctgctatggtcctggtggtcggagcgcaataatgcaaaccatcagaagagatgcctcgacgcagagggtttagtg

SEQ ID NO: 80778 - DNA, 525 bp, Triticum aestivum
  unsure (1)..(525): unsure at all n locations
  Clone ID: PAT_TA_80778
gacgcatgggactggtgatgggagcacaatagtgatgtcctgctccgaagtgaagacccagttggtcgaggactgtgcaactaccatcaccaagaagatgttttccaatgagaaagttggtcccttttacaaggtgtgtcctatgagctcttccacaatacatattcttcttatcgtgacgagtattgaattattcttgaccatggtgtgctcctatcgtgcttgaagctatagaatgaatcctctagtcttgttgctagctagcatgctctgcgactaacgattattcaaagaagtctatctactgttggtgtcatgatcctgtgaacataatatattcttatgaaactctgcagttgtaactgagttgagttgatctatcttacatgtttggcatcatcatgcttcccttgactcatttatgactatcttgatccttttgatgttttttgtcgaacaagacaatctagcagtggggtaccaacgtttacatgactactgaagatgtataannacacttcttnn

SEQ ID NO: 80779 - DNA, 532 bp, Triticum aestivum
  unsure (1)..(532): unsure at all n locations
  Clone ID: PAT_TA_80779
gcctcgctgaattcagcccaagtagtgacatggcccgctgggcgcatagctccataattctcccaccatagactggcggggccttcaagatgatatgcagcaaaggtgaccttgtcagcctcggctactagcgcggacagttttgtgagaaatactgcgaancagtcatcagcgtcgagaggctcgacggagtggtggaacgtgggtggatgtaacttgatgaaatcactaagtgacaccacgttagtcctctgattgtgtgatgtgttctgttcaatacgctccaacaaacggttggtctcccgcttgtttctttcggcttccatcataacctcggctaaggaaggaggatgaggcagatttgcattcctgacttcactgccttcggcctgctcttgaggagcagggttattgcgcgtgttgaccatcctaggtaaacaagacaatgatttagtcagaatgataggattccgacatagaatacagaaggtaaggggtaactcggaatgcaagatgatcatccgtatgacat

SEQ ID NO: 80780 - DNA, 543 bp, Triticum aestivum
  unsure (1)..(543): unsure at all n locations
  Clone ID: PAT_TA_80780
ttttttttttttttacgaaaacaatttaatgctgtatgtaagaaatgataagcatgtacaccatccgtttcaaaatacttgttgtggttttagtttgaatttgaactaaaaccaccaagtattttggaatggaaggccgcaacgagtgccttccacttacgacgtgcagaaagcatgttcctccttttggaaggcaaagacaactgttgcatagtggcagagctaacttcagacttgatttgctggcgcaggagtagaagcgtaggcgctgtctttagatgtagctgttggtgccgaagagatgtagcggttggtaccaaaggaggattattgcccgcggttgcttcgtagtggtcatttctctgaataagaagatacgaggagaccacaaggggcgacaactacaagaaacagaaatgtcgcttccacgaaaactgcgacacctccgacacaactactattcccaatagttttctccatagatccttcaatccctaatanggcgcctcccaggaaagctagcaccgctatgattcgctaggn

SEQ ID NO: 80781 - DNA, 207 bp, Triticum aestivum
  unsure (1)..(207): unsure at all n locations
  Clone ID: PAT_TA_80781
cgggcacgatgcagagctcaggtcgattgaggttgtggctgctcgacacgacacatacagagatgatgatggtgctggggtttcagcttcagcgaacagttgtatgatcctcctacttctggtaggtgcaatgttccaccgggctcaggcttcgtctccgggatcccaggactgccggaanacctnangaanggangaggtcctctt

SEQ ID NO: 80782 - DNA, 377 bp, Triticum aestivum
  unsure (1)..(377): unsure at all n locations
  Clone ID: PAT_TA_80782
gttcattcatcttatagtggtagagatctcatggttcattcatgcatttttatttttggagcatttgtgattattttcaagtgcatggcaaaatctggcctttttttgagtggagcaacatctggcctttattagttatacgtccaatagtgggcttttttattcacagtaaaaattggtgcaaactgggcttttgtttctttttcttgtttcacaacaaaaaggcctgtaggctgctgaggtagggtgttcgggctggatgattctcgtcccgaacgcatgcgttcgatcgattcctccacgttcggtcttggctcccccagaccgaacgttcgacagttatcggggtcctaataaaaaggcagcgtancttcctc

SEQ ID NO: 80783 - DNA, 527 bp, Triticum aestivum
  Clone ID: PAT_TA_80783
ccgtcgcacccttccaggggctcaagtccacagccggtctgcccgtcagccgccgctccagcgcagcctcggccgcgtcacaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagcaaggttggcttcgtcttccgtgagcacaacagctctcccggatactacgacggtcgatactggacaatgtggaagctgcctatgttcgggtgcaccgacgccacgcaggtgctcaacgaggtggaggaggtcaagaaggagtaccctgatgcctatgtccgtgtcatcggcttcgacaacctgcgccaggtgcagtgcgtcactttcatcgccttcaggccaaccaggttgcgaggagttccggcaaggctaaaactacaagttgaaacaatggcctatgtatgatggta

SEQ ID NO: 80784 - DNA, 537 bp, Triticum aestivum
  unsure (1)..(537): unsure at all n locations
  Clone ID: PAT_TA_80784
ggacccgctcgacataatggttcgtgtatatattttacagaaacgtgaaatcaaagttggggataaagtagccggaagacatgggaataaagggatcatttccaaaattttgcctaggcaagatatgccctatttgcaagatggaacacccgttgatatggtcttcaatcccttaggagtaccctcccgaatgaatgtgggacaaatatttgaaagctcactcggattagcgggggatctgctaaagaaacattatagaatagcaccctttgatgagagatatgagcaagaggcttcaagaaaacttgtgttttcagaattatatgaagccagtaaagaaacaaaaaatccatgggtatttgaacccgagtacccgggaaaaagcagaatatttgatggaagaacaggcgacccctttgagcaacctgttctaatagggaagtcctatatcttaaaattaattcatcaagttgatgagaaaattcatgggcgttctactggggccctactcacttgttacacaacaacccggntagg

SEQ ID NO: 80785 - DNA, 532 bp, Triticum aestivum
  Clone ID: PAT_TA_80785
ggactctatcccaacaagccatgttccaaataacgtactgacagaattcagaggagtaatgttaaaggcaatgtgcactgtttgccacaaaactttggcccacaggcaatcaaaaaaaggtgtttgatagtttcatcccgatcacaaaaactacacctagtcgatcatgtccagttgcgctttaccaagttatcctttattaatatgacttgtttatgtacaaaccacataaacactttaattttcaaaggaactttgactttccaaacatatgcggaattagggatggcgctagagttgatgacatcgatttaactgtgaactctccggtcctagtaagcttccagcacaactaatcgggctgatgagatagctgaacctccatcggtctactcactaaatgaagccacgcttcccaccggtttccaacaagcgtcctcctaaaatgaatattaagggggggtggactgcaatatcgttgcaacataagcatcatgtcgttgaacaatactatacagggacggatactgaa

SEQ ID NO: 80786 - DNA, 570 bp, Triticum aestivum
  unsure (1)..(570): unsure at all n locations
  Clone ID: PAT_TA_80786
gcgaacgcgcgcacagagatctagctgagctactagctatagcagcagctgctgcaggtctcctgacatggcgaacaggacatcgaagcatcggggcccgaggccggcgagttctcggccaaggactacacggaccctccgccggcgccgctcatcgacgcggatgagctcaccaagtggtccctctaccgcgcggtcatcgccgagtttcatcggccacgctggctcttcctcttacattcaccgtgggccaccgttcatcgggttacaagcaccagacggacgcgggcggctnggggccccgancggcgtgcggcggcgtgggcatccttcggcatcgcgtgggcttcggnggcatgatcttcatcctcgttcnactgcaccgccggcatctcagtgggcacattcaacccggccgtgactttggctgttcctggccgaggaagtgtccntnttcggngcctgctctanatantnggcatgcctgggngcatttggggttggcttgtnaagggntttcaaagggctaaaaagtnngtaagggggggngcaaagagtttaangaggttt

SEQ ID NO: 80787 - DNA, 303 bp, Triticum aestivum
  unsure (1)..(303): unsure at all n locations
  Clone ID: PAT_TA_80787
tggtggaccacctgcaggagcgcctgggcgtgtnggcggccgcgtncgcccccgcngncgccgtggncgccccggcaggagnggnggcngaggcngaggcgcccgcgnagaaggacgagagttcgacgtggtgatcgaggaggngcnnagcagcgnccgcatcggccaccatcaangtggtgcncgngctgaaccaacctggacantcaaggacgacnaaggaacctcatncnagggcctccccaagaagctcaaagaggccgtcagcaaangcacgaagccgagngangccaagaagcagct

SEQ ID NO: 80788 - DNA, 528 bp, Triticum aestivum
  unsure (1)..(528): unsure at all n locations
  Clone ID: PAT_TA_80788
cacaggcacccaaattattcaagggtccaacaatgggtcaacgatgaacaacccagatgcacatcatgttgattacctggggcaggaatcctttgatcatttctcccgaacaagtctcttttgtgaaggcactacttcgggggatctgggtaatgtcgggagccccacgcggcaactgaaataccaatccacatctttggaccccgagataacggaatgctcacctgaacagccagtaggtgtgatggagaacaccctgaaggcaaattacttcaagcaaggctagaggggcgacatgcccgattaaaggcattcaggtggctcctcaactagtaggagaaatgagagtgctgcagattccggggtttgactgtttgaagcccacacgaagaaatcaaaggtgtaatatagctgacttatctatggaantccttggccgtatccantggttcagtatctgtgtacatgganttgtgccatctgaatacatgaatcctntttccatatgtgaaaaanaaaaaaaaaaaa

SEQ ID NO: 80789 - DNA, 353 bp, Triticum aestivum
  unsure (1)..(353): unsure at all n locations
  Clone ID: PAT_TA_80789
aaagcaagtaaaaaggaacttctacagttgagccacactatccactagctcgaaccaccgttacttcgacttgaaagagcagaccacgacagcggcggcagccaggagcaaggctgcaagaggggcagcagcttcctgatgagttcccccagcgaacctaacgaaggttgtggantcacgccggggancntttgcntcttggggcntgcgggctanttggtnggnttctnggngttcntgggtttctcccgggaaaccccngngggnaattcgccgcggccttnggggaaggtaanttcaacggccttgaanaaccganttntnttaaagggcggccggccaaggggccctnt

SEQ ID NO: 80790 - DNA, 246 bp, Triticum aestivum
  unsure (1)..(246): unsure at all n locations
  Clone ID: PAT_TA_80790
nncagccnctgctgttgntcgattgngtttgngcccnccnggntcaggcttngggttncngcgtgtcggcgtccccggagttgtncaggcccgcggaagnccggccttctcgccgtcctgcgccacgcgccgccgctcccgctcgtgttcgccggcgacgnctactgctgcaggncgccgangggcagcgggntctgctncctgagggngcccnccncgtgcccgcccgagccccggnagccgccg

SEQ ID NO: 80791 - DNA, 532 bp, Triticum aestivum
  unsure (1)..(532): unsure at all n locations
  Clone ID: PAT_TA_80791
ggtgcatgcaggtgtngcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcanttcatcgcttcaagcacgggctgcgaggagtccggcaaggctaaacantcatcacacgggcaacatataaagtgcattgcgttttgtcactctgacantgctttggtttcttttcattacttcntgntgttntagatagatatgtgatgtcatgttccgaatnactcgngannatctctatnnatctac

SEQ ID NO: 80792 - DNA, 550 bp, Triticum aestivum
  unsure (1)..(550): unsure at all n locations
  Clone ID: PAT_TA_80792
ctccaacaccatggcccccactgtgatggcttcctcggccacctccgtcgcacccttccagggtctcaagtcgaccgccggcctgcccgtcagccgccgctccagcagcgccggcctcagcagcgtcanaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaantgcctatgttcgggtnacgacgtacacaggtntcaacgaggtggaggantaagaagatacctgacgctatgtcgcgtatggttcacactagcagtnatcgtattattcttnngcaacgggtncagagntgaagctaacnnattaaatgctatgataagnttggantacttngtacattgtganacagana

SEQ ID NO: 80793 - DNA, 410 bp, Triticum aestivum
  unsure (1)..(410): unsure at all n locations
  Clone ID: PAT_TA_80793
ccgccggcngcgccgcgcgggccgccatccnggaggccgacgacgacctgnagctgctggagcgcgtcaaggaggacaagaagaaacggctccagaagcaggggatcatcaactcctccncngccgagacagggtacttgcaggacctngtgtacaagctgagcnaggtggggcaggccattgacaaggacgacctcgccgccgccggcgacgtnctcnnaaccgcatccgacgcnccgtnggttcacaaanatcaatncaggttgcnccaagttcagctcaagcaccgaggagnagagtncagtggacagttaactcctcnntngtctccttattnacatcagngagcaagagcgnatcanctngtccaagtcngngttcgtatgtcacgaggcntggngaatgngtga

SEQ ID NO: 80794 - DNA, 552 bp, Triticum aestivum
  unsure (1)..(552): unsure at all n locations
  Clone ID: PAT_TA_80794
nctcctctccgccgataatacaataccatggcccccgccgtgatggcttcgtcggctaccaccgtcgcanccttccaggggctcaagtccacggccggtctgcccgtnagcngccgctccagcggcagcctcggcagcgtcanaatggcggaaggatcaggtgcatgcaggtgtggccgatttagggcatcaagaagttcgagaccctgtcttacttgccacccctctccacggaggccctcctgaagcaggtcgactacctgatccgctccaagtgggtgccctgcctcgagttcagcaaggttggcttcgtctttcgtgagcacaacagtcccccgggtactacgacggccgatactggacaatgtggaactgctatnttcgggtnaacgacgcacnangtntcaacgaggtgagagtaagaagagtacctgacgctatgtcgcgtatggttcacaactgcgcagtcagtcgtattatgatnangcaacggttcaagatntgaagctaaatanattnaacatgctangatatgctttttanttatttgnc

SEQ ID NO: 80795 - DNA, 553 bp, Triticum aestivum
  unsure (1)..(553): unsure at all n locations
  Clone ID: PAT_TA_80795
gggcaagcatctcgaggccggcgccaagaaggtgctcatcaccgcacccggcaagggcgacatccccacctacgtctgcggcgtcaacgccgacctctacacccacgccgacaccatcatcagcaacgcctcctgcaccaccaactgcctcgcccccttcgtcaaggtgctcgaccaaaagttcggcatcatcaagggaaccatgaccaccacccactcatacaccggcgaccagaggctgctggacgcgagccaccgcgacctgcgccgtgcccgcgccgcgcgntcaacatcgtgcccacctccaccggcgcggcaaggccgtggcgctggtgttgcccaactcaagggaagtcaacgggatgcgtccgggtgccaccccaacgtgtcgtgtcnacttgtgtcagtctcaagaagacctgccgagaggtaacagggttcgcgagccgcgcaagagcnaagggatctcactntcacgagcgntgtgtcgtgantaagtntcaagtntctcacatgaaggtgttanatgtattgagngaatgtaagtatggtg

SEQ ID NO: 80796 - DNA, 577 bp, Triticum aestivum
  unsure (1)..(577): unsure at all n locations
  Clone ID: PAT_TA_80796
agagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagtcaggcgagatganangtcatcgtgcctatgcgtgtgtgtgtgcaacaatgcttatancagtattcgttttgtcgtgtgtttntttgagaaaaagttgtgttgcttgtgtcactatcggaaatctcgtgataaacagtgnatattgtgcgtgctgcaatatatagtcctgtcagattaatttccgtgattaaccn

SEQ ID NO: 80797 - DNA, 250 bp, Triticum aestivum
  unsure (1)..(250): unsure at all n locations
  Clone ID: PAT_TA_80797
gcaagtncacccacgtgtggcancaggggggcncggtgggggacnacgtgccggcggcgcatcccaccaccggggataacgtcctcncaacgggcaccaacgantcagcaagtgaaaggaacataggangatatggaggacgtacntaggttgcttaanaatcggatatacgcgtgtcggcnggttccgtatgtaagtgcccgcgagccancgctcccctnataaancggtgnatgaaagcttntaatca

SEQ ID NO: 80798 - DNA, 579 bp, Triticum aestivum
  Clone ID: PAT_TA_80798
gtctcgagtttttttttttttttttgtttttttttgcaacagacagtccagagcccaaccaaacatgcccttatactcgtgccccttacgagactgcacagttttcttatttccacgatagctgatattactatgctacaaagagtcacaaacttaacaaagtagactgaagattttcactttgctgttgcagtggtacatgccgcgtgcagatgctgggtcactgccgaccatccttggcacatggcaagaggtgcaagcagaaaacgcgaacctctatgctttatctgtttgaagtatcttgtagagcatggtctctctaaattcagcatttctatctcactgaaaactctacggtcaatgcaggaaccgacagagctccgctctggtgatacagccaaccctgaccaaccagggccttcactccttcaggaaccaagtgaccgatgatgatgatgcgaataaggagatggtggcagtgaagacctccctcctcctgatgcttcttcctcagtgaaatagatgtttttctcattctgttgtatgctgcaaaacacagcacccagctgcaaaaacgta

SEQ ID NO: 80799 - DNA, 160 bp, Triticum aestivum
  unsure (1)..(160): unsure at all n locations
  Clone ID: PAT_TA_80799
ctcgtgtgtaaantctgccgactctgtatatacanattgctcccangacangtgctcggttgtgtacatctttgatgcttgacaancaanattcttatntntagttaanaaantnacatttnttantattnttnacattaaancagtcgctttttggttt

SEQ ID NO: 80800 - DNA, 584 bp, Triticum aestivum
  unsure (1)..(584): unsure at all n locations
  Clone ID: PAT_TA_80800
gtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggttttggttgttgccaacccagcaaacaccaatgctctcatcctgaaggagtttgctccatctatccctgagaagaacatcagttgtttgacccgcctagaccacaacagggcactcggtcagatttctgagaganttgtgtc

SEQ ID NO: 80801 - DNA, 520 bp, Triticum aestivum
  unsure (1)..(520): unsure at all n locations
  Clone ID: PAT_TA_80801
atcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttcttctcntctcccatgcttgccatggtgtccttgtgtgattgtgtgtcattgtcctgtaattgttatnatcccactatgatgagtataaatgaagataaagattactaanannaaaaaaaactcacgggngccggaccant

SEQ ID NO: 80802 - DNA, 560 bp, Triticum aestivum
  unsure (1)..(560): unsure at all n locations
  Clone ID: PAT_TA_80802
ccctaacccaaaccctaccccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgaagaagaagactacaccaagcccaagaanaaaagcacaagcacaagaaggtgaagctcgcgtcctccagtttacaagtcgacgacgccaccggaagtaccaggctaggaaggctgccaacgcgnctgggcgcggcacttatggcaacacttgaccgcaatatgcgcaatgcggctactngttncancagaagttaaggngcncngttgccggctttaactacntnggattgatcattgnggncggtn

SEQ ID NO: 80803 - DNA, 576 bp, Triticum aestivum
  unsure (1)..(576): unsure at all n locations
  Clone ID: PAT_TA_80803
gagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgaganatgcatgatgatggcggcgtggtgttcgcctactacaaggagggantgctgatcaactttcctgtactttgcacatgggtgaaagaggcaagtgtaatcgcactgtatntaaaatctatctgtcttcagatttttgcctatctatggttgcagtcgactctcaatgttggttcagtactgcaatgttagtgctgaaaacttctganatgtggattnttgnatggatcgtaaatgggtggtgtgtttgtnaacaanaatctcctgtatctacggntaaaaaaaaaaaa

SEQ ID NO: 80804 - DNA, 455 bp, Triticum aestivum
  Clone ID: PAT_TA_80804
ccaagaaggccaccactgctgccgctgccgctcctgccaagaaggcacccgcaaaggctgccgctcccaaggctgctgccaccgctgttgctaagaaggctgccgcacccaagaaggccgctgctcctgctaagaagacttcggccccgaagaaggctactgccgccaagtccactgccaaggcaccggccaagaaggcgactgctgcgaagaagaagtagagcgcgtaacgcgtctcgctcgatttcctctttttttctttgcctcagcaaccctttttgatttctgccctcggactcgatcactacctgccttgcctccttcgttgtttttccccgacgcctgtaccgaaaccttcgttttcgtcacctgttccgagagctctcgatcttgtattatttcagaggtatcgttcgagctctttatgacgattgtcctatgcacatatcaaacgg

SEQ ID NO: 80805 - DNA, 181 bp, Triticum aestivum
  unsure (1)..(181): unsure at all n locations
  Clone ID: PAT_TA_80805
gtccaggcacgcangcgagcgatggcgagctgaagcgtggcctccggtgctcaggcncccgcgcgatgaacgncgtcgctcttcaacaanggctttaaaaggttcnggtgcgaaaanaacgaangtgaacaacataatttcttaacggnaattcggggaanggnggttaatcttnaagaat

SEQ ID NO: 80806 - DNA, 210 bp, Triticum aestivum
  Clone ID: PAT_TA_80806
ttgagacctcatgcctccactctgaacttggaagcttttagagacgtcgctatatgcccatcctgtgtgccagggcataatgctaataaattgcaaccgtttaattgtccagaaaaaaaatgcatctgtggtgtgaaatttgttgaagaaaataagctttgaagcttcaattgattgatgccctacttggacttgtttaaaaaaaaaaaa

SEQ ID NO: 80807 - DNA, 560 bp, Triticum aestivum
  unsure (1)..(560): unsure at all n locations
  Clone ID: PAT_TA_80807
ggatgtttaatgggctttactaagcacttttatattatttttggggactaacntactaaaccganggcccagtncaaattgctgtttttttgccnatttcagtgtttcgcagaaaaggaatattaaacggagtccaaacggaatgaaaccttcggaaganttattttnggaacaaacntgatccagaggactttgagtggacgtcaagaannaancgaggangccacgangcanggatgcgcacctncccgccttgggcgcncccccacccttntgggcccctcgcnnctccaccgacctacttcttcctcctatatatattcatatacctgnaaacatccaggagaccacgaaaccctatttcaccacggancttctgtacccatgagttcacttgggcntttcggggtcacatcnaaattncntgagatatgtaggngcattcnatcaaaattngttgatcanttccacngtgaggcggattacttggancttancgntnaatgacaaantttntgtcatnntaatattgttnanttntggttctncaaaaannaaaa

SEQ ID NO: 80808 - DNA, 578 bp, Triticum aestivum
  unsure (1)..(578): unsure at all n locations
  Clone ID: PAT_TA_80808
ggaaattgttggtgttgacacagggcctcttgaggatcttctgcatgatggcaaaatgagcaattcttagcagggagcagattacatggctggagcaaacactagcgctgaccagcaataactggaaaatagttgttggatatgatccattagttgattgcaatgtggcgcgcacaacaaaaacaacaaagatctacgagccgcttcggcatatttttgaaaaatacgcagtgaatgcatatgtaagcacaggtggtcttgtggacacttccatcatgacaattcaatgtcatatattcaaaaccccatccctggagatcaaacgaatttagatggttctcttgcatagagtcancctctagagatggaaccctgttgataaacttagacgggaggttgtnaaagttgtagtcacanatggaagggaccatgtaatgctcattcactttcngcacttgcaaactnagatctgttcacatgatgcctgaccagtgttgtaatantcggttgcaagaagctctgcattgtggatcactgtccncctaatgngancgtggntgggggttaaaaaaaaaaaa

SEQ ID NO: 80809 - DNA, 384 bp, Triticum aestivum
  unsure (1)..(384): unsure at all n locations
  Clone ID: PAT_TA_80809
cccaaagataaaatcttaacaaacttctgagttccactagagcncgtttcttggncttttnggctgttgtacacttacttgccaccacaatctagtggctcctatttacagcnaatgtgatgcgacttagggcctngaaaaantacttctanggactaacnaataaggggaatcattttccttcangntgcganttgnccatnaatcattggtgttgatatnctgatatattaatcncaagcaagaagnaaatgcttgggngtancctnagacagtattcccctgaaggtgctgatgctctgnaaagccccttccagaaaatanaaggggacncggaggggnatngttgaantagtgaatggtttttgttgtatccctgggngt

SEQ ID NO: 80810 - DNA, 576 bp, Triticum aestivum
  unsure (1)..(576): unsure at all n locations
  Clone ID: PAT_TA_80810
ccgacgctcaagcccccagacgccgcagcgccgccactccacccgcagcgggcaaccatggcggtcggcaagaacaagcgcatctccaangggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatttcagaacgacgaggaccaggcctacaggaagatcagactccgtgctgaggatgtgaagggtnatgtctcaccaactttggggatggattcacactgacaactcagtccttgtgagaagtggagcatcattgagntcatgtgatgtaagaaactacataatcttgatttcgcattgttacagagacgccnacagtaaccattgttccaananaatagnaatcncgaaatgttaattgnaacagtcacgtattaaggttaaanctctngnatgaaggttgngtctagtntccccaaagtnngcg

SEQ ID NO: 80811 - DNA, 554 bp, Triticum aestivum
  unsure (1)..(554): unsure at all n locations
  Clone ID: PAT_TA_80811
nngaggcggggaagccgctgtccatggaggaggtggaggtggcgccgccgcatncatggangtgcgcgtcaagatcctcttcacctccctctnccacaccgacgtctacttctgggaggccaaggggcagacccccatnttccctcggatcttcggtcatgaagctggaggcatagtggagantgttgganagggtgtgactgancttgcccctggtgaccatgtccttcctgtgttcactggggagtgtaaggtatncccacattgcnantttgcngagancaacatgtgttatctgctcangttcannaccgacagatgtgtcatgatcngtgatggcaagtacgcttctctattnatgggnagccgattaccatttcgtagggacttcaccttcagttagtaactgtatgatttggttgtttgcaantaanccnaggccccctgataanctgtttctacttngattcactggnctngtnatcatnttttcaaacacaangntcgaantncanatttgtaagacntnggctgctctnaaagtcaagttcagt

SEQ ID NO: 80812 - DNA, 277 bp, Triticum aestivum
  Clone ID: PAT_TA_80812
gggcaacctcatcgatgccgtgaccagggagcggctcaagaaggtgctcctctcgctccaggccctcgcgctcaggctgcagcacaacaaggacgactgactcaagatccatgatacttgccaccgtgtactcgtacgtccatttccctaaagtttgacgacgttttctgctccgtgcactagtattcgtggttccgtgaaatactgtaggaagtgtgtcctacctttgtgtaataaatcgctgaagaattcgactgtactgttgaaaaaaaaaaaa

SEQ ID NO: 80813 - DNA, 472 bp, Triticum aestivum
  unsure (1)..(472): unsure at all n locations
  Clone ID: PAT_TA_80813
ngtctgananagcaaagcatacaaaanatcgaggaagatggcgttcatgcggtacgactacagggcgctgccgcaggagacgacggnngagnagttccgggcgtggctggcgcagttcgacgcggacggggacnggcggatcanccgggaggagctgcgggaggcgctgcncanctcgacctgtggttcgcctggtggaaggccanggaggcgctgcgggacgccgacgccaaccgcaacggcctcgtcgacggcgacgagatggccagnctctacgccttcgcncgcaccaacctccacctcaangccnccnacctcnacgcctatcctagactgctatcagcctcccaataatctcctctgatcgatccggcagatacgtactgtacgactagctgttggatcgagtctctngcgcttatngtnagagtaantganagancattaaagngatttgtgtttggtnaaaaaa

SEQ ID NO: 80814 - DNA, 586 bp, Triticum aestivum
  unsure (1)..(586): unsure at all n locations
  Clone ID: PAT_TA_80814
gtctctcccatcgtgttcgcggccgctggcacggtgatcgactcggggacggtgatcacccgcctgccgccgcgcgcgtacgcggngctccggtccgcgttcgcgcgctccatgcgcaggtacgggtacaagcgggcgcccgcgctgtccatcctggacacgtgctacgacttcacggggcacacgacggtgcgcataccgtcggtggcgctggtgttcnccggcggcgccgccgtggggctcgacttcagcggggtgctgtacgtggcgaaggtggcgcaggcgtgcctggcgttcggcccaacagcgacggcgcggacatcggcatcctcgggaacacgagcagaagacgtcgcggtggtgtacgacgtcgccaacaacaagatgggttcggcgcaacggtgcanctgatggtggccgtacttgtcatcagcttaatggtacattttttttctaagtcacatgaaatgaagaatcaattanatggaatcaaancttattgtancncaacaccaacntnantgaataaattacatttntacaanaaggggccggnccaatnnccatattgngntccncccacggn

SEQ ID NO: 80815 - DNA, 407 bp, Triticum aestivum
  unsure (1)..(407): unsure at all n locations
  Clone ID: PAT_TA_80815
ggaagctgtttaatccggcgangtntgagatcactgaggagaatgtnaangacatgaagntggttgttgagtcanttcattagctctgntcagaaacaccaactgctaccgattttganttgggctgctcatgattctggggatatttgtggtggtaanaatgtggntcgtattgtgaaaagcgtatntttgattgnagtgcattctgccancaaaatgncatctgtnctgntcaaacatgganccgattggnatctgcnagataagtaaatcgaaccctaggctcctagctnaaggttgaggtcnattataatggccccancangatatggngtccgagctngtctcatcagggagcaaanaagatattgtttnatgaatctggcacttntggnaantcatctcaa

SEQ ID NO: 80816 - DNA, 499 bp, Triticum aestivum
  unsure (1)..(499): unsure at all n locations
  Clone ID: PAT_TA_80816
ggngtgctgcccgctgctgaagtgatctcgtcaccttcgacgcngncctctgcgtctgctccgccctccacggccgaancgatcgctcgggacatcgatcaggaggtncccntcagcctcatccttaacggatgtgacangtcggtgcccacttctttccagtgccccctatgaatgcaaaaccctcttcctcgagtagtactgttttcttttttnctactantnccacgacgagtnatntgganggagggagtacntgttatgtatctgggccggttacattgtccactctctgtttcctgntgttttctcttttttttctttctttgttgatgntggatagcttgccncctggttcttgttgtttnattnacgngtgaagggtgcatcctgcgttcgttgtancgnggncccgnggttcgtgcatttcatatcatcgtgtnccgnggtatcgaatanaaaaataaaanncgangggggncggtaccanncgcctatg

SEQ ID NO: 80817 - DNA, 323 bp, Triticum aestivum
  Clone ID: PAT_TA_80817
ctcctccttggcggtccgtggggaagtaaggtgaggtgggtctcattactagagccatatgaccaaaaagatgataggaaaggctctttccaagcatacaagcataaggtcaagtttatttcatcatcgatccaaatattgttccatagaataattgtgtcaccagctctaggaatgcaagttgtaacccctttgtatatgtccatgaacgagaacacatcgttctgtatatctttccgtaaaagaactgtgcaaaaatttcttaagcgcaacaactagatattaatttgtaatagaattttagttggatcaaaaaaaaaaaa

SEQ ID NO: 80818 - DNA, 319 bp, Triticum aestivum
  Clone ID: PAT_TA_80818
gacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcggttaactgaaaaaaaaaaaa

SEQ ID NO: 80819 - DNA, 563 bp, Triticum aestivum
  unsure (1)..(563): unsure at all n locations
  Clone ID: PAT_TA_80819
gagaatctccattttgtctgcgtcccctcacatgttgcattctcaacgccgccgccgcaaccaccgccaccagttcatagtaaaaggaaaaaaacatccgagtctgctttaggtagaggttctttacaaaaaaagcccatgttgtagagcttgaagatgacccagagccttaaaggtgtgcgcgcgtctgaactggacacaacaggaagagaagagattggcaagcgcttggttggaactttcaactgatcccattgaagggaatggcaagaagagagataagtattgggatgacatagctgttcaatataacagtctcacccctgcagatcgtcatagagatgccgtgcaattgaagagccattttcaaaaggtgaagagaaagatcaacattttccatggtgcatataatgctatgtgtaagctatacactagtggttatggtgaggagcagctacaggccttcgccttggagaaatatgaagccaaccaacaatcagctttccaacatttgacaatgtggagagaacttaaggacaacgggaagtggctttncagcaatn

SEQ ID NO: 80820 - DNA, 584 bp, Triticum aestivum
  unsure (1)..(584): unsure at all n locations
  Clone ID: PAT_TA_80820
gagttagcgcctccgtccgtctcgtagctgctcagatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggtgactccatcgtgctcatgggcaagaacaccctcatccgccgctgcatcaaggtgcactcggagaagaccggcaacaaggacttccttgagctcagcaacctcctcgtcggtaacgttggcctcatcttcaccaagggtgacctcaaggaggttcgcgaggaggtcgcaagtacaaggttggtgctcctgtcgtgttgggtagttncactgttgatgtgtggttcccctggcaacactggtctgatcctccagacgtctttttcaggtgctancattccacaagnttaacagggnctgtgaattactatccagtgagctaannagaagttacaggtggtcttgagntgcctcttgcaanttgaacgccctcnaatgatgtattnntttnaagtgggannt

SEQ ID NO: 80821 - DNA, 581 bp, Triticum aestivum
  unsure (1)..(581): unsure at all n locations
  Clone ID: PAT_TA_80821
gtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcattgatgctcctggtcaccgtgacttcatcaagaacatgattactggtacctcccaggctgactgtgctgtgctcatcattgactccaccactggtggttttgaggctggtatctccaaggatggccagacccgtgagcatgccctccttgctttcactcttggagtgaagcagatgatctgtgctgtaacaagatggacgcacactcccaagtactcaaaggccgttacgaggaattgtcaangangtctcttcgtacctgaagaaggtcgctacaacctgacaaggttcctttgttccatcctgggttaaggtacacatgatnagnggtcacaacttactgtaaaagggctacctntgngtctnancagtnaagagccaagaggctcnanaagcctggnttccttagggntaaaattgtggan

SEQ ID NO: 80822 - DNA, 565 bp, Triticum aestivum
  unsure (1)..(565): unsure at all n locations
  Clone ID: PAT_TA_80822
ctctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaatggcaccattgacttcccagagttcctcaacctgatggcccgcaagatgaaggacaccgactcagaggaggactcaaggaggcttagggtgttcgacaaggacaaaacggttcattctgctgctgagtccgcacgtatgacancctcggcgagnagcnacgacgaggagtgacggatatcgtaagccgacgtcacgtatggcagataatatgaggnttntaagtatatgcaaatacncaacgtctcaagcagagnntttcttcaatattagntaatt

SEQ ID NO: 80823 - DNA, 585 bp, Triticum aestivum
  unsure (1)..(585): unsure at all n locations
  Clone ID: PAT_TA_80823
agcaaccccacttgccggtggtggaggcttgccgtccatgtgatcctttcttctcccggtatccccattccttgcctcccattacaaaagcgagcatgaatgagagcaggggctgattttcatcagttaatttctcatatttttagttgcttttttgagattatacaagatgctcccgatctattttgtcaaattacttggatcgtcttatggaattgccagccatcgtattttcacctcatgttatttcttaatccttgtcccactagacatccactacatgtttggtaatgacgtgatgttgaggcggctaggagaagctcagcagccagatcaagggtatcgagatggacctgggagcaagcagtagttcttctgttaaattttggttattactttctattgttacaattgtgggatggttgatttgactcgtgtacatttgcatttgttcccagcttgttngcgagatgcgtgcactgcggcaactaatcaagacgaggcagtgacanagactacctgaatgtgcgagnaccacgattggattcacacgaggatggagagagagacataacatttcatgtt

SEQ ID NO: 80824 - DNA, 331 bp, Triticum aestivum
  unsure (1)..(331): unsure at all n locations
  Clone ID: PAT_TA_80824
atggtggagatgatcttgaagatgatttcattgatgaagaagaggtgaaaaccaccaaaacaaaagcaaagcaacctagcagtggcgagaagaatgccagctcaaagtcaaaaggaaaacagactccaaaagttgtaaaattctttggttaaacaatgccgccatttttgtagcgtatgtcgagaatggtcatcttcctggacaattctttttggaggaatcccagccttgtaacttacaatgcaatgagaatgtatctgtctacactgcgacgttggagaaatgccatataatttgaaatatcaaaaaanaanaaaanaaaaaaaaaaaa

SEQ ID NO: 80825 - DNA, 447 bp, Triticum aestivum
  unsure (1)..(447): unsure at all n locations
  Clone ID: PAT_TA_80825
atcactgggcactgataacaaaatatggataggtgcagagacgagtgacggtataaactttaaaatctcattatgcactgaagcaccgcctggtttttctcatctctttcttaagacggatgatgcagtggctgttacccccaccagcaccgtgtttcgtgacggtgtgaaaaagaagttgcgtgctgaagccctggcatcttgttacaatgctattctgatgcagactattgttgatactcagacctatccttatttctatcacgattattttttgcttaagaatgatgtgccatctccagttatatctcgtcttcctgagattcctggtggtcctgacttaattttggctctgcatcagagtggtcattacacagtggctgtgttgaaggaaggatgcattgcaactgcnaggcttcctcggatatnaaggggtntgcactgaag

SEQ ID NO: 80826 - DNA, 535 bp, Triticum aestivum
  unsure (1)..(535): unsure at all n locations
  Clone ID: PAT_TA_80826
aatccaccaagcaaacccgatggcccgcacgaagcagacggcgaggaagtccaccggcggcaaggcgccgaggaagcagctggccaccaaggcggcgcgcaagtcggcgccggccaccggcggcgtgaagaagccgcaccgcttccgccccggcaccgtggcgctccgggagatccgcaagtaccagaagagcaccgagctgctcatccgcaagctgcccttccagcgcctcgtcagggagatcgcgcaggacttcaagaccgacctgaggttccagtcctccgctgtgtcggcgctgcangaggccgccgaggcatacctggtggggctgttcgaggacaccaacctctgcgccatccacgcaagcgcgtcacatcatgccaaggacatcaantcgnagacgatcatggaganaggcctaatncgtngttcctncaatgnctgactctatcgaagtgtagaatttgtgtnatcccgttcantatgtatgtctagtgctatgtacatttgtgtanagaattgaanaagttggtcc

SEQ ID NO: 80827 - DNA, 526 bp, Triticum aestivum
  unsure (1)..(526): unsure at all n locations
  Clone ID: PAT_TA_80827
agaagacgacggcggggaagaagcccaaggcggagaagcgggcgccggcgtccaaggaggccggcggcgaggggaagacgaggggccggaagaagggcagcaaggccaagaagggcgtggagacctacaagatctacatcttcaaggtgctcaagcaggtgcaccccgacatcggcatctcctccaaggccatgtccatcatgaactccttcatcaacgacatcttcgagaagctggccggcgagtccgccaagctcgcccgctacaacaagaagcccaccatcacgtcccgggagatccagacctcagtgcgcctcgtcctccccggcgagtcgccaagcatgccgtctccgagggcacaaggccgtcaccaagttcactcatcctaantggctcgtcgtcgtttatgacgagttagggcggaagcgtcgtgtgtgtagttacagtagtcgatgttaaattttgtaagaattgtttgttgcttgtgcttaaggaatagtgatgttctgttgataaaaaaaaaaaa

SEQ ID NO: 80828 - DNA, 530 bp, Triticum aestivum
  unsure (1)..(530): unsure at all n locations
  Clone ID: PAT_TA_80828
ccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtcgtgtggtacttntcgtctcggctatgctctgccttgtgtccttgtgtgatgtgtgtcactgtcctgtaattgcttatctatctcacatgatgagtataatattaagaatgatgattactaataactactcnaaanaaaccactangacgtcgctg

SEQ ID NO: 80829 - DNA, 531 bp, Triticum aestivum
  unsure (1)..(531): unsure at all n locations
  Clone ID: PAT_TA_80829
ttgagcagtcttgatattcagcagggcaaagcagtttctctggaccacggtttctaagttttgtgaacaatacccatgcccgagacgccgtcaaaagcatctcgaccgtttttcagattggagaagaagattacccagcaccgccaggtcttttcgcgcaggacgaagaagcagatgaagaggatgatgcctgcaagtggaaagcagagtgattcaagcacgtagagtccatgcggcgattgtccatttggacattcgtgcgttggaattttccaagagagcacacaggagtaccactgagaaatcgagtccgaatagtatcctttgtgagcttgaatctcgaaggatgttgccaaaatcgaggcgtcacaagcaggaaaagatgcaaaagagcgcatcactaagaagtatttgagcanactngtggcatgctcgacttcagcctgaattcagagaatgcacttcacgtaaaacagcgtgacagccangtatcagatgctttanagngccacgnatgcacattgtgtnggt

SEQ ID NO: 80830 - DNA, 540 bp, Triticum aestivum
  unsure (1)..(540): unsure at all n locations
  Clone ID: PAT_TA_80830
tcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatnagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaaggtcgtggagaaggaagagagtgatgatgacatgggttcagtctgttcgactaagttgtggggatcttgtgtctgaagtantatcttggcaggaaactagagtcatgatgtttagcttattactagttgtaacgctgcaaacaatgtttgaaagtaatcanccntgttctgtgattactgggaacaactttctatca

SEQ ID NO: 80831 - DNA, 187 bp, Triticum aestivum
  unsure (1)..(187): unsure at all n locations
  Clone ID: PAT_TA_80831
ggacaatgggtttggtttgtattgataataatgggtgcttttagttagatggagcgttttcaatccctggcaatgattggattttgganttatgaatgnttttgttttgngtgaantggattttaagccgntgtgnctngaagttatnatatatnatactgcctccacttcnaaatananactcccc

SEQ ID NO: 80832 - DNA, 541 bp, Triticum aestivum
  unsure (1)..(541): unsure at all n locations
  Clone ID: PAT_TA_80832
gatcgctcgagccctccgccgccgccgcgccttcagctctctccttccttcaccgattcaagatgaagttcatcgctgcctatctgcttgcttacctctctggcaacgccagcccctctgcagaggacctgacatccattcttgagtcagttggttgtgaaatcgacaatgagaagatggaactcatgctgtcccaagtgaagggcaaggacatcactgagctcttggctgctggtaggganaagtttgctgcggtaccatctggtggtggtggtgtngctgtttcagccgctgctcctgctgctggtggtctgtgcncctgcantgagtcaaagaaagaagagaaggtcgtggagaaggaganagtatatgacatgggttcagtctgttcgatantcgtgggatcttgtgtctcantatctatnttggcagaaactagagtaatatgnttagcttattagntagttgtaangctgaaganatgtttatatgaatcagnctggtnctgntattatgnaacatacttnctaaaaaaaaaaaa

SEQ ID NO: 80833 - DNA, 464 bp, Triticum aestivum
  unsure (1)..(464): unsure at all n locations
  Clone ID: PAT_TA_80833
catctatttaaggccaatggtacagctttggactggagtctcagataccagatagctactggagtggccagaggcctagcctacttgcacactggttgtcgggattgcattatacattgtgatatcaagccagaaaacatacttctcgacacttcattcgtagccaaaattgcagactttggaatggcaaaggttttggggagagaatttagtcaagcattgactacaacgagaggaaccattggatatcttgctcctgaatggattagcggatcactgttacatctaaagtcgatgtttacagttatgggatggttttgtttgaaatcatatcaggaaggagaattcaagtcaagttgtggatggtgattattcagcctttttcctctacaagntnacgaaanctctcagtggagaattgaatctgtagacccaatttgcaaggaacgtgaacctnaggaggt

SEQ ID NO: 80834 - DNA, 472 bp, Triticum aestivum
  unsure (1)..(472): unsure at all n locations
  Clone ID: PAT_TA_80834
agaggaactccaagtacctctccgtctcctacctcgacgcacccgacgccacggcccctggttctacctccccgtcgtcctctgcttccatcttcttctcggtcaggaccgcgccaaggttcagaggtccaccgcgtcgccgtagttgtctgtgtcaccgtcttcttgtcctaggagccgggagacgagttcgtgaatgaggaaccggttgagtacgcttacgaagatcaagctttcgacaactctgagaaccttgcagttgcaggtgccgacgataccagtgcaggtgacgcaaccgagctcaagtgggagtttgacgaggaacgcggtcgttactatgtttcttttcctgatgntcagnagtggagcccagttgggacaatcggggntctanatttggggtatctaantttcattggattnnaccgagttcgtctatgtnnggatgttgatatgatgatnattatgaatg

SEQ ID NO: 80835 - DNA, 469 bp, Triticum aestivum
  unsure (1)..(469): unsure at all n locations
  Clone ID: PAT_TA_80835
agagaggctgtttcagaacctctactgagggtcatgagggatgtctcaggaggcaaggctgccattggttatatatacgagtctatgacaaaggtgatggattctattagaacatactacataatggatgaaggcaaatgcaagtcatttctggatattgtggagcagaaatggctggtggagctgcattcgcctcttcattcagcagctgcttttctgaacccaagcatccagtataatccagaagtcaaatttttcactactatcaaggaggagttctaccatgtcctggataaagtgcttacagtcccagatcaaaggcagggnatcacttcggaactgcatgcttttcgcaaggcacaaggaatgttcgcctctaacattgctaaagaggccgnaanaacacctcccagggatgtgttgggacaatatggnattcagcgccanattacacactggcctagaatag

SEQ ID NO: 80836 - DNA, 174 bp, Triticum aestivum
  unsure (1)..(174): unsure at all n locations
  Clone ID: PAT_TA_80836
ccgaccgngagtgctacgangtgggccgccccttcatcgnnaangccggcatggcggacaaggtggacttncgcgagggcaccgacctggcgcgcctngacgagctgctcntcnaggacgagggggcggccaganacgacttcgcgntcgnggacgcggacaagcncaactacg

SEQ ID NO: 80837 - DNA, 337 bp, Triticum aestivum
  unsure (1)..(337): unsure at all n locations
  Clone ID: PAT_TA_80837
tggagggcgagaagggggaggagatgcgccaccgcgccgcggagtggaagcagaaggccgcgcaggcgaccctgccaggtggcccctcagagaccaatctggacggattaantcatgtgctgcaaggcaagacgggtcaagccggaaagtaagaattggtgcgtgcagaaatcgcacgtccctgatttcaatcgtgttctgaatttgcctagtagtacgtactactatttgatgatagatgtggagagctgctctcagtttgtagcgcacgcattgttctgttttgtttgttacgtcaacataaaatcactccatttgtcagaataaaaaaaaaaaa

SEQ ID NO: 80838 - DNA, 521 bp, Triticum aestivum
  Clone ID: PAT_TA_80838
agaacttcaaaagtaaaactggagtacattggaactgtgtatactgtataaatgaaaaactctactccttcaaacccattctcaaattcatgtatcttgtgcacgatccattccataccacatataaatgaaaagggaaaaaaggcatagcccaacatctctcaaagtaaagtccctgcagttcaaccactacacctaagaaatgtgtgcctgaaagtttccccagtttgttaagctaccctctttccttgcctttgctgagccagcacaaaacacatttctacagaaaccccccggactgcatcaacggaatccagtgagccacgagtcagctcgcggtagttctccaattttcgcagcgtaaaccccttcgttccaaattcttcctctattcttagaagtgattgtatttcgtgaggcactctccacggaaggggcacggctttattgtccagctgctgcacgacagcaggtcggcgatgaaagaatcattgtgtcccagactatgtgacaccatacac

SEQ ID NO: 80839 - DNA, 455 bp, Triticum aestivum
  unsure (1)..(455): unsure at all n locations
  Clone ID: PAT_TA_80839
agatcgntcagtttgcctgcactcgcttcaaggcngagtacccccattttcgacaaggntgatgtcaatggcaacaangtttntgccctatacaagttcctgaantctagcaaaggtggcttttcggcgatagatcaagtggaacttctccaagttcttggttgacaaggagggtagcgttgtagancgctatgcncccgancacttcggcctgagcattgagaaggatatnaagaagtgcttgggagtcttagacangccgctggctggagcgtctngagaaatcggcactctgtattctacaaacaagaatantgncgngttgaaataaantctgtacccancatttnanacgatgcatctgtatattttacgatgtgtctntantgtngtatanntgtnttaatnaatnaattaaatattntantgttcngtgtgcctttannaaaaanaca

SEQ ID NO: 80840 - DNA, 287 bp, Triticum aestivum
  Clone ID: PAT_TA_80840
ttttggttggatcactaggtgggatcccaacccctttggtcggaattccaggatctctatgttcaggcggtcaacccggagatgagcgttgcttcggcgcttgcctcctctccaccagcgatttgcttacggcgcgagctttcgggcaccgaacaagctcagcttccggagctgcttagtctcatcacgccggtttcgctttcatcgtccgaggacaccgtgcattggcctctgaccccttccggcaagttttcagtcaagtctttgtaccgggaagttgtgcgaga

SEQ ID NO: 80841 - DNA, 166 bp, Triticum aestivum
  unsure (1)..(166): unsure at all n locations
  Clone ID: PAT_TA_80841
ggtgttcaggagcaagagcagacagagcctgggccaagagcaagcgacaaccccgcggggcgccttgcaaaggccaacgnttttcgcngttggaagttnaccgaaggaagcttnaagcnaatggccggagnagnaaacccacgnaagccgttggttntcccaaccg

SEQ ID NO: 80842 - DNA, 278 bp, Triticum aestivum
  unsure (1)..(278): unsure at all n locations
  Clone ID: PAT_TA_80842
gtgtcgtggggggtacaactgcgcgtgaagacgacgcggaggagcaaggtcgagtgcaccgagctgtcggngtcgtcngangggggcggcgcgccgagccgcgcggactcgtgcccccggtccaacagcatacgactcggataggctgacccagcaaaccccaatgcttaggtgcccgttcgatgggaacngtgcgaattttttttctacaatacaaaatcgtgccaganttanatttttctcctgataaacttactgggnttctattttttcgggga

SEQ ID NO: 80843 - DNA, 290 bp, Triticum aestivum
  unsure (1)..(290): unsure at all n locations
  Clone ID: PAT_TA_80843
cgntcttccctgcnaccgtccccgcntattaccgggctcctcccgangcggagttctgantgacgaaggtgnagctaatntctcttgnacgatganatttttncntgtgtnggtagtcgtntanagtgttagcaggtaactggaatgtgntgtgttggtagtatgaatggatngaggaagtgtatagtatctacgntgggtgctgatantgtttttnaaatgttttgaattgntgcgtcggtgnacatgttgattagtnctagtgaaattgtanatatttgttgtatacg

SEQ ID NO: 80844 - DNA, 565 bp, Triticum aestivum
  unsure (1)..(565): unsure at all n locations
  Clone ID: PAT_TA_80844
ggtgtaataccctaatccagtgtgtggtgtggtggattgcctctggggcctatgaggaacagtacagaggaagaacagcctcgcgaggggtgttcttgaactggtgcagtgttctactaaggaaggattcgatcggatccccttcctactgtggtggctatctctatttatagaggcccttgtcctcttcccaaatatcgggcgggaagggagccaacaatgtccattttgaagggggacaactagtacaagctatcctgactaaagttggtcttcgtctgccaaaggtgctggtgatgacgccgtcttcggctccacggtgatctccgtcctaccgctctgctggtcttggtctcgtttcaccgatatggaaacctttgcatgatgcctcggtactccgcgcctgtgcttgccccctttgcaccaaagaggaaatgtggacactacgctggctggcgccgctggtctaatcgcatggttggtatgagactacaaggaacaattgcttattntcgctctcggagcagctagtaagcgcctagaactttttncgccngaggttgcn

SEQ ID NO: 80845 - DNA, 276 bp, Triticum aestivum
  unsure (1)..(276): unsure at all n locations
  Clone ID: PAT_TA_80845
ncctggngnctggaangaaatactgaaacaatcaagcgttccccagcanctagaaagtntaggcagatanagngaccgaagatgagnggggtgaagcnaggtgaaggaagttgaggcccaaggcngggnacgcgctngacatgggncggcctggccaacgangctcgtatagccgnggccncncgaangacttcgcnaactcaggagcaccttcgcggccgtnccacccccgctcccgaccacgttctcccggaacccanccccntgnatgggaat

SEQ ID NO: 80846 - DNA, 536 bp, Triticum aestivum
  unsure (1)..(536): unsure at all n locations
  Clone ID: PAT_TA_80846
gccgagttcaaggnggccttcagcctcttcgacaaggacggagatggttgcntcaccaccaaggagctgggaacagtcatgcgttcgcnggggcagaacccaacggaggctgagctccaggacatgatcaatgaagtcgacgctgatggcaatggcaccattgacttcccagagttcctcaacctgatggcccgcaagangaaggacaccgactcacaggaggagctcaaggaggccttcagggtgttcgacaaggaccaaaacggttcatctctgctgctgagctccgccangtcatgacgaaactcggcgagaagctcancgacgaggaggtgganganatgattcgtgaagccgagtngaggtgatggcagancaactatgaggagtttgtaaggtatgatggnaaatgagaaccaaacgtgttcaaaanangagagatttgattgatatagttagataaatttattgnnggttcagtagatntantagtgngtgtaaaggttgaggggattctgaactttaangtnttaaat

SEQ ID NO: 80847 - DNA, 304 bp, Triticum aestivum
  unsure (1)..(304): unsure at all n locations
  Clone ID: PAT_TA_80847
cgcacgcacgagtgaagtgagagntttgnacgaaaagttnatnagcgaccatgaagggcacgaagctngcggcgatcntnntccctccaggcagtctggtnatgggagtctctaanacgtgaacgccgantatttcncaagtgctgcaanaatgcaggtncttatccggggncgnagtntgcnagangcccacnccaagtgcccaagggntgctcggacgtgcncgtggtgtngncgagcccgaaatgtggcgtgcgggntatgnaatccacgtcgnggcnctgcggtgggcctgcangaagta

SEQ ID NO: 80848 - DNA, 411 bp, Triticum aestivum
  unsure (1)..(411): unsure at all n locations
  Clone ID: PAT_TA_80848
cggagaaggccccggtcccggccgggaagaagcccaaggccgagaagcggctgccggcggggaagaccgccgccggcaaggngggtggcgacaagangggcaagangaaggccaagangagcgtggagacgtacaacacctacatcttcaaggtgctgaagcaggtgcaccccgacatcggcatctcctccaaggccatgtccatcatgaactccttcatcaacgacatcttcgagaagctcgccggcgaggcccccaagctggcgcgctacaacaagaagcccaccatcacgtcccgggaganccagacctccgtccgnctcgtcntgcccggcgagctnggcaagcacgccgtgtcaganggnanaaggncgtcanaaagttaactnntnctaggctntgctttttntg

SEQ ID NO: 80849 - DNA, 523 bp, Triticum aestivum
  unsure (1)..(523): unsure at all n locations
  Clone ID: PAT_TA_80849
cggtggacaaggcggccgcctggcagctcttcaccacccaggccgccaacnaaggccgnactgtcgncgntcactttggggcgtcgtggtgngtcacgtcnctgtccatgaantacaagtttgaggagcttgnccagacncaccnagacatgctcttcntcttcgtcgacgtngatgatgttaagggcgtgtnttcnaagctgggggtgaagcnatgnccaanttcttcctgatgaagggaaggaggtggtgaagaagattgtnggtgnaaaacnggaagagcttcacaagatggtggaagcntccgaagaagattngnttggctctgctgtgancactttncctgacatagtcatncgaaaaatagttgttttggtcntgaatgttctcgagtgtgttggttggttcggtgtgtgtgtgtgtgtgaatntgaatctatctgatctgattgatggtgtgccttttncggtanaggagataggggtntnattggtaatggtaaggtaattgntgtganaagnan

SEQ ID NO: 80850 - DNA, 529 bp, Triticum aestivum
  unsure (1)..(529): unsure at all n locations
  Clone ID: PAT_TA_80850
gatgatacaaatatggttagggaggagaacaacaaagctattgtctcctccctgtgtaagctaagcacccagaatctccgctccctgaatatttatgcagggagcagcctcttaacggaacctttgtgcctgccgaccctcgagaaacttattacctggtcctcagacatttcgcaggttccgacatgggtaagctccctcagaaacctccaagtgcttcgccttacattgaagggaatcaagaaaagtgatctctgcatccttggagccttacctgctctgctcattttgcatctggaggaagtaacacggncaaacgaaaagataagaatcagtggagaagttgggttccattttttgaggattttctattatgaagcacattatgaaccagtagatctaatattgtntggggagggtcatgnccaagcntganaaaatcgagtttataaaccgcacgtgantgangtgactgctggactttggatgagaactccctgctcaaactgtgaatgtattatgatggngn

SEQ ID NO: 80851 - DNA, 178 bp, Triticum aestivum
  unsure (1)..(178): unsure at all n locations
  Clone ID: PAT_TA_80851
caagaaaaaggntgtggagtnggaggagaacactntgtatgantacttgcntnatcctaagaagtacatctntgnaacaaagatngtattaactgggntgaanaagccacaggaccgtnctgatntaattgagtaantgaagaaagcacctaatcttgaaagggnatgatnatgctgt

SEQ ID NO: 80852 - DNA, 559 bp, Triticum aestivum
  unsure (1)..(559): unsure at all n locations
  Clone ID: PAT_TA_80852
ctcacctccctccaggagctgcaattttcagcctccgaaaacgagcggcactgctacctctcgaagctgcagtgtctccctgcagggctagacaagctcatcaacctcaagagactaatgatcaattgttgttcatccatccggtcgctgcccagccttccgagctctctgcaggaattagtgattgacaactgttatgcactccagtcgctgccaaacagcctcccgagttctctggaaatattgagcatctaaggctgtcagcatcaagtcgctgccagagagccttccgagttctctgaaaaaaatgaagatctccggctgttgggccatcaagtcgctgcccaaggacgggcttncaagttcaatgctagagttagatgtcaaccttggcttggacagcgacaacttaagaaaggagtggcgaagctaaaaggaacattccgatagtaaagtataattaatcaaggtcntgattcnaatctctgctctagaactcntcanganatgtttggtgcanatacgtctaaatgantgcatctgagncaanaatgggtga

SEQ ID NO: 80853 - DNA, 203 bp, Triticum aestivum
  Clone ID: PAT_TA_80853
cttcagcgccggctgcctggtcgcctgcggcttcgcctccgttggctctgccatgggggtgttcggccccgagagaagctagctgcgaccaactgagccaaaattaataatctctacttagctaggatatgtataaatgggaaagatataattcaaaggggaacacgccagagatattttaagcaccaatgtgacattagcaa

SEQ ID NO: 80854 - DNA, 238 bp, Triticum aestivum
  unsure (1)..(238): unsure at all n locations
  Clone ID: PAT_TA_80854
nngatgatgacanccgtnacgcttacnggngatactagataacggcgaaactccaantcctttnactagaacattcaataatacttctttgtccntctggaatctcatnatncaaacttgaattgcataacatgtggantgggcttgttgaaattnagacataactgagatatttgtgntttatgttggacctcatnattttatgggtngnnagcttatttnattgaaaaaaaaaaaa

SEQ ID NO: 80855 - DNA, 484 bp, Triticum aestivum
  unsure (1)..(484): unsure at all n locations
  Clone ID: PAT_TA_80855
angaagctcatagccattcanagcctctccatctccgangctccaacccaacctcgaagatgtcttgctgcggaggaaactgcggctgcggcaccgcctgcnagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctaganccatcatcgatcatgcatgcaccgtgccgtgcgtgcatcatcgatcgtatcgatctactataccataccatgtaacgaactgattgaggggctttatgtacgnactgacctgcatcagagtcaggtgcatgcatgatttnaaagggccnctaaatnaacttcttantactaaanaaaaaaaaaaaa

SEQ ID NO: 80856 - DNA, 470 bp, Triticum aestivum
  unsure (1)..(470): unsure at all n locations
  Clone ID: PAT_TA_80856
ctaccaagaccatactagtatannccaggngcaacaccgtgagtgcnttcgcaatggcgaggcgcctggcagtcgtgctggttgtcgcggcggtcgtncttctccttgtcaccgccacggccgcccggnccgacaagccggagggcnancaaggcagacaagcccaaggggcctgcnganagaccgcccaangcccaggggcccaagcngaaggagcccaaggcagacaagccgaagggcctgctganaggccgcccaangcccaagggccaaagtcgaagaaaagccgatgcacgtnaagtgagcgaganctgcaaganggactnaaaatcgtagtnaatgtaatcttggagaagtcatatcnacnaagnatanatgtggtcattgttgaaantttgantttgtnttttttgtatatttgtttttaataagttatttttgaangtgnatnaaatttgaataattaaaan

SEQ ID NO: 80857 - DNA, 565 bp, Triticum aestivum
  Clone ID: PAT_TA_80857
gatatatggctaattgtgtcagattgtttaagccgccatgggaaacagtagcaattaaattatttaaatccactatgagtgatcaggattattcattgagcattgcctctttaagccggcgataagagtcgccatggctaactgatacagttttttgcctaattgtcgcacaaacaagtttcacaggttgaagctgttattttggattaaacagtcgttcagaaaagaaaatattctagacctaaaaactggtacagatgagtttgagaattctaatgaggcctctgaactagagaaaggaatctactagcatctgaaatggatgcgaaacggttaccgcacaagttatatgttctttttggatcagaagaagccgcggtggaggaaccacgaagaaacgttgaagaaccatgaagaacacgaaagaagttgaaaaccctaaatgcagatctgaagtgtgggaaggtgaagacttacagctgtagatctacctgcggaggatcgccgccgttctctagtcaattcaggttgatgcagcggccagattcgacgagatgagtggtct

SEQ ID NO: 80858 - DNA, 515 bp, Triticum aestivum
  unsure (1)..(515): unsure at all n locations
  Clone ID: PAT_TA_80858
ccggacctccgcgccgcncacggcgcccgcccttcganccgcacgccaccgtcgtcggcgccgtgccatgcgccgccccgccgcaatccaggccctccgcgccgccgcgcgccgccgacgtcgccccctacaccgcccgcgtcaccggcgtcgcncgcgggantngcttctaccagtgcgtgtacctcctcctcgagcccacccccgaggtgatccacacaagcgaccacttctgcgtncactttgggtttcaganatcaaccccatatatgccacatgtcagcctcctgtatggggatctaacagacgaggagaaggaagcancaaggaanaaggtagagganatgnacagtnaactatctggactgcagtttganatctctgagctcgcactttattgaagggatactgaggataaaagctttnagtcctgtgaactgggtggaggtttccacttggggaanaagtgatggattccttccngatgatatggctttctnctgtaagtggttact

SEQ ID NO: 80859 - DNA, 520 bp, Triticum aestivum
  Clone ID: PAT_TA_80859
gttgcttacccatcgagactagcctttgagtattgccggcaacgtgacttatgcacattagtgatcatacaacatagcatacatatcataacatagtggtgcatatcttgagatcaacttgtgtgtcacaaagtggtcatagcatacgcaattgctatcttggttcgtgaagttttgcatgagaaaagagctccaaagtgaagagccacccaagcttttaagcaaaagagaaagataagcaaagagcttataagcgagaaccatagcatcatacaacattaagattgtcatatccgatcatcttggatcatagcactgaaatatcatacatatagcatacttgggatagagatcgtagcatttttgtctagtaggttgtgcacaagtttgtgtatccgcctattgtggcaatcgtgctagcgtctctctagtattgtgcaacaagagcatttcgtggtttccacattttggctcacttttgggttgcacaatcccacttatctatttgcgtgtgtgtttc

SEQ ID NO: 80860 - DNA, 568 bp, Triticum aestivum
  unsure (1)..(568): unsure at all n locations
  Clone ID: PAT_TA_80860
naaanaancnnntcctnganncgcngnctcgcnccangccaccgccgcanncgctgcaaagangccgttcaagangttcgttcgagatcgggcgggtggcccctggtgaantacggcaaagactaangccgcntngtngtcnaacgttgacgttgtcnaccagaaccgggnncttgtggatgctcccnanatggtcacgtgccaagatgaacttcaancgtctttcgctgaccgacattaaaaatgaacatcaaagcgtattccctaagaagggccaattttgattcaaaggcnatggaggaaanctgatgtgaaaaaccaaatggggagaacaagctcatcggggnaagaagcttttttttcccnnagaanaagagcattcgctgaatgactttnaaaaggttcaaantcatgnttggctaaagatttaagaagggtggtgctatnaaggcnaanagcttgccaaagcttccagaangaaggttgctgcttanaataacttaattggntgaacatntttngtntttttgttccaagtnggatccgctccaangttccaatgnttctt

SEQ ID NO: 80861 - DNA, 302 bp, Triticum aestivum
  unsure (1)..(302): unsure at all n locations
  Clone ID: PAT_TA_80861
nngccgagtcgccgcngtncgacgcggtcgtntggggcntccttgggacantgcgctgggngctccggtccttcangccaaagtnnggctcgaggntatatcgtgcactcgtgcgtacatgcntcggtgcatgantgtncggctggggtgtcctagggtgcaccctgtttctttcgtgatttgcntcagantgtttggngantttgagtgtaactnatcanttgtcgtntggttgtncgtgtttagtcctcagtttntccntactcaactcacccgttgcancaaaaannaaaaaaaaaaaa

SEQ ID NO: 80862 - DNA, 294 bp, Triticum aestivum
  unsure (1)..(294): unsure at all n locations
  Clone ID: PAT_TA_80862
gttgccatttcaatgcaacgagaccaagaccaggaagactgcaagacggaggtcatcgtggagcccaggacggcgtcaccaccagagctttgtgcaggtgaagactacttttgtcaagggancgagtactaagctgtccccctttaaattaagcttgcaatttttggttcctttccggttcataattngggaaaaggacaagggctttattaaaaaggacaagcaacccaccgaaaaaaaaggttcgaaggggtccantnagagagagaganaganagagaaaaanangggtgg

SEQ ID NO: 80863 - DNA, 454 bp, Triticum aestivum
  unsure (1)..(454): unsure at all n locations
  Clone ID: PAT_TA_80863
ccacccgtctccgcccatcccactcctcggcctgacgggcgtcccaccgctgccccgtccccgacgcaccacctaccgccggcccgctcgccccaatgccccacctgctgctggccacctgagccgccgccctcattcgcgtgctgtgccgtggtgacgcgcgcccgtccctccctttgccctgctgccaaatccacaacgcgcacccccgcgaccctctcccagattcaccggtacaggtagtgccgccgcattctctggcatggccccggcgctccacgcctctgcccgatctcccggctcgcaacggcgcgattcttcacatactaccagatttcatcggaggaggtccccctgctgcacctccgcctcctgggtcccgctggcggaactcgcctgttactcctcatggctgcactaactttcccttttnccttttncccctttttttttt

SEQ ID NO: 80864 - DNA, 490 bp, Triticum aestivum
  unsure (1)..(490): unsure at all n locations
  Clone ID: PAT_TA_80864
cccaaattggtcaaggggtcttcttgctcaagcgaacggcggcagtnggcganggtcgaagaacggcggcaacgattgatggctgttagcgaggagctcaacgtcgtcgacggcgagaaggcgaggccgtggaagtgctgcgaccagacaatgtgcaaccaaggtctgccccgccgacctgcttcttgccaacgacaaggtgaagaagttgcgccaagacctgcaagaaactgccttcaagggacgacttcggggcaacttcccttccgcgtgtgcggcgaccccgtactttcggctgggcccngggcccaaagtgcaccaaggtctagcgttcgccgccgacgttccgcccgcngtgtctaagctaacttaggatgttgcatgcacgcccagctctatcttgcactgggcgatggttgaacgaataaagtgaagttgattcggccggcccggttnaantttttnggggggggncccccctttttttttt

SEQ ID NO: 80865 - DNA, 571 bp, Triticum aestivum
  unsure (1)..(571): unsure at all n locations
  Clone ID: PAT_TA_80865
catcgcctcgcgcccgcaccccaggaagttcaagggctgtcctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggattcagcacccctggggagggaacaagcttcgatcaatatcagatcctcaagttacccgctttaccantgagttntgcaatggaagaagntcggagggacaacaacacantcgtctttcattcgttcggacctggaaggccggacaagaagaagatttaagggccgntgttcaagaaatgttacgacatttcagggccaagaaggtttaacacccttcattcagggcttgatgggcaagaagaaggcgttacgttgaagctggacaccagacttacgatgctctttgatgttgggncaacagattggcatcatataagtccagagggagggtcttgcntaggg

SEQ ID NO: 80866 - DNA, 430 bp, Triticum aestivum
  unsure (1)..(430): unsure at all n locations
  Clone ID: PAT_TA_80866
ngttcgtgctggtctcccccgtcttcnctgccnccgaacgcccagcgccncacagagcactcccacgtccccctttnggcgccgcttcccatcgggttcgccgtgttcctggtgnccctggcgacgctccccatcncggggancnggcntccccccggngaggtccctcggngcngccntcctctaccacncgaacgccggcgtgggacgccnactggctnttctgggttggtccgttcntnggtgaggngctggcggccatctaaccangtggtggtgnttcngggaactnccttacngagacgngaatagnaagncattaagtctgaagaacctangaagggtggctcttntngntgttcatagtngatngtcaatgnggtggtngttgangtagcgtaagtggannttnagaaagtgnattntntat

SEQ ID NO: 80867 - DNA, 339 bp, Triticum aestivum
  unsure (1)..(339): unsure at all n locations
  Clone ID: PAT_TA_80867
gaggngcaacttccgccantgcattaaaccccacatataccttcctcaaaacagcaaccatanctacatactatggccatttncatanccattccganatatatttacatgcaacttccaccgttcccattttattatgacacatacgatcattgtcatattgctctncaatgatcatgtanttggcgatantgtcggtgcaacaaacattcatgtatgttgcccagagtgtancacaagcgcgatggcgangcntacaacancaccganctccccaagtcgcncancaancgananagatcanantttgcantcaatccaaanggnggattcaancaa

SEQ ID NO: 80868 - DNA, 433 bp, Triticum aestivum
  unsure (1)..(433): unsure at all n locations
  Clone ID: PAT_TA_80868
gaaaaagcatcgtctcgtctcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctggaagcaaagtgcaaggagcatgccgaggcaaagcatccgaagagcgagctcgttccagtggctttcccttcaccttcaagcagttgattttttgcccaattcaggacagagagagagataaaaggaggagagagagagagaagcttttcataattccacttactatttatcatgtttccgcatgactgaatgtttgacctaaaccttggggtcttgaancccggggtgctgcngt

SEQ ID NO: 80869 - DNA, 254 bp, Triticum aestivum
  unsure (1)..(254): unsure at all n locations
  Clone ID: PAT_TA_80869
cancgtcggcgccaacatcctggtgggcngcgccttcnccggcgcgtccatgaaccccgccgtctccttcggccccgccctcgtcagctgggagtnggggtaccagtnggtgtactgggtcggccccctcatcggcggcggcctcgcggcgttcatcttacgagctgctcttcatcttcccggcacccacgagcagcttccccaccaccggatactgagcagcgagctcagcgncagcagcctgttgttgcctg

SEQ ID NO: 80870 - DNA, 507 bp, Triticum aestivum
  unsure (1)..(507): unsure at all n locations
  Clone ID: PAT_TA_80870
gaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcgggcatggagatggcggcgganaanggcggctncggntncacccagtncaagtncggcaccagctngcggctgcttcctgctggcagctgctagancgtncatncgaccatttgcatgcaccgtgccgtgcgtgcancatacgatcanttcgatctactactaccattaccatgttaaccgcaacttgatncgaggggctttatcttatggnactggacttgcatcagcagtcaggtgncatgccatgatttgtaaacagggccccctnaataaattttccctggattaacttaaaaaaaaaaaa

SEQ ID NO: 80871 - DNA, 422 bp, Triticum aestivum
  unsure (1)..(422): unsure at all n locations
  Clone ID: PAT_TA_80871
ggcggcggcggcggcggcggccgcaagggcaagaagaaggggtccgtctccttcgtgatcgactgcaccaagcccgtggaggacaagatcatggagatcgcgtcgctggagaagttcctccaggagcgcatcaaggtcgccggcggcaaggccggcaacctcggcgactccgtcaccgtcacgcgcgacaagagcaaggtcaccgtcacctccgacggcgccttctccaagaggtaccttcaagtacttgaccaagaagtacttgaagaagcacaacttcggggactggctttcgcgtgattcgcagccaacaaggagcgcaagtgtacgaactccggtanttcaaantcgctgaaaatgaagggccaagaagaaganttanaancactgttaaatngnagagcctgttgagattttagaca

SEQ ID NO: 80872 - DNA, 533 bp, Triticum aestivum
  unsure (1)..(533): unsure at all n locations
  Clone ID: PAT_TA_80872
tcctcctctcttcgaccacaatacagagcaaatcttcaagctcagacatggctttccaccaaagatcgacaagtttgccttctaggcctcacgtcagtananccgaagtcgagctagagcttcagagcctagaagcaagcatctcttcctctaattccatcagcatgatgtgcgatggtctcaggactcttgcaaacatctacgatggtcttgaagaaatcatctgcctaccaagcaaccaagtttggctcctcccagcagaggagcatgttgggatgggagaaatgggacggttctcttggagctggcttagatctctggcagcgccatgcaagagatctttgtcgagatgaaggccatcatccaagagctgcaatgggctctaagggaaagtgatgacggcagctacttcaggttcaagattccaatccttacacccgcttggtggaagaagtcgaagaatctttttcaagaagaccggcgaagaaggtncctggcagatgtagcatggtcatgctgttgggccagggtag

SEQ ID NO: 80873 - DNA, 401 bp, Triticum aestivum
  unsure (1)..(401): unsure at all n locations
  Clone ID: PAT_TA_80873
ccncggcgacgntnnctgctgctngggctctcagggctgctgctgtngtgangacgagacggtganaacgcgaggtagatatgcgagctgaagcgctcantggatcaaataagctggctggatggctgaatctgcactgccagtaatttacattttatttatttattcaccgctgtaattttntctattttttgctcctcnctccctctctgcttctgtgatttattntgtgccnggtatagaatatatangagaagtnaccaatgtanancaanggcgannaataataaancnccantgctgttttntnaaaaaananaanaacaccncccacacaaccccccccccccacccccccccccccccccccccacccacccccccacccccccnccancacc

SEQ ID NO: 80874 - DNA, 377 bp, Triticum aestivum
  unsure (1)..(377): unsure at all n locations
  Clone ID: PAT_TA_80874
ggccaagatctacctgcaaaccaagcagataagctgccgcctacctttgcgcccccccctnncccccactcttctctctctctcactctccatacaacttgctctgattctgaatcagttggtttcgccatggacgaatcgtcaagctctggtgtctgcacaatttttttctccccctttgggcattgatgcacacatgaatggtgatgctgcgatttattacatgcttatactggttaatcataaaaataaagggttcctttctttggtgttcatcgcatgtggtgcgcaacgtggagatggaatgtaattatgccaacaagggagtaacctttgagatcaatgtgaataacagtatgtggtctaaaaaaaaaaaa

SEQ ID NO: 80875 - DNA, 519 bp, Triticum aestivum
  unsure (1)..(519): unsure at all n locations
  Clone ID: PAT_TA_80875
catccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaaggtggacacatcgtcatcaaggcccgtccctgcaagttgttgaggtctccacctccaagactgggaagcatggttcacgcaaatgttcanttgttgccattgacattttaatggaaagaagntgagatatcgttcctttcatcccacaangtgacgtcccccatgttggaccgccaagattatcagctgattgacataactgatgaggatatgtcagccttctcantgagagtggtaacactaaggatgacctgaagnttcccanggatgagttctgctttggncagatncaagangggattgctgatggggcaaggactgatcctgtctgtgaagtnccgccangggtgga

SEQ ID NO: 80876 - DNA, 518 bp, Triticum aestivum
  unsure (1)..(518): unsure at all n locations
  Clone ID: PAT_TA_80876
cctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcgggtcgagatcaacaagcaggttggcaacaggatcatcaagaagaggatccatgtgcgtgtggagcactgcagccatccaggtgcaacgaggagttcctccagaggaagctcaacaacgacaagctgaagcgnaggccaagcgctggtgaggtcattcagcaccaagagcagccagcaggccccaagcngggttcatggtggaggggcaccaccattcgagacgttcacccccattcccgttacgacttcgttcaacgatcttcaagggtggtttactagagcgntgttgtttnctgagcagaagnttgagccatttctttagtatctatgctgttcccatgtttttggtactgagtattcnctttttttgcnncgcggagtgtgan

SEQ ID NO: 80877 - DNA, 458 bp, Triticum aestivum
  unsure (1)..(458): unsure at all n locations
  Clone ID: PAT_TA_80877
gagaccttgagaggggctgtgtggatgagcagaacagtgaggcccaggtctacaactccaaacttgagaggttgcttcgaacattgcaaggctcactcaaaggaagcaaaattgtgtacttgaatgcgtacgaagctttcacggtgatccttcagcgcaccaataaatatggattcacagagacaacactgggatgttgtgggactggggctcacagagttcggaattactttggcaacatattttacccctattctggcagggaatgtgtcanccttattatatttcatgnatggcggtgcacccgacagagagggttttataggganagcaaccgntttacatagttgaaaaatgtaattcccacagtttttaatggaattcaaatngctccaaattaaganatttnctctccattnccatttaaacgaattnaacctaaatggcgttttgattca

SEQ ID NO: 80878 - DNA, 523 bp, Triticum aestivum
  unsure (1)..(523): unsure at all n locations
  Clone ID: PAT_TA_80878
ttctccttgaaatctttttgggttcacagatttggaggatgtcttgcaactgtggatccggttgcagctgcggctcagactgcaagtgcgggaagatgtaccctgatctgacggagcagggcagcnccgccgcccaggtcgccgccgtggtcgtcctcggcgtggcgcctganaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctganctgatggagtcgagcaagggtgcgtgtgcgtgtgcgtgtggtttgcttgctcgctctcccatgctctgccatggtgtccttgtgtgatgtgtgtgtgatgtgtccctgtaattncntatcatcccactatggatggagtnatgaatatgtnagactgaagantaccaataacactctaaaanaaaaaaaaaaaa

SEQ ID NO: 80879 - DNA, 439 bp, Triticum aestivum
  unsure (1)..(439): unsure at all n locations
  Clone ID: PAT_TA_80879
ntccctntctctcgnngctaggcagctagancttgaacttgttgttgcagggccggccatggacggcgggaagaagggcggccgggaccgcaagcnggcgcaggagcgcacncacngcaagtngggcaccgggatgagcggcgacgccaagaagggnggccgcggcggcaagttcacctgggagggcgccgacggntacaccgacgaggacctcgacctcgtcgccagcaagggngnngggagcngngcctccgcctccggcaagaacaantcctagggtgntgcctcgcncgcncgtcgcnttcccgnncgancgatcgnnagttnctanntcgtgtgagttgataattaantcggtcgtagngngtttggcatgncatatgtatnttnccagncgtagccttcnaatnnggtgntggnttcgnctaaaaaaaaaaaa

SEQ ID NO: 80880 - DNA, 553 bp, Triticum aestivum
  unsure (1)..(553): unsure at all n locations
  Clone ID: PAT_TA_80880
ctgatgctacacccgcacttataaaatccattaaggatattgataatatatattatgagaccgaatatagaaaagagtggtgcacaagtaatgagagaccagcaccttgcttcctctttgcaaggaagtttacacgcggaccggtctgaagcttcttaactcatcatttatagcagcaagatgatgagtatatagtgcaggggacatctgccatgtaaaggttttctcccttacaagcagaatactgccagtttgcatatacctaaaggaaaggggtggaggtgacagaaaatagcagcgatttttggcctgtgttagatataattngttgtactctagaaagtacaatagggtgttgtaaagagataaacttatgcttcatatagcgctaggttagtacacatgttagctcacagctcagctcagcattgtaactggaaccgtaagcactatccacagttggantggagaccacttaagtctatcttgagaaaancttctgaaattatggagcagttnacttgtggcaaanaaaanaaanaaaaaaaaaaaa

SEQ ID NO: 80881 - DNA, 264 bp, Triticum aestivum
  unsure (1)..(264): unsure at all n locations
  Clone ID: PAT_TA_80881
gtcaccggtcgctccggccggnctgaagtgtngntctgtgcgacgnagnnggctgcctccngcaantgcgctntggttgctcgaaccnacncctttgtcctgttcngtgtctccggtctttgcctcntcagctgctnccgttcctcggcttgtgcntntgtcgacgtgnccgtccnttcgtacgtcgacgtgttccggagttcgccatgtttgcttgctgctgtttgttccaagtgtgcttccttttcctcgctctatgtnctc

SEQ ID NO: 80882 - DNA, 390 bp, Triticum aestivum
  unsure (1)..(390): unsure at all n locations
  Clone ID: PAT_TA_80882
cagcagcccatctacaaggcacnacatcaccctnggcngactacgancatccnacgcacggcatgggcctggagcctcttacctacaactaancnctcngggcnattgccaggttggtcaccctattgttggcctgccgatgcatanctttggttgcattccaantccccagtgtcttccaganctccaatgtgtgggntgcaacttcagcggagctcatnattatnaantcagtgccatttattgtnaccccatgcatgcattcattgcaccagcntgcaaacatcacttttcctgtgcatcgcactngcgcaatctcaatgtgctgttnatgtgcaagtttataaataaacataaatgtctttactggggttgtgcaaaaaaaaaaaa

SEQ ID NO: 80883 - DNA, 335 bp, Triticum aestivum
  unsure (1)..(335): unsure at all n locations
  Clone ID: PAT_TA_80883
ggaaagaagaaggccaagaagagcgnggagacgtacaagatctacatcttcaaggngcncaagcaggtgcaccccgacatcggcatctcctccaaggccatgtccatcatgaactcctncatcaacgacanctttgagangcncgcnggcgagnccgccaagctcgngngggtacaacaagaagcccaccatacangtaccngggaagataccagacctacngnacngaccnacgnanctacccngggngagnctacgaccaagncatgactgnactacngaaggggcancaagggcngntcaccaagttacaccttcataccttagggtacctc

SEQ ID NO: 80884 - DNA, 519 bp, Triticum aestivum
  unsure (1)..(519): unsure at all n locations
  Clone ID: PAT_TA_80884
cttactttttatacttttcagagtttcacatactttatatttcagagcacttgagagactgcatcgtaggaaattcagaatgctttcatagagtgattcaggtttagtgtagtgaatagcctggaacttcatgtcaaataatcaaagtggagtataataccaactccattgatatatgtatgctcatcattcctttttgttcccatcggttgtttcttttcacatgattgattttgttggcactactttggcatcaggggagtggaaaaanatatagggactggataagtgtactcccttccttcctaaatataagtctttagaaatttaatngggaccacatacgggaaaaaaatgagtggaacctacacttcaaaatagggctatatcatccatatgtactccatattnnntctcttaaaaggacttatatttagggaacgaggggagtagtaagttactctagtttaacctactagcggtaaanttcancaacggnggacaaattntccatcaggg

SEQ ID NO: 80885 - DNA, 342 bp, Triticum aestivum
  unsure (1)..(342): unsure at all n locations
  Clone ID: PAT_TA_80885
nnaccgncgcnccgtggctcccctgcttcctcgtggtgtacanngtcaagcctcccccngagctctccacctcctccagcggccnctcccgctgacccgaccgacgccggccatgaacggnatcccnngcnccgatcagcaccgctccacccnctaatccgctaactgctanctaggcttggatcgatcgaccttcctccccccattcctccatgaccgatcgatgcaangtgtgcatgtgagactgtaaaaaacggccattgtttcccacccccacgattgttgaccgaaattgtaccatacatcaatcaaacaaatgcagctgctgctaaaaaaaaaaaa

SEQ ID NO: 80886 - DNA, 586 bp, Triticum aestivum
  unsure (1)..(586): unsure at all n locations
  Clone ID: PAT_TA_80886
gttgagtcatccgacaccattgacaacgtgaaggcgaagatccaggacaaggagggcatccccccggaccagcagcgcctcatctttgccggcaagcagcttgaggacggccgcaccctcgctgactacaacatccagaaggagtccaccctccacctggtgctccgtctcacgggtggtatgcagatcttcgttaagaccctcaccggcaagaccatcacgctcgaggtcgagtcatctgacaccattgacaatgtgaaggcgaagatccaggacaaggagggcatcccaccggaccagcagcgcctcatctttgctggtaagcagctcgaggacggccgcaccctcgctgactacaacatccagaaggagtccaaccctccacctggtgctccgtctccgtggtggcagtaagtgctggccatggagctgttatgtctgtgggctaaaagtcggttgctttctgtgtctccgatcggnttgtagtgtgtctcgtctggnttgtgnttgtngcaangtgtgtggnnagtgtatgaantatgttggntgtgtcgtnacttnttnacggagagattgangaatgtna

SEQ ID NO: 80887 - DNA, 174 bp, Triticum aestivum
  unsure (1)..(174): unsure at all n locations
  Clone ID: PAT_TA_80887
ncaactacagctcttatgtnacacaccttgacantggtgcggtggatatncntcncacantactaggnatgcctgtcagcntatctcccatnnacaagtcgatcaaacagctcaatagagnagtgntgaaagtggattctgaanttcaggctntgcaaacatggaaattttggt

SEQ ID NO: 80888 - DNA, 556 bp, Triticum aestivum
  unsure (1)..(556): unsure at all n locations
  Clone ID: PAT_TA_80888
nccgcagcttcccattcctcgccgccgccgctccgtacccgcncgacgccaacccgaccatggcggacgtcgacgttnacacggaggtggccgcnggcgcgcagcgangangaggacgttccgcaagtccagctatcgcngcgtggntctcgatgccctcctcgacatgtccaccgacgaccttgtccagatgttccccgctcgcncccgnagaaggttcaagaggggtctcaagaggaagcccatggcgctcgtcaagaagctgcgcaaggcgaaaaaggaagctcntgntggtgagaagntgagncagtgaggacanatntcgtaacatgatattgtcntganatgattggcagnttatnggtgttagaatggaagacttnaancaggttgagattaagctgagatgattggnattaanttgagagtttgtatntgtaaaagnagtgaagaaggtaggcaggtatggtgaaaaaattctggggttattntttaatggtatgggtttcaatttnaagattaataggggattggtggatgnaatnagtgtttnttt

SEQ ID NO: 80889 - DNA, 579 bp, Triticum aestivum
  unsure (1)..(579): unsure at all n locations
  Clone ID: PAT_TA_80889
ccaaggcttaaacaccttgagttcaccttaccatccaagtggatctcccgtgaaaactttgatttgggcatgcggcatctcccttccctcgagcgagtcagggttcgttttatcgaggagggagctagccgtcaggaggtggatgatgaagcaatggctgcgctaagggccgcagcggaggaccaccccaaccatcccgccctttacatctggtgacgcatgcaaagggaaaggcggaccaagcgattgaggctcgcgagtttcaggcagccggcccgagtgcttaggacgattcgtcgaatcttgcacccaggtagcatgagctaataaatttcgtcgacatggactcaatcgcgcgtgccttaaactccggtgccatttctttttcaaccaatacagtcgagnacactgcgtttgccttgttgtttgatctgtcttattccgcaccgagatgaagctctcattctgtccaccanccatgttgaagttcttctggttcgtcaattcaacaacaatcagtttgaggngccctgatttgcctatgaacatagtacatgatganatgctgntggaggnccn

SEQ ID NO: 80890 - DNA, 514 bp, Triticum aestivum
  unsure (1)..(514): unsure at all n locations
  Clone ID: PAT_TA_80890
gccagtacggcccgcaagcggcgggccccttcgatcaaagagacatccgaagtggcctgtcctcccgcagccggccctaggccgaggccggcttccaattgccggcttgcttccccctcgggggcgcgcacatcattaagcggataagacacggtaaggctacattgggagcccgcaaggcggcggacactatagccatgctttaccacgggcggagccttcgttcattcagagggcgaggcaacagttaaccagcccccaacaagaccccttgggcggtggggccggcctgttcggaccagcggagccgacaaccggcggggacccaccattgggcggggcccccagaangcgggnaagagaaggcggcggttcaaattacattaacaacttgggcccgngcttaggccggattacgtttttaaccccggggggnangcctntanaaaaccccccgggggaanacnattnaaggggggatnttgagaaaattnttaaaaattnnccatagggg

SEQ ID NO: 80891 - DNA, 524 bp, Triticum aestivum
  unsure (1)..(524): unsure at all n locations
  Clone ID: PAT_TA_80891
aagccctcccacggccccatccacttccgcgcccccgccaagatcctctggcgcaccatccgcggtatgattccgcacaagaccgcgagggcgaggccgcgctcgccaggctcaaggcgtacganggcgtgccgccgccgtacgacaggaccaagcgcatggtcatccccgacgcgctcaaggttctgaggctgcagcctgggcacaggtactgccttcctcggccagctcttccaaggaggttcggatggaattacgccgacaccattcaggggagntggaggaaaagaggaagggagaaggccaagttntccttacgacagggagaaagcaantgggccaagntccgnttcaaggccgagaagggcagccgagggagaatttgggaantcagntggagattcctggctncgattnaattacttaagagatattcagagnttttcgttgcngcattagttttttggggaacttctgtctatttcnaatagttttggnaactctggatagtnaatctggttngg

SEQ ID NO: 80892 - DNA, 198 bp, Triticum aestivum
  unsure (1)..(198): unsure at all n locations
  Clone ID: PAT_TA_80892
gtcncacgagagngggatagngagagagtgngagagcgacaggnggaggaggaggacgaccacgagcngggggaggnggaaggngcaaggntgggtcagagcccccttntccggctgccggtggcggagcagattcagccagaggtggcaaccggtggcagcancaggcaggancnacctggcaagtcttcaacagct

SEQ ID NO: 80893 - DNA, 346 bp, Triticum aestivum
  unsure (1)..(346): unsure at all n locations
  Clone ID: PAT_TA_80893
ggcaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcgcgcgtcaangtgtttctcaagcttctnaacttnaaccaacttantgccaaccngtnaaaccntcgangtcgacntnaaggaggtggcctcnggggcgcccgantccctcacctcnaagganaagaaggtgggcgcngnnaaggccgccaaggcaagctcgaggnnangttcaagaccnaaaagagagttttca

SEQ ID NO: 80894 - DNA, 157 bp, Triticum aestivum
  unsure (1)..(157): unsure at all n locations
  Clone ID: PAT_TA_80894
agatgggattttttggttgtagatgaagacggacggagtttatctaaattaattgttgcccctttgttagtcgcttatgctgctgctgagaaccactgcctacgaagcctgcagcagcgtacattgtgattttttttctccttccgnngggggatgg

SEQ ID NO: 80895 - DNA, 514 bp, Triticum aestivum
  unsure (1)..(514): unsure at all n locations
  Clone ID: PAT_TA_80895
caagatgcagatcttcgtgaagaccctgacgggcaagaccatcacgctggaggtggagtcctcggacaccatcgacaacgtcaaggccaagatccaggacaaggaggggatcccgccggaccagcagcgcctcatcttcgccggcaagcagctcgaggacggccgcaccctcgccgactacaacatccagaaggagtccaccctccacctggtgctccgcctccgcggtggcgccaagaagcgcaagaagaagacgtacaccaagcccaagaagcaaaagcacaagcacaagaaggtgaactcgccgtcctccagtttacaaggtcgacgacgccactggtaaggtcaccaggctcaggaaggagtgcccaacgttantgggcncgggacttcattgnaaaccattcaccgcactaatgggnantgggctcacctagtnttaaacagaagcttaagtgcttcgattctttaattgactattatatgtgtcngtttcttnaaatgaacttnggtt

SEQ ID NO: 80896 - DNA, 193 bp, Triticum aestivum
  unsure (1)..(193): unsure at all n locations
  Clone ID: PAT_TA_80896
gaagaggaagttggagacattcaatgacctaacacgcgactgcaaggatggtgtcaatacatgcgcaccgcctccggaatatctggttgagtaaggtgagctgagtctcagttatatcctgaatagngtattttgaancccacatgtatnccngcggttttaangcccccnccatttntaaaaaacnatttgt

SEQ ID NO: 80897 - DNA, 464 bp, Triticum aestivum
  Clone ID: PAT_TA_80897
ctgatctgcttttagttgcctggttggttcaatggcgagactgggagggttgatagacgtcattttggcttcctgggctaaggtgacaaaaaattctttggtggaagctggaatattctcttgagtcgtgtaagttcagtaggtatctttccaactcactgactaaataaaatgatgtccacaagttgtttttctatttcttggagttgcttcccttgatttgagaaatagttatctgtccgctcgggatcgggaagggatagtgtgtcgatggcttagctccctttctctatagtccttggagcccagatatggaggagtttagaggatatgtaatcaagccttgctgcccctttgccttttgttttgtttgatttgagaatagaacatcggtgatatgtattttagatttagccattgcaaagagtatggatgcgtaggcatgaagtttcaaaaaaaaaaaa

SEQ ID NO: 80898 - DNA, 608 bp, Triticum aestivum
  unsure (1)..(608): unsure at all n locations
  Clone ID: PAT_TA_80898
gctgagcatccaggacgaatcgcttgtgcccccgccggtgttggcagctcttgatattgttcgtcaaggtgccgatgttatgccgaggaagcagctgaattctgtccttgatgccgagcttggtcaaggttggtcctctaggctgaggagtttcgactatgaacctttggcagcagcgagtatcggacaggtccatcgggcggtcttgaaggatggttcggatgttgtgatgaaaatacaatatcctggagttgctgacagtatagagagtgatatcgagaatgttaggcgactcctgacttacacaaatctcatccctaaaggtcttttccttgatagantataaaggttgcaaagcaagactggcaagggaatgtgattatttcttagaacaagcaaccagaagcgttacaaagagttgctctctgatagtgagggcattacgtcctaggtnctgatgaatttcgagcaaaagtttacatcgagtttgttcaggagttctatgataagtgcagtctaancaggaaacccaatatgttgattaactccgactacataaagatgttgctcaattatcagctatcaatgngnatccttatatgtcaaag

SEQ ID NO: 80899 - DNA, 573 bp, Triticum aestivum
  unsure (1)..(573): unsure at all n locations
  Clone ID: PAT_TA_80899
ccgaactccaaaccctagtagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgatgcgaggagatctgcatgtccggcggcctcgtccgccagaagatgaagtacctccgcttcctccgcaagaggatgaacaccaagccctcccacggccccatccacttccgcgccccggccaagatctctggcgcaccatccgcggtatgattccgcacaagaccgcgaggggcgaggcgcgctcgcaggtcaaggcgtacgaggggtgcgcgccgtacgacaggacaagcnatggtcatcccgacgcgctaagtttgagctgagctgggaaagtatgctctcggcagtctcaagagtcgatgaatagcgacacataggactgagaaagagaaganagcaaattctagacagagaacaatgcnntcgnaagcaaagcacnagaaattgaanactgantct

SEQ ID NO: 80900 - DNA, 566 bp, Triticum aestivum
  unsure (1)..(566): unsure at all n locations
  Clone ID: PAT_TA_80900
cccaaccctcccagcgctcccccctcctcaacaacctcccggcgcatctccgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgggagatccgcaagtaccagaagagcaccgagctgctcatccgcaagctacccttccagcgcctggtgagggagatcgcccaggacttcaagaccgacctccgttcagtctccgccgtctccgccctgcaggangccgccgagtcctacctcgtggggtcttcgaggacacaactctgcgcatcacgcaangcgtaacatatgccaaggaatcagtcgccgcggatcgtgaagaggctaagttgtcgtgtgttgtagtgtgttagcaattgtacgtaatgtctgttgagtgctgtgtcatgtgatgattcctattatnactcttgtgnanagnatgaataatttgtantgttaaactggct

SEQ ID NO: 80901 - DNA, 558 bp, Triticum aestivum
  unsure (1)..(558): unsure at all n locations
  Clone ID: PAT_TA_80901
ctcgccaccatctacgtgtgaggccctcttcgaagtcgacgacaagctagaggtcatccaccgctactgccatgtcctaaacataaacgacgacaacctcgggcaggcatagtgcctccttctcaccccttccagtgggcctgcgacgcttgctaaagcagagtgtgatgagcactggcaagaggcgatgcacgacgagctcatgttaatcgaggagaatgtcacctggactctaaatgattttcctacaggaaaaaagttgatcgacctcaaatgggtttacaatctcaagagcgatgccgtcagcaacatggcgaacataaggtgtgtctaatcgcgaaanctacatccaacgtccggggatcgacttcaaggaatttttgcctgggggtcgctggttcagtcactcctgctcgcgtaacgctcagtttagtggaagttacacatgacgtaagacaacttgctaacgatgagttgtaggagtcattacagcttcagattatancatgtactcanaagnatcacatnacaagtntcttgagtcgaaantcttgtaga

SEQ ID NO: 80902 - DNA, 517 bp, Triticum aestivum
  Clone ID: PAT_TA_80902
ggacattgtccttgaggtagcgctgtttcttgtattgtgctttcttcaatcttcgtccttcttcatacttccacttctcttcctcaatgaagtgagtgagaacatggctttgaccaggagtgagattcatctccggcaaaggtgtagtggggtccttgtgccataagtcaataaaatcaaggatcaacttgggatccagcattagtggcacattgctgcctttggctctagcagccttggtttgcctatccctgatgatttcagcaagttcttcatcatcagcctcatcgtcatcagaggggatttggaaggcaacctgcttcttgtgaggacttgggcgaaggctcgtcctgcagtggcctttttcttcagcagagatggtccgactgaggaacttggtgcagtagtggagctagcagatgctcctgaggcaatagagatgccttgagtcctttggcacgtggcaagatgcacatgtgccgaagaatttgtcggagcagccgaagaactttgtcgg

SEQ ID NO: 80903 - DNA, 363 bp, Triticum aestivum
  Clone ID: PAT_TA_80903
gatgcctcgcgtggctgaaagaggtcgagatgccgagggatctgaagatgcgcaccgtccaatagggctggacacgagccgagccgagctgagttcggtccgagcccgagcagctcgttttgcctctggaggctgggtgcgtgggcgtacgggcgcatcaggcgaggctggagcttgacagcgttgaggggagcacgacggagacgtgccgacgtggcgaggtcgggcgtctggtgcgtcgaacgcaggtggctagcctctgtagcagttgatcttgcttcctctcgtacgtgtgcatcaagttttgtacttgtgtccaactccaggattcaatcaacgtgcttcaagtttaaaaaaaaaaaa

SEQ ID NO: 80904 - DNA, 514 bp, Triticum aestivum
  Clone ID: PAT_TA_80904
gttcttccatccttaatgggagaccagatggacgctcgctcctgcaagtcctgctgtctgctgcatgtttggtttattgtgtgcttcccgggttgcttgaaagagatttgctggtggtgtcggtcattggtcgatcggctcctactgctactgtgtgttgttgtgtcaggtgtgagcttgtggtggcgctcacctttgtggctttcaaataagaagcagcatggttcttggctgcttgcactgacgtgtgtgcgcgcggaagtatggcttgcgattgaggatgcctgcttgctgcctcttggctgcatgagtatgaacttggagtgattgactaagcagcagccctgtgtgcctgcgtgcatcgatggggctgcctggtgtggtttgcgagtgtgttaatctgaacacagaagcagctggttcagtgcattggcttgcattggacctgctattatccgtgtctgttatgcttgtggaataaacagattgtaatactaggagaacggatttcagt

SEQ ID NO: 80905 - DNA, 500 bp, Triticum aestivum
  unsure (1)..(500): unsure at all n locations
  Clone ID: PAT_TA_80905
gccacaagaagccaaactagagctaggaagcgtancgnagagctttgaggtagagataaggtcgtggacatggcgtggagcgatgccgagaacgagaggttcgagcgcgcgctggccacgtacggccgcgacacggccggcctctgggagcgcgtggcggcggcggtcggcggcggcaagacggccgacgacgtcaggcgccactacgacctgctgacgcaggacatcggcgacatcgagtccggccgctacggttaccccaacggcggtgccaacagcaacaccaaccgcaacaacggcaggaacaaggccaaccggnnccagacattattggatcacgcggttcacacagtcgaaccaaggacacgtangtaaccaagtacagtaacgagcaaagntagctagcagcttattatgcatncaaagcttgccgngtaaaatgnacttcgnatctactcagtaatttatgcctngggnttttgggagtatatncagtagta

SEQ ID NO: 80906 - DNA, 563 bp, Triticum aestivum
  unsure (1)..(563): unsure at all n locations
  Clone ID: PAT_TA_80906
tgggtgtccaggaggtgcgctgcatccatctacgtcgactacaaggagcgattcaactggaatcgcactgcgcccatgcatcggccgatctccttcgtctacggccgccgcacctcgccgctcgatccgcccgtcttcgaccacctccggcctccccgacctcgccttcgtgttcattaccccgagactgccaacgaccccagttcgactacaccgaagatgacccctccttcccggctgagcttccagacgttgaagcccaggatccagacgccaccgtcgacgacgactactacacttgaggagcctactactaacgtgcagggccactgacgacgaccaaggagtagttaggtggattcccaggcaggaggnatncgcctctttnnatctgnatcccagtttgtgctagccancttatggcaattgttaacttatgtctgtaactcaganattgttgctttccgctgancccgtttatgtacgagaacttgtattcgagccctcaagggccctggctttnaaaaanaggccttnaannactaatttaactttnaaaaaaa

SEQ ID NO: 80907 - DNA, 539 bp, Triticum aestivum
  unsure (1)..(539): unsure at all n locations
  Clone ID: PAT_TA_80907
ggatcatgggcgcgcaggtggggaagagcggcgacgcgccgatggcgaggccgtacggggtcgcgatcctggtgttcacgtgcatgcacgccgccgggttcgggtggtcgtgggggccgctggggtgggtggtgccgggcgagatattcccggtggacatccggtcggcggggcaggccatgaacgtgtctatcggcctcggcctgacgttcgtgcagacgcagngtntcctcccgatgctctgcagcttcaagtacgccacgttcgcctactacgccggctgggtcgccgtcatgaccgtcttcatcgcgctgttcctgccggagaccaagggcgtgccgcttcgagtccatgggcaccgtctgggtcaagcactggtactggaaacggttcntgcagccgcaagcaaaaagcgccgacgcactcacctagttaactgagccccccgtcgagttcttctctatgtaaagcaaacgaactcctcgttgatcctatacgcatcagttgactccaaaacttttaaaaatctgcctttantt

SEQ ID NO: 80908 - DNA, 462 bp, Triticum aestivum
  unsure (1)..(462): unsure at all n locations
  Clone ID: PAT_TA_80908
gtgcagggcgaggccgtgcaggccggtgcttgcgggtataaaatcctagctcccctctgtagctcagggacaggatcgagttcgtgctcgaggtaaagggaaaagcgttcgtgcgctggaaaaacccggttttcaccactttctgaacttctctgaatctcttccttcttcctctccggtgaccgaactacggcaaacgtgagtaagcagagtgagagggagaggagagctgcggcgaggagttggcggttccaacagtaactcgccagatgaggctaagattaccaattctgactgctgcttacgacgtgctgacagcggtatcgcagctcgttaattcagacaagttaactgggcaaagactggattagatacaactcatgtaaagaaccatttgtgtacctctcttatctaaactgaaangctgaacggatctactttctctggggtaaaaaaaaaaaa

SEQ ID NO: 80909 - DNA, 506 bp, Triticum aestivum
  unsure (1)..(506): unsure at all n locations
  Clone ID: PAT_TA_80909
gccgggccgaggtttcatcctccggtaattcgccccggttcatgtaagccaggtatgggattgtccaatccggtatgacatgcaaagctgccaccaattgagcctccggatcaggaatagccaactcctcttctgttggtaccttgaccgatggattatgcaacacgtcaagaaagacatttggtgggaccggtttgcgctgagaaccaaggcggcttaaagcgtccgttgcttcgttctttcgccggtctatatggtccacctaataacccttgaagtgaccagccactgtgtccacctctcgtcgctatgcagccatgagtgggtctttagagtcccaagtgccagacacctgttgagccaccagatctgaatccccaaagcacttaacccggcttaagttcatctccttagcatccgaagaaccgtggagtaangnctcgtactcagctgcattgttagtacatgggaacattaaacggnggacataacaaaattgttaccnn

SEQ ID NO: 80910 - DNA, 351 bp, Triticum aestivum
  unsure (1)..(351): unsure at all n locations
  Clone ID: PAT_TA_80910
tnggcatccggctcnaagaggctcaggatcgccgtccggagcttcaggctgcgcgtctgccggagcgtcctcaagcacctcaagaatctcaggaggctcgggtctcctcgttcttgatcccctcgatctcctccttctgaaagagttttttatgtgtcagggaaactaagctgccttctacttctatcatacgcaatagctaacaanaacttctgcccttgatatgccgagaagatttgggcgcgcgcgcgtgtgtgtggatgcatagtatagtacagtatgtaatctgnaaatggagcagatcagcaatgttggctcctgtttcangcttcctttttcaaaaaaaaaaaa

SEQ ID NO: 80911 - DNA, 542 bp, Triticum aestivum
  unsure (1)..(542): unsure at all n locations
  Clone ID: PAT_TA_80911
accntggtggtntcgcggtggcanttncaccggcagctgcatcccgagctggcgttcgccgacgtcttcgaggccgtgtgcagcggcgcggttggcgtacggaccagtgtgggaccacatgctcggctactggngcgccacacggcaaggcctgacagcgtgctcttcttgcggtacgaggagctgctgcgcgaccccgccgagcacgtcagggcgctggcgcggttcgtggggctgcctttctccggcgccgaggaggatgccggcgccgtccacgacatcgtcaagctctgcagcttcggccacctcaagaacctggaggccaacaaaacgggccacgtgaatcccatcctccagatcccgcgcggcgcgtaattcaggaaaggcgcggccggtgactgggtgaatcacatgacgccgganatggcgcgangcctttacgagattgtcgccganaagctccatgcctcangggttaactttcattaagtgacgactcgactgagngcaatatacatagatgatgcaaatttagagattaa

SEQ ID NO: 80912 - DNA, 350 bp, Triticum aestivum
  unsure (1)..(350): unsure at all n locations
  Clone ID: PAT_TA_80912
gcganaacatccagggcatcaccaagccggcgatccggcgcctggcgcggcaggggcggcgtgaagcgcaatctccggcctcatctacgaggagacccgcggcgtgctcaanancttcctcgagaacgtcatccgcnangccgtaacctanaccgagcangcccgccgcaagaccgtcaccgcnatggcacgtagtctangcgctcaaaggcncagggccgnancctntacggcttcgncggctanggccgtccnnggcaganggttagtcgntngttatcgcangctgaanatttngaaaanncatgaatgnnaccctgaacttgttnaaatttgctatttcctntgaa

SEQ ID NO: 80913 - DNA, 521 bp, Triticum aestivum
  Clone ID: PAT_TA_80913
gttgccggtcgatagcatctgcctgcatgacatgtgtgctaatttgagcaagtcagattccacaatcaaggattggcataccgttcttctcatggaccaggtggtggactatggtggctttgtgttcttgcagatgggtggatgtgtactgcacttggatattaggtgcaggacactgcgtaaagtgtatgaatacagaagcactcgttaccgtgatatccatccttttatgatgatctggcctcccatattccccgcgctcaagtacgatcctgcaagaactgcaacctaaagaagaaagatacaaggaagctcatggattgtacctgcgtcgtgaagctccgtcgtgaatgacatgggtggaatcaagtaagagcagtagtctgaagtatttcctctagtaccttgtagcagttccgtaaatgtgtggttcctgcaaaaccttaacctgaagtgtcgatgttttttgcaattcactcgttttaattaccatgtaactagagcatgtactcctatgcaac

SEQ ID NO: 80914 - DNA, 311 bp, Triticum aestivum
  unsure (1)..(311): unsure at all n locations
  Clone ID: PAT_TA_80914
gagcggcacnntcggcagccagccgctggtggacaacagcccctacgacagcggacctacaagggcagccgtggggcccgtctcgcggcgattggaaccgtggttttcgtcggtgccattgccgtgggtttctgatcaggaagacgaatcaatggcgaaagcgcgggcaacatctatagtgcaatgcaatcgcgtttcttaaggagttgtgaagttgtgatataatgaatctactgtacttgttaatcatgtaatttgtgtactacaattgtatcaaagtcaatacaatttgataaattaaaaaaaaaaaa

SEQ ID NO: 80915 - DNA, 532 bp, Triticum aestivum
  unsure (1)..(532): unsure at all n locations
  Clone ID: PAT_TA_80915
tgatctgtctattaggaatcaggatttgcttgatttggccgtccctgcttgcattagctgattagcttttctgtttatttgccttcgtcttgtgtgatccactagttcaattagcctgtgctctgatctcattcagtcttgtccgattctagttcagattgtactactcgcatgtttcgatcatcgcgtcggtgtatgtgcggtatgcatctctgtgtgacagtttgtgctggttttctgattgaatcatggacggcaaatcatgatcatagtttattcacctagctgtttgtgtggggaatctgctggttgaacagtgaatgactttgggcgcaaaataatgtgagtggttgggtacctttttgtttggcagtgaatcagagaagcaactaggatcaacgaaagcctagtaggttaataagcaactagctgaaaaccttttgcccataaaaaggttaggtggaaagctattgcacacggcagcagcagtttccacnaagcacaaggcnattctatnaaaaaaacnccnttt

SEQ ID NO: 80916 - DNA, 515 bp, Triticum aestivum
  unsure (1)..(515): unsure at all n locations
  Clone ID: PAT_TA_80916
ggaagatggacgccagcaagctgaagaaggtggccgggaagaagttcggcgggccgaggaagaagtcggtgaccaggtccgtcaaggccggcctccagttccccgtcggccgcattgggcgcttcctcaagaagggccgctacgcccagcgcgtcggctccggcgcccccgtctacctcgccgccgtcctcgagtacctcgccgccgaggtgctggagctggccgggaacgccgccaaggacaacaagaagacccgcatcgtgcccaggcacctgctgctggccatccgcaacgaccaggagctcgggaggctgctgtccggcgtcaccatcgcccacggggcgtcatccccaaatcaacccggtgctgctcccaagaagaccgctgagaaggccgagaagaccgccgcnaagttgccaagaaggcaaccaagtncccaaaaaggccaccaaggctanattctatantgggtgtnctaatggttcantgtggttaaatntaaactntttcactct

SEQ ID NO: 80917 - DNA, 517 bp, Triticum aestivum
  unsure (1)..(517): unsure at all n locations
  Clone ID: PAT_TA_80917
agtttatagactactagatttgaaaatattttctccgtggctatggtgtttagacttcaccagcatgcatatgaagaataaaatactattaagaatcattaccagatgatacttatatccgatgacacttgaaatagtatgagctactgcatattatgctgccagtagtaaaaaaaacggatgttgattaaaaaggaccagtaggaatccctgagaaaaatatatattatgtataacatctaagtgaaagtttaatttatcttgggatgcctttcaagttagacctgtgcaaatgttgtcctacccgtcaagccttttttttctgtttgcgatgaaactctgatgtgtcggcaatttattgcaggatggatccacttggtatgtaagtcaactggggtttagagttgacctaactttgggcacagtttgaatttgtggnctgatgctctccccttacgcttgattttgggagcaagttttttagattccngttgagttagaaaatcctatcncgggt

SEQ ID NO: 80918 - DNA, 493 bp, Triticum aestivum
  Clone ID: PAT_TA_80918
agtacaatcatgattttaagcaagctcaagccctggctacacttaattattttattatcagctttagaataacataattaagtgtagccagggcttgagcttgcttaaaatcatgattgtactatttgccaagcaccaacaaaccaggggatcaacaggtgtgggtatgtaccaagtgttactctagtctttattaggaagtatgcatagtcttggtagaaaacaaatttcattatctcgtccatgatgctataatatttatcagcaacattaggaggcttaaaaacaacgcgtggaaacacatcattcatcaagacgagggaatcacgcgttgcggttacatataagatcatccagcctcgctcactgacggtgataaaatcaacactttaagtatgtcatctggagaagaaacgtgtccgtcgcccgtttctgtcaacctagaacagcaccagccatgcgccgggcccagattcaccagcacgggaggagg

SEQ ID NO: 80919 - DNA, 505 bp, Triticum aestivum
  Clone ID: PAT_TA_80919
tcgagttttttttttttttttttaatcaaccggccatcggttttaatgaaaatcttgaaggatcgaatacatggagtaacccttaataatttcgaaaataaaataatggatcatttgggaagatgaaaaaatgtctgcattatggagatgacggtactgaatatggtgaagcaggcgaagagtacggcgaagacaaaaccgacgactgcccaaggattactgaggtagttccggcggacgttgccatggtacggtgccccttgttgctgcagtagtcatcgacgtctaggtacacacgacggaggtagtgcttctcgtagttgatgtaggagcagtggcggactggttgaagaagtcggcgacctcgtgggcgctggacatctggctcttcaagatcccccggtctttaaggatgagcacgtcttccggcgtgtcaatgaggtagtccatgagcacgacgtagctggtgaagtgcttgtgtacctcgtggtgcgacatctcgaag

SEQ ID NO: 80920 - DNA, 491 bp, Triticum aestivum
  unsure (1)..(491): unsure at all n locations
  Clone ID: PAT_TA_80920
cttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctncggccaaggaggtagaggaggaagatnaggaggaatctgacaagtccaagtcggagattaatgacgacgttacgattaagggcacccatnaggacnaggacgatnacgagttaagaagacgcatcttnttaaagctgctcccgcgganaaattcgggagctgcttttncgagaacgaccttanctgttttncgtggtgttnataaggagcctattccttctccccctaaaattantcccaagttttactttccnatcgggn

SEQ ID NO: 80921 - DNA, 514 bp, Triticum aestivum
  unsure (1)..(514): unsure at all n locations
  Clone ID: PAT_TA_80921
gggccatgttctccagctccacacgcaaccactcctccgcgtcgccgccgcctctgcctcaccccgactccttccgcagcaatggcctacctcatctcccctccgccgatgtggtgctagccaccaccaccgagccctagcagcaaagggagcggtggcttattccacgcgtgcagggcgaccccgggaggagctcaagccgcagcgatggtccaccgcgccggcgccgtcgtcgaccggcagtggaggagcagcagcgggccaacggcagatcggcgtgtcatgggagcagacacggcggccgtcacgggcagagcagagcnnagttggcatggcggctaggcggttgtccggactggatcccgccatcaccaccagccaaccgccttcgtttgtccgtgtcatcttcggcgaaaccaagggtctgcctcgtgtctgcgaggtgacactcaacggcaacgctctgtgtttccgcctacgttcgttcctccgtgcatcttnacttcganaaaan

SEQ ID NO: 80922 - DNA, 485 bp, Triticum aestivum
  Clone ID: PAT_TA_80922
ctggacttcaccttcgtcggcacgcaggcatggatcaggacgatgggctaccccgtggtggcgccctggaggccgtggtactccaagcagcaggtcgcggggttcacgacggagtacgcctacaacctcacctacgccaccgtcaagggcgccgggcacaccgcgccggagtaccgccccaaggagtgcctcgacatgcttgacagatggacctcgcccgccggcaagctctgactccgctccattccgaaccacgcatttcgtgtgcatactatttcaaagaaacaaaatggctcgtgcgtcgacttagagatagttgcttcacatgtgtgcataatagaaatagcaaaatcgtcaagtgatcaatggtcaaatatgcttggagtccgaagtctgaccagtatatggcgttattgtagtggttagccatccacttcatgtgtacacgtcttgaaatcaaatctaagtagtacagtattttggat

SEQ ID NO: 80923 - DNA, 362 bp, Triticum aestivum
  Clone ID: PAT_TA_80923
ccacggccacgatgccggccacgggtcgcacgtcctcaaggctgagcatggcgtgcactgaggagcgaactcgccaggagaatatctgcctgtccgccgacgacgagccttaaccaaacccgccgatcagggatccccttccgagccggcgtagttgttgatatgtgctgtgagatgttggacggaacatcgggttggggtacgatgtactacctttgttcatgaatgtaagaagaactgtcaaaacgtcttacattttagaaacagagggtatatgtgctaattcgacgatgccttgtatatttataaataacgaaaggattcgcgttctttgcgatcaataaatttgtaaaaaaaaaaaa

SEQ ID NO: 80924 - DNA, 343 bp, Triticum aestivum
  Clone ID: PAT_TA_80924
tcagggtcaacaagatggggagggcagcgggagtgcttgagaaccatgaggagggcaggcgctacgccgagcacggcctcagagcctatgtgcaggacaagacccccgagatcatgccaggaatcaacaagttcttcaccagcccaaaatgaagcactttagtctgtctgtgactcgcaattagtaactgttgtggtcaagtgcaaacctatttcaagcattcagtaatgttgttgcgtccataattcagaggacatcgtcaattacctcttattgaaagaaccatgtgatgtttgatggcttgctatatatgtgatggttgatggcttctaaaaaaaaaaaa

SEQ ID NO: 80925 - DNA, 512 bp, Triticum aestivum
  unsure (1)..(512): unsure at all n locations
  Clone ID: PAT_TA_80925
ggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagantatccacaantccaaggntgagaaggcaagagagaagaccctctctgatcagtttgaggccaagcgcgccaagagcaaggcaagcagggagaggaagcatgccagaaggnagnaaaanttgnttnagggcccnaaaantntgccnagaacnaccggttgaattcaattcaanaagnaggncccaaaaaggccaaggcaaattaaggttcntacctaacttttggncnataaggttacctntttgggctcttaantcaaatgtttttgngaaattttgtgcncgtataatacctnaatatcaatcgggttgtctgttgatgtncctatcaanttcttnaanattcggtcncgacctanttncaaaaaaaaaaaa

SEQ ID NO: 80926 - DNA, 523 bp, Triticum aestivum
  unsure (1)..(523): unsure at all n locations
  Clone ID: PAT_TA_80926
agaaggtcggctacaaccctgagaaggttcccttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtccgttgagatgcaccacgagtccctcctggaggcgcttcctggtgacaatgtcggttcaacgtgaagaacgttgtgtcaaggattgaagcgtgggtttgttgatccaactctaaggatgacctgccaaggaggcagcaacttaactctcaggtatcatcatgaacacctggtcnatcgcaacgctagcccaatgtggantgcaaactccanatgtgtaagttn

SEQ ID NO: 80927 - DNA, 440 bp, Triticum aestivum
  unsure (1)..(440): unsure at all n locations
  Clone ID: PAT_TA_80927
gcgggcccgtgttcaccacggcgttcatgccgctcatccagatgattgccgccgggatcaacgtgacggtgctccgcgagcagctccacctcgggagcgtggtcgggtcggcgctcgtcgtcgtggggctctacttggtcctctgggggaagagcaacgaggcgagcagcaaatccaagttgcctcctccgtcaaattccaagctcgcgttggatgaggaagcagagcatggcggtgattcacggatcatgcagatgtgtnataactctggtnaaggtgatnanggggaatcattttgggaanaaaagggggggaatantcnctatttctccatctttttaanaaaccanggaanttaaaagggttccngnaaaattcccgggaaaaccaaaagggntttttttaaaangggaaanttttttntttccaaaaaaaaaaaa

SEQ ID NO: 80928 - DNA, 516 bp, Triticum aestivum
  unsure (1)..(516): unsure at all n locations
  Clone ID: PAT_TA_80928
ccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaanccctgcaactgttaagctgcatgcactcgtacgtacgtacgtgtgatggtgtgagagtatacttgaataacgagcgtctgatctgatggagtcgaacaagggtgcgtgtncgtgtgatttcttgctcgtctccgcctatgctctgcccatggtgtccttgtgtgnatgtgtgtcgcatgtctccctgnaaattgcttnatcnatcnccactaagggagggggganaaattnnaaaaataaanttttnccc

SEQ ID NO: 80929 - DNA, 326 bp, Triticum aestivum
  unsure (1)..(326): unsure at all n locations
  Clone ID: PAT_TA_80929
cacggcaagtccctcccggncaacttcaagaagatgctctccgtccagctccggtcgtccgccgccaagggcaagctcgtcaaggtcaaggcctcctacaagctctcagacgccgccaagaaggacgcgcccaagcccaagcccaaggcnaagcccgngcccccaaggccgcggnnaaaccgccnaaggacgccgcnaaacccaaaaaaaagggggccntgaaacccaanaaggcngccgccnccgttggaacnaanggnaaggggcccnnaaaaaaaacntgnttcaaaggcaaaaaatttcncgggnaaagnnaagggnaacaa

SEQ ID NO: 80930 - DNA, 190 bp, Triticum aestivum
  Clone ID: PAT_TA_80930
ccccggcgagctcgccaagcacgccgtctccgagggcaccaaggccgtcaccaagttcacctcttcttaggcttcatccttgtatcatgagttgatggcggtgttctgtgtgtagttagcagtgcgatgttacaatctctgtaagaattgtgctgcttgtgggtctgaagaattagtcaaaaaaaaaaaa

SEQ ID NO: 80931 - DNA, 526 bp, Triticum aestivum
  Clone ID: PAT_TA_80931
ggagtgactccaatatcaaaatgtctccggtggagcatgtcccttatgttgactctgtccattaacatcagccaggtgaacactttaagtttcacgatacactttgtcttccagatcattgtgatgtatgcgggtggctgcagttctctgaagaagaagttggtgaatttcttgggccgaaactgaacatctccccaacaagtaatccattcatcagccatcattggttccaagtagagatcattcatatgattctgcagatatgttaattcatgtagcgcctcgattgatagagtgaggtaaaagtttttagaagcttgtggtctgtcttggaattgcactatagaaatatcctcctcccttgtggaagtgaacatgtgtggcacttgttggaaaggggttcgtcatcgatcgaaatatctttccatagaagaattgtgtcgccagctctaggaatgcaagttgtaaaccctctgtatatgtccatcaacgagaacacatcgttctgtatatctttccataaaag

SEQ ID NO: 80932 - DNA, 290 bp, Triticum aestivum
  unsure (1)..(290): unsure at all n locations
  Clone ID: PAT_TA_80932
gtttgcgcttatttcttttttgttcgcggcacgtnctctctttctttcttctgtgtggtttggttgttgtttttgatgtgttgttttttcttatccgtttcttggggtattgtttgcgatctttgtgttcttgcccatggtatgtcttttgcctgttgtatttctgcggacacgtttggttttggtgccggcgtcgcgtgctttgttcgttgttgttgggtagcacgatggacgttgttcgtgtggttttgatcttgcttgcttactttccgcgncatgttttggggggg

SEQ ID NO: 80933 - DNA, 222 bp, Triticum aestivum
  unsure (1)..(222): unsure at all n locations
  Clone ID: PAT_TA_80933
gagcacacacaaagcanagcaggtgcaacactagctgcaagcacaagaagtaggcagcaatggcaaggnatngctcctcgtcgtgctcctcancggaatanttgcancctccggcttcaaccaancagntgcggctggccgaggccttgctgccgtcgagaagtttgcagagcnagagncaaagcnagaaccccnaatcagagcccatggncaaaccttatg

SEQ ID NO: 80934 - DNA, 403 bp, Triticum aestivum
  unsure (1)..(403): unsure at all n locations
  Clone ID: PAT_TA_80934
ganacttaaaaaatcctcttcaccagtaagcttgaacaaccatacgatgacaattttctttgctgtaagaatgatcaaccatatgttganctaacaacacaatttatgaacgttccatctcgggttatccgacataaacctcacagtccatgggcatgtacagatgcggannaagcagcggtatntcngcctacagnangnggcaaccggtataacagtgatacacacacacgaaagagatttctttgctgtacatgagnnaagaggcnttggtgcaaaactactgcnagtccntgctcnactgaantgccnaaacgctnganatgctccctgnagaactngaagctcgnatcatcngtgaaatatcatatcgcccccagnaggcngaacnatagncgggggt

SEQ ID NO: 80935 - DNA, 209 bp, Triticum aestivum
  unsure (1)..(209): unsure at all n locations
  Clone ID: PAT_TA_80935
gancatgcttaantcttcgaaanatgcaactttatcatcagcngtactntcccagggggatacatatcctgctgggatgtactcttctgggactcttagtnacgtggaaccagaaatagttgaaatanatggtcctagtaccatagcaacaaagttcccagagcaggagccnaatttnatcagaaatncaagcncgcacgggncttagt

SEQ ID NO: 80936 - DNA, 269 bp, Triticum aestivum
  unsure (1)..(269): unsure at all n locations
  Clone ID: PAT_TA_80936
cgacaacaccacgctcgcggagatggaccccggnagcttcctcaaattcgacgccggctactaccgcctcgtggcaaancgcagaggaatcctacactccgactccgcgctcctggaacacccgagcanccagggcatacgtcgggcgccaggccaacnggcttcttcggcgncgagttcttccggggacttcgccgagtncaatggtcaagatnggcaacatcngcgtgctcancgggagaanagggcnagattcangnaacaagtgg

SEQ ID NO: 80937 - DNA, 334 bp, Triticum aestivum
  unsure (1)..(334): unsure at all n locations
  Clone ID: PAT_TA_80937
gangtcactgcaattcgcgtgttggccgtgaccggagctttgccgttgcgggggcggggtggtgcccgcaaagtgttcgggacattgtncgantcgagcagagcagatctgctgcacggatagcaagaatgtaagancgtaccgtcatacctttttctcatctcgttgctaagacaatggttttnaggactattnggnggcatattcctctacacccgaattatcagnacaaagaaactcgatttaactaacgatcngnccngcttgtngaaagntctgcacagnttttggatatctgcgaagnttncntatagctgtagctcccnatgagatg

SEQ ID NO: 80938 - DNA, 539 bp, Triticum aestivum
  unsure (1)..(539): unsure at all n locations
  Clone ID: PAT_TA_80938
cggactacaacatccagaaagagtccaccctccacttggtgctcaggctccgtggtggtatgcagatttttgtcaagaccctgaccggcaagaccatcaccctggaggtcgagtcgtctgacaccattgacaatgtgaaggccaagatccaggacaaggagggcattcccccggaccagcagcgtctcatcttcgctggcaagcagcttgaggatggccgcacccttgcggattacaacatccagaaggagtccaccctccaccttgtcctccgccttcgtggaggcatgcaaatcttttcaagaccctcactggcaagactatcaccttggaggtggagtcatctgacaccatcgacaacgtgaaggccaagatccaggacaaggagggcatnccccggaccagcagcgcctcatctttgctggtaagagcttgaggatggcgcacttggcagactacaacattcagaaggagtcaaccttcattggtgctccgtctccgaggtggcagtaagctctgaccatggagctgcttcgttn

SEQ ID NO: 80939 - DNA, 449 bp, Triticum aestivum
  unsure (1)..(449): unsure at all n locations
  Clone ID: PAT_TA_80939
cggcacgagggcagcccctttcgactataaaaggaggcccatggcatactggaagaggattcggctctttggaactacacagccaccatagctagttcgagagctcaagaacgctcaatacatccaccaaagcagaactagggctttacgcatcctcgcggcccgaacctgggtaaacgatccttgtgctgactattaatcctgctcttctcacaaccccgcgccccggcaaccgtagtggggattcttgtgatcccataggtgtcgtttccaccgacatctttggcgcgccaggtagggggcgcaattgtgagaantggtctagcagttagctanagttcttcancgcatggtnccaagagagannccaggngaaaactacgcgctgcagcggaaggcgnaacgngaacggaaantagnattngacttagnatttctttaaananagg

SEQ ID NO: 80940 - DNA, 512 bp, Triticum aestivum
  unsure (1)..(512): unsure at all n locations
  Clone ID: PAT_TA_80940
gctccctcgtctcctctcgcgcagggcccggcgaaagggaagcaagatgtacaccgccaggaagaagatccagaaggacaagggcgtcgagccctccgagttcgaggacaccgtcgcgcaggctttctttgacctggagaacggcaaccaggagctcaagagcgacctcaaggacctgtacatcaacactgcaatccagatggatgttgttgggaacaggaaggccgtggtgatccatgtgccataccgtctgcgcaanccttcaggaagatccatgtcaggctcgtcagggactcgagaagaagtttagcggcaaggatgttgtctttgntgcaacaagaaggatcgtgaggcacccaagaagggtctgtgttangccctcgaccaggacctgacagctgttcatgatgtatcttgganntgtgtgaccagtaattntgggaacgntaggncgtttgatgtcaagnatnaaattncntgaccgaggcncacaactnagncaactgaacttc

SEQ ID NO: 80941 - DNA, 572 bp, Triticum aestivum
  unsure (1)..(572): unsure at all n locations
  Clone ID: PAT_TA_80941
tatcagtgcacggttcccttcctcgtctcgcgctggatccatcgcacgcccggaggccggtggcggaggcatcaccacaagctgagcaaggcaaatccggctggtagattgttcagatccggctggtacgtgttggtaaaatcctgcgtgttcatctaattgtccagatccggctggtacgtggtggtaacaatcctgcgtgttcatctacagatgtgtctgagacaagaattaacgttgttgaatccaatgaggactatatggcagaagaaccaatcgaacatcataattatgctgaaaaagatgtcgagtcatctgatgtctaggaataactactaatgataagaaggttcacagattgtgatgatactgtgcagttaaatgagtgtcacggcactagaaaaagtntgctaacacagtttcagaaccagaactttgatngattcagncatgcaggaatnatctgtgccacaggactaagntcttgacactgaaaanatactggcgngcctggacaatntaaagaatgtgctttggggtgaanntctccantnttctntaatcagngtntg

SEQ ID NO: 80942 - DNA, 382 bp, Triticum aestivum
  unsure (1)..(382): unsure at all n locations
  Clone ID: PAT_TA_80942
ccgacgcagcgcgcggaggcgacctcccaccgccgccaagatgcagatcttcgtgaagaccctgacgggcaagaccatcacgctggaggtggagtcctctgacaccatcgacaacgtcaaggccaagatccaggacaaggagggcatcccgccggacnagnagcgcctnatcttcgccggnaagnagctcaaggacggccgcacccttgccgantanaaaatccagaaggagtcnaccctccacctggtgctccnntccgcggnggcgccaagaagcgcaagangaagacctcacnaagccaagaagnaaaaganangccnaagaaggnaaactcacngncctcagtttaaaggtganagncccangagagttnaagatttt

SEQ ID NO: 80943 - DNA, 243 bp, Triticum aestivum
  unsure (1)..(243): unsure at all n locations
  Clone ID: PAT_TA_80943
gtaagggaggaggaggaggagagcggcggcgaagatngtgtcgctgaagctgcagaagcgccttgggcctcgagcgtcctcaagtgtggcaagggcaaggtcttngctcgancccaatgaggtcaacganntttccatgggncaactcccgcnannaatccggaanntggtaaaggantgttttcanccntcnggaacctcaaaaannccactcccngtttttataatgggggtntttggggc

SEQ ID NO: 80944 - DNA, 380 bp, Triticum aestivum
  unsure (1)..(380): unsure at all n locations
  Clone ID: PAT_TA_80944
ggcaagaagaagtccaagaagagcgtngagacgtacaagatctacattcttcaaggtgctgaagcaggtgcaccccgacatcggcatctcctcnaaggccatgtccatcatnaactccttcatcaacgacatcttcgagaagctcgccggcgagtcgccaagatggccaggnacaacaagcnnncccaccatgacgtcccgggagatcnagacntccgtncgntcgtcgnccccggcgagctcgccaagcacgccgtctcngagggnaccaaggcagtcaccaagttcactctcttagatanctgctcttgtgtcttcttgaatgtgttnacatctcgngggtgttgangatccactgngntngtagttanatgtcanac

SEQ ID NO: 80945 - DNA, 466 bp, Triticum aestivum
  unsure (1)..(466): unsure at all n locations
  Clone ID: PAT_TA_80945
gttctgtatatacatcagcttgaattttttggtgtaaatcaggatcttcaattatgtctgatgagtattactagtttatcatcttttaaatgtcaccagcgcctcaatttgggaaatgctttccatctcctgttatgcaccgacccctccggttatactgagtgcatcctctacaacaattcttcactatcatgctccgctgttacgaccagtattacagacttttatcatgttttaaatgtcaccggtgcctcaatttgggaaatgatttgcatcggcccctccaggctatagtgagtgcagccactacaaccatcttcactatcatgctctgcttttacgaccaattatcctcaggttgtttctgacatgctttnttccattcagntggtcgatttgtggactccaagcagtatgtataaatggacntcattttatttcatgttttaccagtatttaatttcag

SEQ ID NO: 80946 - DNA, 486 bp, Triticum aestivum
  unsure (1)..(486): unsure at all n locations
  Clone ID: PAT_TA_80946
aactagtagaagtnatacttttaaccagaaaattatagtaccaggttagnagtattattccttctgttttttactcgcaaaacgttgttaatccaatattgccatgaaaggtaaagaccctaaatccctaatgttcctccaatcccagaaaacgaaacacgcactagttcttttagtaaaagcgtcgattttttttaaaaaaaattgtaaaccagtctagtacacgagtagtagtattgtcatttactacgttattttcattttgcatcggattctttttttttccttgtgctgcatgcttgcattgcatatctgccatcaattgttgttgctggaatggaaaaggtgtgcttaattaagacgatcntcgcaacttgcagcgttgtgttggctggggtggaatgaagagtgggagtgtgccggattttaaagggaaggtgtgtgncgtcaaatcaaccgcnggttnanggaccaacgcgccnnaca

SEQ ID NO: 80947 - DNA, 573 bp, Triticum aestivum
  unsure (1)..(573): unsure at all n locations
  Clone ID: PAT_TA_80947
cgccatccgccttcttcntcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaattgacaagtccaagtcggagatcaatgacgacgatgacgatgagggcagcgatgaggacgaggacgatgacgagtgaagaagacgcatcttgtcaaggctgtccggcggacaagtcgggactgctgtngagaacggactagctgttgcgtgtgnataggagctatcatctcatagatttccagttcacttacatcgnatgtgtttactttttctgtatgtctctatacgganacgtcctttgcgcgcgcgngggatcctagtgtgaggttttctttcgcgggtcctgctttctaatgn

SEQ ID NO: 80948 - DNA, 167 bp, Triticum aestivum
  unsure (1)..(167): unsure at all n locations
  Clone ID: PAT_TA_80948
gtgaagttnaatgtgaatcgtgtggataatatggtgattcaanagatntttctgttggctanacttgacaaggatgtnaattnattntctatnagagtgagggnatngtatagatggnattttcctgagctggtnaagattntgaatgagnattacatntatgctaa

SEQ ID NO: 80949 - DNA, 468 bp, Triticum aestivum
  unsure (1)..(468): unsure at all n locations
  Clone ID: PAT_TA_80949
cgccctccagagcgacnatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccaccggtgtcttcactgacaaggacaaggcngctgctcanttnaagggtngtgccaaganggtggtcatntctgccccaagcnaagattcccctatgtttgnggtggngtaatgangnnagtacacctcagccgttaacatgttcaatntantgnacactanttncttctccctgcaagtcnttatgaaactcgntnantagggttgatacnctgtnatgcatangcaaaa

SEQ ID NO: 80950 - DNA, 284 bp, Triticum aestivum
  unsure (1)..(284): unsure at all n locations
  Clone ID: PAT_TA_80950
ggcatcaattatcagagcactacacgatctccatgaagttaatatatgtcctgtacagttttgtgcatcaaacattgtagtgacatattacgggagagtgaaaatcagagttgcatgtttgaagaagactgtttctatggtgcgcaaaaactatgaggatgccagcaatattattatggacacattgtttgctgactacaagccaactattatccccaaagatgtagatcatctattttcgttgatgaagtctcccattgcaacaggtacganttgtgataggg

SEQ ID NO: 80951 - DNA, 583 bp, Triticum aestivum
  unsure (1)..(583): unsure at all n locations
  Clone ID: PAT_TA_80951
atcaaatctatgtttaacaagattcataatatgaataactgttgcggtgttatatgtacaagtcgcatcccatttggaccaaactgcgaccatgaaaaaaatggtagcattcaaatacaagtcgtcattgatacagagacgaggttcacaagcatttggttgggattggcagatagcatgacccagttgagcattttgcatgactctgaaatctttgaggtgtgcgagaagggtgattggctgaatggcagcaagctgaaggtaggattagatgagtcagaagttggggaatacataattggtgatgcaggataccctcttctcccctggctactcacaccttatcaggaagaagacctctcagattccaaagcagagttcaataggagacactccacagccacaacctgtctgtnaggcgctggcaaagcttaagatacatgaagncctgcaggaaatgcgtgtggcagtaatcgaaacttggcnagatgttgtgctctgatgtgctatangcaagttgaggtgtcacgtcggatgagactgattcttggagtcgcagtngaaatgagtcataggcaggntg

SEQ ID NO: 80952 - DNA, 372 bp, Triticum aestivum
  unsure (1)..(372): unsure at all n locations
  Clone ID: PAT_TA_80952
aacgcaaatctatcaatccattgttatttctntgtttccgaaaaatanagannacagtatataccaaatgtgtgcatttttacccnttctcacggnacaaaggnagcaaacagttacnnattgcagtattnccgnctgccacgtancantacatcggcngtngaggcgcatacatcggctcgtgccgaattcggcacganggcggcagcgggatttnggtancngcgnctgcggcggccatcttcntgntctctctccgggcggccnccggcaatgcnggccgagtanannatcggcggcggcagacccaggncttctacgacatctcngtnatcngcggntcaacncttacnatggacttctnctgcagca

SEQ ID NO: 80953 - DNA, 201 bp, Triticum aestivum
  unsure (1)..(201): unsure at all n locations
  Clone ID: PAT_TA_80953
ttttttttttttttttntaaaaagtgtaattnactcgaaactttattantcangncatgatatattgnacgnacggnctacctattattgatcaaattaaagggaantatnatcncaaataataattcagcattatcacaangaaacngnagcaatnccttagatatnacacatagtgntgnatgtngtcaagccangggg

SEQ ID NO: 80954 - DNA, 500 bp, Triticum aestivum
  unsure (1)..(500): unsure at all n locations
  Clone ID: PAT_TA_80954
cctccgtctccatatctctgttacttccttcttcttttccgtggatgataatggatggaaattgtctgcatcacggtctgatcctcgaattaattcctgaccacgtctcaatccgtctgtggtttcacctcgctgtacacttgtatttatcttattataattaatccttcaaactgcactatgcaattgcaaacttgttggattcagatggttttacaaatgagcttcanattttgatgctctgcttcngcatacagactttggcttgtgttaattttgggctaatcctcgatatatttaacaagattcctcaacaaaacacctcgataattctgtgctagccaattnattcagtataagacactgtaaactcatagtttancatatcattccaggtgggtcagcngccttgaaatgntggctggctggctaatcaggagtatctaggctggganaatantantgngacctcnagttatngaaccaatnttgnggttgac

SEQ ID NO: 80955 - DNA, 376 bp, Triticum aestivum
  unsure (1)..(376): unsure at all n locations
  Clone ID: PAT_TA_80955
gggatgaggatgctaanttcaagctctgcaaggtcaggtctgtcnagttcggccagaagggcatcccctacctgaacacctatgatggccgcaccatccgctacccagaccctctcatcaaggccaatgacactatcaagctcgacctggagaccaacaagattgttgacttcatcaagttcgacgttggtaacgtggtcatggtgactggcgggcgcaacactgggcgtgttggtgtgatcaaaaacagggagnagcctaagggaaccttcgagacatcnacgttgagnatccccagggccacnatttngcnacccgtntnggacaatnnattcaccattngnaaagggnccaancntgggtaccctccccaagg

SEQ ID NO: 80956 - DNA, 577 bp, Triticum aestivum
  unsure (1)..(577): unsure at all n locations
  Clone ID: PAT_TA_80956
tttttttgtcaaagattaagcagtgatgcattttaagatctttcgtaggcacagcaacaaccattttagtaatcaaaaaccaccatagtagtaaccaccacaacaacttcagacaagcactgatgaacaaacagcacttagcagagtaacaaagctcagatagacagcagcaatattactattttctactactaatgcatttcacggattgtaggggaaccagtgaacactatcccaaccaccatatactaccgcagtcagatagataacttatgagaaagttggagaataaccccggaacaacaacatctatagcatggctagataacctcggagcagcttgcatatatagaacattatgacacattctcatcggtcctcagggaagagcatgcagccagacgcatctcattacaacacttccagaaaatactgggactgcggaagacactgctggggggggccggnaccaatngcctatagtgagtgttncgcgcgtactggcgtgtttcacgtgtgactgggaaacctggcgtacccacttatgcttgagactcccttcgcactgggtatagga

SEQ ID NO: 80957 - DNA, 525 bp, Triticum aestivum
  unsure (1)..(525): unsure at all n locations
  Clone ID: PAT_TA_80957
aattgctactgtcctacaaaattctgcgcttggaggcccaacaatagtctacaaaagtaagttgtggagtagacaatacaacgcatggtgatcggggatgctacaatgggcatttagttttcctacaaccgaggaaaacaaagctgcgacaaagtggccacgggagctgcatgctagcggcgcgacgaccgacgtcgaactgcaaccggcgacgatgagatcaccggccaacgggccgcgcggggagtggagagcaccggccaccgggctgcgaggagcagaggaccagtcagcgagaggtaggggttgtggggggagctgcaggtaaggagggggtggagagatgtgaacgcggaggaggaagacgacatacctgcgggagggagatccaacngtggtantgtncgcagtcgtgcagctgcngggccgactgcccaaattttgggcaaacgcgccngggcanataatttcncatttttttaacnccatnaactttctgtgccctanaatagggcactntttttt

SEQ ID NO: 80958 - DNA, 439 bp, Triticum aestivum
  unsure (1)..(439): unsure at all n locations
  Clone ID: PAT_TA_80958
gtctacctcgccgccgtcctcgagtacctcgcagccgaggtgctggagctggccgggaacgccgccaaggacaacaagaagagccgcatcgtgcccaggcacctgctgctggccatccgcaacgaccaggagctcgggangctgctgtccggcgtcaccatcgcccacggggcgtcatccccaacatcaacccggtgctgctccccaagaaggccgccgagaaggctgagaaggccgggcaccgcncccaagtcgcccaagaaggccaccaagtcccccaagaaagcccaccaaggcgtagattntagtagtgcggtgtgctgattgttccgagtttggttagatgtagtagctggttcactctgtattcctgngnccctgatgnaatcgcgaagaaaaagggggaatccngctngcttncntcttggncttatgaatt

SEQ ID NO: 80959 - DNA, 291 bp, Triticum aestivum
  unsure (1)..(291): unsure at all n locations
  Clone ID: PAT_TA_80959
catcgtcggcgattgcgggactggcaaaaccacttttgtgnagaggcatctcactggagagtttnagangaaatatgancccacttatnggtgttgaaggtcanccattggantncaccactaactggggaaaganccgtttctacggntgggacactgcngggcnagagaagttgngtggcctgagggatggatattatatccatggtcagtgngcgataatcatntntgatntcactncaaggcgacatacaanaatgttccgangtngnacagggactttgcaggggg

SEQ ID NO: 80960 - DNA, 514 bp, Triticum aestivum
  unsure (1)..(514): unsure at all n locations
  Clone ID: PAT_TA_80960
gagaaaacttggatcattgataagcaccacaatagcaacattccttagggaaggctttaggtgaaatctataccaagataactccaatgaagagattaatggatttaaaatatctcattcttgacaacatgtgaatcatgaaacacgaactcaaattgtcaagaatgacataacgccacctcaagagataaggtagaaggaattgcactttgaaatgcaaaagaagaatacttgaactcctccaacaagaatcttgaagaacacttcgagaatgaattaaatccttgatgaacccccatgtagagcctccatgaagaactccagtaataaaaggatgatagaaagaaagagaggttgaaaacacaaggtgaacccttgcaatgatttagatggagcttcgcgacgagataattgagagagcttggaactccgaaaagaaagatgagctctcgaaccgagatgtgatttatgacccantnccgaaagaaagatgatcncttgtatccagaatttt

SEQ ID NO: 80961 - DNA, 186 bp, Triticum aestivum
  unsure (1)..(186): unsure at all n locations
  Clone ID: PAT_TA_80961
cgcacncnccctccaacccacctccgccgtcgacatnggtaaggtgcacggatcacncgcccgtnccgggaaggtgcnctagccagacgcccaaggtcgcnaacatgnacaagaagaagcanccccnacggccgcanccacaagngggntccagtncaaccgcngnttcgtcaccggccgncctcg

SEQ ID NO: 80962 - DNA, 425 bp, Triticum aestivum
  unsure (1)..(425): unsure at all n locations
  Clone ID: PAT_TA_80962
gccaccggaaggtgctgcgcgacaacatccagggcatcaccaagccggcgatcaggcggctggcgcggcggggcggcgtgaagcgcatctcggggctcatctacgaggagacccgcggcgtgctcaagatcttcctggagaacgtcatccgcgacgccgtcacctacaccgagcacgcccgccgcaagaccgtcaccgccatggacgtcgtctacgcgctcaagcgccagggccgcaccctctacggcttcggcggctaggtccagtcgaatccacctcgcgccgccagattcctactagtantatagcnaagctaatggttttcnatggttccantcttcgntgctgttgttcaatgttnanggtttgaaggnagantgatnagaatggaaattcgcggattttacncntccaaaaaaaaaaaa

SEQ ID NO: 80963 - DNA, 278 bp, Triticum aestivum
  unsure (1)..(278): unsure at all n locations
  Clone ID: PAT_TA_80963
aaatctagtgagcgtttaataggtatttcgcacgataaactgcatagcaaacgcatagaacgatccccgccggcctccctccggtttcaagctatttgtttttctaccggttatctggtttgctctattttttctcaaaaaaacctgttttgttctggttttcaagtgttttttcgtaaaaccttgaacaattttnttgtaaaaaatgcgaacaagtatgtgcacaatgtatttgggaaaaggaatatgaaaaataaaaaaaaagcaaaaaaaaaaaa

SEQ ID NO: 80964 - DNA, 509 bp, Triticum aestivum
  unsure (1)..(509): unsure at all n locations
  Clone ID: PAT_TA_80964
gttcgagctataataaggaagagaagaccacgtattacatatgtcacacgcagctagcaccggcaacccaggcaacacccaaatgagctcctccttgaatctgatcccctcgtctctcaaacctcagtctctctaattactctgaatcactgcaagctgcacatataatttctttgaatcatcccaatttccttcccctagatttcacttaggtcaccgtctattcatctcattaccaaatatgctagcataaacaattcactgaattgttgtttacagtttaaaaaatgtagtataggtagctatgtgcaaggacagtcaaaattgtagtgcctggcagattatcatatagtaaattctggtatagcttcttttgtttgtatgattgtatctggctcacttcatcttgtaacaaataacaagagagagaaggtatactgattaatgccaatgattcctgaatttgatctgtttttttgttcttagcttggnccgcccagcaatttgtt

SEQ ID NO: 80965 - DNA, 218 bp, Triticum aestivum
  unsure (1)..(218): unsure at all n locations
  Clone ID: PAT_TA_80965
aaccaaaccaagccaaagcaagangagaaagcgatcggtggatgagcgtgaggtacatgatgagccgggtgggcgcnaggacggcgcaggccgtncgggangccgtcggcaggnccgccggcaaggccgatcangncgcaggcgcananacagtccatggccaggnccngcanggcnccggcagagtnggcngngcgaangcncngctggncaggaag

SEQ ID NO: 80966 - DNA, 548 bp, Triticum aestivum
  unsure (1)..(548): unsure at all n locations
  Clone ID: PAT_TA_80966
agagagaaagaaaccgttgaatacntgatgttgctaggaatcctgggtgcaagtatgacataccaggttggcctaaaaccaccaggaggtctgtggcaagncaacaacaacgaanactttgcnggctaccccgtcctcnacgncatnaacaagcatcggtacgctgtnttcttctacagcaactccacttccttcatggcctcagtcgttgtnattgtcctgctccttccatggacgacattattccagaaacgcaaaccgccactctggctaatgcntattgncattttgctggacatggttggtctcctagtggcctacgngcaggnagtactaggaaatggggngcatccnaaaacgtcatattncttgtcatccctgtgttagcctacntcggattctacgnattagcgtcagtgttcttccgcgagaaaaccggnngtttgtggnaancgcntggctttcctgtggtttaggggaaccngtcagtattaggaagtagggaagggtggcnaatatgntcncattatcccggatgttgcncctnt

SEQ ID NO: 80967 - DNA, 440 bp, Triticum aestivum
  unsure (1)..(440): unsure at all n locations
  Clone ID: PAT_TA_80967
cagcagcgcctcatcttcgctggcaagcagctcgaggatggcaggacccttgctgactacaacatccagaaggagtccacccttcaccttgtcctccgccttaggggaggcatgcagatcttcgtcaagaccctcaccggcaagaccatcacacttgaagtggaatcctccgacaccattnacaacgtgaaggccaagatccaggacaaggagggcattcctccggaccagcagcgtctcatctttgccggcnagcagctggaggatggccgcactcttgctgactacaacatccagaaggagtccancctccacctggtgctcccgcctccgtggtggtcagtaattgtccctgacgttggacctgctgctattaagtgcctgtgnccttggttcgtgttaaagtctnccgtaatnggcttgatcgancatctagtccc

SEQ ID NO: 80968 - DNA, 538 bp, Triticum aestivum
  unsure (1)..(538): unsure at all n locations
  Clone ID: PAT_TA_80968
aagttctcgagctgcatctcggaacacgggatactatgcatcagtctggctatttcaacttgggcttggaaaacctctcttcgcttcaacaggtaagtatcgatttggattcttctaaggatcgggtggaggaggtggaaactgcggaggctgttcttcgttaagtgctggacatgaatcccaacaagcccacgctctgcttgcataagtggtactagtgtccctttgcatagcgccgtcgattcattccgagctacaactatcaccgaggtgtgcaatgttggatttggcatcacgcgcaaagtgttacaattgttccttgaaagggtcgtggtgacgcatngantctcctggccatggtcgtgtgaagctgggtggtggtgggcccgttgctgctcacggggcgtagtgctggttatttcctgggatttgatatgttttgatgttttcncctgtaataagtagtgnccttgaacttttatccaatgctagcagtttttgtcccgtaggagatgtttcnaattcngacatctccagn

SEQ ID NO: 80969 - DNA, 542 bp, Triticum aestivum
  unsure (1)..(542): unsure at all n locations
  Clone ID: PAT_TA_80969
cccagcgaaaacaccaccacacctctccccgtcgacgcaagaagcagcagcggcatccatggcccccaaggcggagaagaagccggtggnggagaaggccgagaagacgacggcggcgaagaagaccaaggccgagaagcggccgccggcgtccaaggagggcggcgagaagaagggcaagaagaagtccaagaagagcgtggagacttacaagatctacatcttcaaggtgctgaagcaggtgcacccggacatcggcatctcctccaaggccatgtccatcatgaactccttcatcaacgacatcttcgagaagctcgccggcgagtcggccaagctcgccaggtacaacaagaagcccaccatcacgtccagggagatccagaacctccgtccgccttcgtccttccccggngagctcgccaagnacgccgttctctgaggggtacaaaggccgtcaaccaagnttaaaatccgcttagatacctgncccttgngttttncccngaatnnggttgaatttccncctgggcngttgntaa

SEQ ID NO: 80970 - DNA, 526 bp, Triticum aestivum
  Clone ID: PAT_TA_80970
cacacactcatctcctgatctccgtttagcatcagcagatctaaggtagcactttagccgcttcagttcatctttcaagaatcctacttcaccagtgacaccacataaaagtgaggtttcccaaaccgcaagtttgctcacattcctgatgacggccttaacagcagacccagccattgattgctcctccttgtatctgctccctacatagtttgtttaaaaataacatatattagaaatttccctgtctgttgtacttttttttttggagagccaatagctagactgattatttggacaacctccggttagtatgatgatgactgcgcttgagcttccaattccaccagtgaattagtcataggctcatagcagatagatctgacgagagtgggagctaaaaatgagctgaacacttgtaccgaggagaattgaaaaggggagatactcaccgattcgaggggatgcatgccttctgcttgataactcgctgtttcggtactctgctcccacaaattcttcaagg

SEQ ID NO: 80971 - DNA, 439 bp, Triticum aestivum
  unsure (1)..(439): unsure at all n locations
  Clone ID: PAT_TA_80971
aatggtttcatgttctcgttccctgtcaccaaaacctcagtttcgcttccagaaccgccacccactcctacttncttctcaccgccgaaaaggagcccgccagctgacatccaagatatccccaagttcaactttggctcaccaagttctacggacaatctcgttttctctgtcgatgcagcaggcggctctgctggtgcagaggaagtggctccaaccttcaagtttgggtcggacaagcgagagctttccttcgacgtggctgggaaagacgcggttgtctcttagagatgggcatcctcttgtatctgaaccccgctcgcacttggttatttgctgggatgacggcaccatttataacnaacaataccgtgancttatancaagaaaacatggggcctcgcataccccagtatnttcaactgcatatttttgcanc

SEQ ID NO: 80972 - DNA, 286 bp, Triticum aestivum
  unsure (1)..(286): unsure at all n locations
  Clone ID: PAT_TA_80972
tcngccgcgctcgccatcgangccgaggccttctacgnngccgccntcaccggcgggcngccgcctccntcgaggagggcancgaggcgcngcagctctactccaagnatgtcagcngcngcctcctcgacttcgtcaagtccctntccgncgcggccaatgccnagccgcngtccgaangagncaaccgccgnanaaggagngngacctccgagggcctgagccccgaccgngnacattnatttcgattatgcttctngatanaaattcatttacatntaaaggt

SEQ ID NO: 80973 - DNA, 176 bp, Triticum aestivum
  unsure (1)..(176): unsure at all n locations
  Clone ID: PAT_TA_80973
cagcaacagcaccacgccgaccggtgaggcagcgtcgcccaagaatacacggaggaggtggcccggntcggcgncggcgccgnccggcnaggccangggcntcngnccaagtgcntctgcgcnccggccanccacnncgggtccttcaagtnccgtntccaccgcaccaactctca

SEQ ID NO: 80974 - DNA, 305 bp, Triticum aestivum
  Clone ID: PAT_TA_80974
ggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggctcgtcctcgccccccctcctgcagatccccaaagtttgatgataccgcgacttgtctagttctctgtatgctctgtagttcgaactgaatcgtggaacaaagttattcgcatatgttgctggaaaaaaaaaaaa

SEQ ID NO: 80975 - DNA, 179 bp, Triticum aestivum
  unsure (1)..(179): unsure at all n locations
  Clone ID: PAT_TA_80975
cagcaacctcttcttcttcttcctcatcttccatgatggaagcctttccaagcactctggctatggtcttcttgaccctttccttcctcttctttcctttagcagcaactggctctatgggagtgggcttctcaggaatcttggttgaagctctggcctttngcataggcagcanncat

SEQ ID NO: 80976 - DNA, 514 bp, Triticum aestivum
  Clone ID: PAT_TA_80976
cgccggcctcatcgtgctcgagccccacggcgggctcatggccaccatccccaccgccgcaacgccgtacccgcaccggagcggcgtgctctacatcatccagtacatcgcgttctggcaaggcgacggcggcacggcggccaccacctggctcggcagcttctacgacttcatggggcactacgtgagcagcaacccgaggcaggcgtacgtcaacttccgggacctggacatcggccagaacgcggtgtcggacgacctcagtaccacgtcccagagcggcaaggtttggggtgagcgctacttcatgagcaactaccagaggctcgcgtcggtgaaggcagccgtggatccaatggactacttcagaaacgagcagagcatccccccgttgcgaccagtcccagcctacaacgactacaacgaacgacccaagtgagcagagattcatgccacaagatccccataattagtacagtaattaattgattccttttactacttcaagatgact

SEQ ID NO: 80977 - DNA, 505 bp, Triticum aestivum
  unsure (1)..(505): unsure at all n locations
  Clone ID: PAT_TA_80977
atcttctagagcaccgcctaatccagcgaagagggcaaagaagcaagcacctccagcaagatcatcttcacaacaagcacctccagcaagatcatcttcacaacaagcttctcaacatactgtagacagaagaagcaggatgaggagtcagaacagagtaggttcaagctcacagcccgctccaggaaattcaagctcaattcacatgcaagtgccaactactgacaggctgcaatggctcctaactggagaaaggtgaatgtccagtttgcttatcagtggagaaagtgtcatgtacttgatgtgtaacatcatgttgaagtgtgtgcttttgttgatgtgcaacatcaagttacttgcacaaagtagcatgccaatgtctgtagtattttgtggatgttttcttttctatgncaaagaccttaagaagttgtcagggtaaatttgatgttatggaatttgctatcagtttctggaaagtatgggttttccttttgctattggc

SEQ ID NO: 80978 - DNA, 414 bp, Triticum aestivum
  unsure (1)..(414): unsure at all n locations
  Clone ID: PAT_TA_80978
ggcgcacattttcgggcccagctgggaccgcttcctggcccgcaangcccggtacgacccagtgcgtgtgcttgggccgggccaaggcatttttccttggacggattccgcgagctccatgtgatagcttgcacaacattagggctcgtagatgttagtagctcaaacgaaatttttcaggatgattaatcggtaggtgtcttttttttagggaaattgatagtaggtgtctttagggaaagagttcgttctttctttttttgttgggttaaatttgtgatgtgtttagcttagctggtaagntgggactctcagattatttggcaagagcagagtatctcgtctcaactctatcgtatcattatgcccntagctgntccgtaagtcaaggcccncggagnaatggancatttt

SEQ ID NO: 80979 - DNA, 538 bp, Triticum aestivum
  unsure (1)..(538): unsure at all n locations
  Clone ID: PAT_TA_80979
gtcccagataggactctaacttgcccgtcttgtctctgaggcctccaacttcagtggccaggttctccttgtccttcttcagttgctctacttctcgattcgcttctgagatggcgttcttcaacttcgcgttctcctcttctaatttgccgactaaagccagcttctggtctgcaagcgttgtcttctcatgtgcttccttctgagtagcagcaaggtcctggnccttcttctcnaaagcttcctccattctctctaaagaaacaacactcttcaaacgagcctgaagttaacagttttcactatgcacatatgcttgtgtgaagtcactcggttcaaagagcttaaggaaaaagcagtgaaagacggagtactaaataggaagagtcngtggnacctccnatgatggcgtctcntgtgagcagtctgaggtcttcttgggacttcaaggcaagtcaaactgatagcttttcnaactggaagcgantcaagatcaaagccttgtacnagtganaagtantagtgacgaaaaagaana

SEQ ID NO: 80980 - DNA, 534 bp, Triticum aestivum
  unsure (1)..(534): unsure at all n locations
  Clone ID: PAT_TA_80980
gagacgccggcgagaagaagatgatcacactcaagagctcggacggcgaggagttcgaggtggaggaggcggtggccatggagtcgcagacantccgccacatgatcgaggacgactgcgccgacaacggcatcccgctccccaacgtcaactccaagatcctctccaaggtcatcgagtactgcaacaagcacgtccaggccaagcccgccgatggggctgccgccggagccggagccggagcctcggacgccgcncccgcngcccccgccgaggacctcaagaactgggacgccgagttcgtcaaggtcgaccaggccacnctcttcgacttcatcctggctgccaactactgaacatcaangggtgctggacctgacttgccagactgttgtganatgtcagggcagaccccagaggaatccgaaagacttcaaatcagangatttacncccgggngaggngaantcccnggagaaaantggctttnattaaggnnttaggaggntccccccgnttattaanaaaacnttn

SEQ ID NO: 80981 - DNA, 354 bp, Triticum aestivum
  unsure (1)..(354): unsure at all n locations
  Clone ID: PAT_TA_80981
gagccgactacggcgcgtacagcggcagcacgctggcgacgctgggccacatcggggtgtctggcccggcggagggagcatcgtcgggggcacgggcaagctccggttcgcgcgcgggtacatggtccaccgacacctccatcgtcgtcgtcttcgacatgtacttcaccctggcccgctgattcgcacgcntgcggacgagtggagtacaaggtgtacatttcgaagcaaagctgttggggagttgctgtcatacagtacatgtacccaagtaatcaatctgcaggcccgntgatanatacttattgtttaattaatcaagtgggtttgtcctgatcctggatttttaaaaaa

SEQ ID NO: 80982 - DNA, 528 bp, Triticum aestivum
  unsure (1)..(528): unsure at all n locations
  Clone ID: PAT_TA_80982
gcgctctcaggcgcgcacaccatcgggaaggcccagtgctccaacttccggactcggatctacggcggtgacaccaacatcaacactgccttcgcgacgtctctcaaggccaactgcccccagtccggcggcaacaccaacctggcgaacctggacacgacgacgcccaacgcgttcgacaacgcctactacaccaacctcctgtcacagaaagggctcctgcactcggaccaggtgctcttcaacaacgacaccaccgacaacactgtccgcaactttgcgtccaacgcggcggccttcagcagcgccttcacgacggccatgatcaagatgggaacatcgcgccgtcaccgggacgcagggccagatcaggtcagtgctccaaggtgactcgtgatggacgtatggtggagcacgacacgtaatgaatagggcccaaaaagtggcagtacattatcatacanacttgaatgtgnattcaagatgtnagagaatatgatgataagtattaacgacgtgatctaattt

SEQ ID NO: 80983 - DNA, 248 bp, Triticum aestivum
  unsure (1)..(248): unsure at all n locations
  Clone ID: PAT_TA_80983
ctgaattcccgatgagatgagacgggaaggctggctagcttgtacgtgaaggctcacacaagacgtggaaaaaggaggagaattcgaatgtccctttacttttcttttccttcttccctttgctatgctagcctccctcttgttaattccttactactgtagtacgtagtattcctagcagtttgttcgcacttctttcttcttcttgggttggtctgtnaggatgcgtcccctgtgnaatgtaaaaa

SEQ ID NO: 80984 - DNA, 274 bp, Triticum aestivum
  unsure (1)..(274): unsure at all n locations
  Clone ID: PAT_TA_80984
catctcccccatctgccacggatcgctcgccggagacgcccgccgccacagatcgcccgcaggagacgcccaccgcccctgatccctcgccggaggtgcccaccgccccagatcgctcgcaggagacgcccaccaccaccggttggacctcctggttatccatggccgccgttctccgcggtgctcgcgctggccgtggcggccctggccngctcaggggaggnagaggggcgccgcngtgnagcaaggccccggcccaggnagnagcccccgt

SEQ ID NO: 80985 - DNA, 414 bp, Triticum aestivum
  Clone ID: PAT_TA_80985
ggcagacgctcctggccaggacgatgccatgggcccgagccgggtcgacgcggaaggtgcgggatgacgtcgcggcctccacgacggccgcgcggccatgacccagacgacgtcgacgccggaacatttcgtgtgctctttccgttgactctgatggtgtacattgattcttttgtaattccgttgggtgtggtgtgggaggcaattcgatcacagaggagcagcgtatgcgtggtggtgatgctttgtttgtgctccttggtgttgatgggttaatggttggttgggtgtccgtccgttgctctcggtcaacccttcgtttgaatgaaatattcatgtacgtaaaaacacgagtgtaaacaacggatatggaaaagtttctcgtgctgaaaaattctgtggaaaaaaaaaaaa

SEQ ID NO: 80986 - DNA, 525 bp, Triticum aestivum
  unsure (1)..(525): unsure at all n locations
  Clone ID: PAT_TA_80986
ccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagaacatgcatgatgatggcggcgtggtgttcgcctactacaaggagggagctgctgatccaactttcctgtactttgcacatgggctgaaagaggtcaagtgctaatcgcactgtatgctaaaatctatgcggtcgtcagtattttgcn

SEQ ID NO: 80987 - DNA, 478 bp, Triticum aestivum
  unsure (1)..(478): unsure at all n locations
  Clone ID: PAT_TA_80987
gtgaacnaccactctcacggaatngngcagctgttccaagatacgnggagcctctctngatactcaaacggaaccngcatgtnccaatnaaatgtgatcangatgaggaggatcataccanngcctngcgagattatatgatttnnttaccgtgacgagtatgaaaagataanctgcagtgcngacagngcagaatgccaacacgggaaagtnaaagngcggattncataccagnagttgcagtgcccaganggatgcaatgtgnactgaagtncnatccgagaggnatttaagtanggaatgnntcactgggacgacacacaccaatgaaataatggacgcttccctggaagacgtgcagttataattgancnagatgactgaattgtagaatatgcaanccntggacaagggtttanaattcntgggttattccccctnctncanaatncatgatnttctttcnctttntaaaaaa

SEQ ID NO: 80988 - DNA, 515 bp, Triticum aestivum
  unsure (1)..(515): unsure at all n locations
  Clone ID: PAT_TA_80988
ttcacacttactcaggttcccaaacattcagaatcagtctcttctgtctggttttgcttactgcatagcatcctgcagcatgattttagttaataagtttgtgttgtctggctatggtttcaacgctggaatattcctcatgatttaccagaacattgtatcagtgaccatagtttctgcactgtccctctctggtgttatcccaactgaaccattaacatggaagttaatcaaagtttggttgctgtgaacatcatatttgtcggaatgctaatcacaagcatgttagtttgaagtacatcaatgttgcgatgttgactatcttgaagatgtcgaaatgtcctactgcttctggggaacctacntcttaagaanagacgtagacaagttngattcnctatgtgtganatccagcaatgcaggngatacgatctccattcatgagcggnaacatgnagacttaaatgttctgaagnacgaatcgctaacgcgnagnatgaaggcganaggccnca

SEQ ID NO: 80989 - DNA, 456 bp, Triticum aestivum
  unsure (1)..(456): unsure at all n locations
  Clone ID: PAT_TA_80989
gaggagagaggagagagagacgccgccgcccgactcctctccaagactccgccgtccagcgcctccccaagacgccgcagctcgacgcctcgacgccggcgtacctcctccggcgtactggatttctctccggtggttctcaggcaaccagagaagcaagattaaacaatttggacaaactattggccattcaaaaactggatgatcatgacatcatcaagagcaattcatatgtatgacaacatcattctcagtggtctgtaaaaatataactaattgtgagctattgcacaagtaccctgtgttgcattatgtttgttgcaaaattatggtgttgctgtgaaagtcacggatgagatattattgattccaagtcatgttgtttttgagaaatcatgtatttcctgtgatataattgatattgttgtgatgagatattgatcnaaaaaaaaaaaa

SEQ ID NO: 80990 - DNA, 502 bp, Triticum aestivum
  unsure (1)..(502): unsure at all n locations
  Clone ID: PAT_TA_80990
gtgacctcgcgtgccgccattgccggaggtggctggctggatggacgggcgtccgcggtgccggtgttttgcagccttacatctcagggaagacgcttgctaaaatgtgtgcatgccaagattcctgcggttccagactgattgctggtgcggatgggaggtggatgcccgcacggatccggcgtctccaacctcggcatccacaaggaggagcggcgacaattacatacccaaccatggggnagcagcaattcatgatgttttgcatnancctgtcattgctaaggaagaancantanttaaagaancagactacatgttttcttgttgnnaancactanatagtctattattctttncctgtntagagntttcagcagctgaatcttnaatacgtatgttgtaggttgcttgatcaaataaagtacggatgtgatggaaatttgtagaatgtgagttttagatattctgnatattcactaattgtggtaaaaaaaaaaaa

SEQ ID NO: 80991 - DNA, 203 bp, Triticum aestivum
  Clone ID: PAT_TA_80991
actaatataagagcgtttagattactataaagtagtgattcaaatgtttttatattagtttgtgaagggagtacatgtgtgtgtaacgaataattacctagctgtattatgtgaggcaattaatgtattaatatgtaccgcacccgccatctgtagaaagaaataaaataataacaacaaattgagacaacaaaaaaaaaaaa

SEQ ID NO: 80992 - DNA, 563 bp, Triticum aestivum
  unsure (1)..(563): unsure at all n locations
  Clone ID: PAT_TA_80992
tcgagttttttttttttttttctgtttttctaattaatgcccaacagttgcagttaaatagaaaaacagaaacaaataaaaaaacagagagagggaagctacctgggccttacctatgctggcccagcccacctggctcggcccagccgactggccctgccagtcgtcgtcctcctcgcgccagaaggacgcggancgtggccggcgcccgcggccacacgccggccacctcctgcttctgccgatgtcttggagacgtccagggatgccacgcgacccccacgtccccctctcatcctcnctcactctccccctcgtctccctcactctctcccgcgatgcccgtgcgcattcctcgccgccgttcgccgtagacgacgtagagnaccccctcgcccctccgacaagcaaatcgcntgcaacgacgccctcgcctccccaccgagcagcttgccggaggcctgnatgcgtatggctgtcttaaactggtactgcggaagcgttatgattgctcntcggtgccccgagccantgatgntatgactccttagctcgcgcttccn

SEQ ID NO: 80993 - DNA, 413 bp, Triticum aestivum
  unsure (1)..(413): unsure at all n locations
  Clone ID: PAT_TA_80993
gcctggcatctctccccacgagcngccgcccccaggtctagggttccccctttcttcttctccacgcgaatcagctagatactagaaccagcatcgatggcggcggcagcaccggcggacgcgaaggcggaggccgccaagatggacctcctcgaggacgacgacgagttcgaggagttcgagatngaccaagaatgggatgacaaggaagatggcaacgaagctgtccagcaatgggaggatgactggggatgacgacgacgtgaatgacgatttctcantgcagctgaggaaagagctggagggaggcaacactcagaagagtgaantanttccncatccatatcaaactgtagtacacttnatnttcgtnaggnantgtgnggcaatggtctntgaanctgggnanttcc

SEQ ID NO: 80994 - DNA, 551 bp, Triticum aestivum
  unsure (1)..(551): unsure at all n locations
  Clone ID: PAT_TA_80994
ctcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaagttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttggccagatcaagactggatttgctgatggcaaggacctgatcctgtctgtgatgtccgccatgggtgaagaacagatcncgctgtgaaggaatcggtggtggaagnagcantgtcgtggttgcctactggatacttggaacnagtgctctgggtgttt

SEQ ID NO: 80995 - DNA, 386 bp, Triticum aestivum
  unsure (1)..(386): unsure at all n locations
  Clone ID: PAT_TA_80995
ctcagacaagcccctccgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgctgtgaaggatctgaagcgtggctttgttgnatcaactccaaggatgaccctgccaaggaagcggcaaacttcacctcccagtcatcatcatgaaccaccctggttcagatggcaacggcaacgcccaagtgtngnatgcaaacctcccaaattgcggaaaa

SEQ ID NO: 80996 - DNA, 544 bp, Triticum aestivum
  unsure (1)..(544): unsure at all n locations
  Clone ID: PAT_TA_80996
gaagaggccaagaggaggtacgaggagttcgtgaggagcaagagggggcggaaggagtccaaggccaggcgggaggtgctcgtcgacctgtgctgctccgccgtcagcgccgtcgccgtgctcagcttcctcgcctccgtcgtcctacgctagagtcaggggtccatccgggatatctctaccccgtgaaacatgtacaacagttttcccactagaacagacgatcaaaaaaagtgcagagatttgactactgaatactgatagtgaagcgaacaatcctatttttctgtgctgttggtcccgaaactcagggagttgaaggtcgcacggtgctcacaatttaaccatggtggtcttctgaaaaagtctgtaaaaatagccaccgggggaaaggcatccttctcaaagtacagttattatgccaggtctcnaagcatggtgaaaataccactatgtcaatactagcttaaattctgnaactgagtactactgctagtaccatttctananaaaaananggtgggnangaggaggnggnagnact

SEQ ID NO: 80997 - DNA, 330 bp, Triticum aestivum
  unsure (1)..(330): unsure at all n locations
  Clone ID: PAT_TA_80997
gcgacgccgggagaggtacttcagccaggtgatggcggcggcgctgagggagggcgcggaccaccacggcaangaggccctggcgcgggtggcggtgacgcggtcggacgtggacatggacgncatccgggcggcctaccaggagcagttcggggccaagctcgaggacgccgtcgccggcagnnngcacggggnacttcagggacgcgntcgtntngctcatcgtnggaaantnanccatatgtncagtnttgnaancgcggcggggntngtnttcttcttgttcggggggngatggngccncggcnggaggtgtgttttnntggtggt

SEQ ID NO: 80998 - DNA, 565 bp, Triticum aestivum
  unsure (1)..(565): unsure at all n locations
  Clone ID: PAT_TA_80998
gcaccgcataccgggcaagcgttcaaatcctcgtactcaacgcggtagaggatgcagtcattagggcatgcatgtatcttctgcacctctaaccctagagggcggacagccttctttgcttcatacgtactctcgggcaattcgttgtcctttggaagcatattctttatcattacgagcaactttccaaatcccttgtcagatacaccattctctgccttccattgcagcaattccagtgtggtgcccaacttttttttgtcagcttcgcaattcgggtacaacaatttcttgtgatcatctaacatgcgctgcaacttcttctccaaatcacttgcgcagtttctctttgcatcggcaatggcccgacctagatcatcagcgggctcatctgatgcctcttcttcagcttcttcctgcattgctggctcagcttcttcccccattgttgatcacatatcagggaaccatggcaggatagtgcgcaacctctntctnatgtcttcaacataaccttcnnctcgtgctggncaaaataagggggataaacggcccaatagtggcn

SEQ ID NO: 80999 - DNA, 418 bp, Triticum aestivum
  unsure (1)..(418): unsure at all n locations
  Clone ID: PAT_TA_80999
agcagttcatctcctcaaccctgagcccgccgcgcccgcctgcccgccccgatggcccgcacgaagcagacggcgaggaagtccaccggcggcaaggcgccgcggaagcagctggcgaccaaggcggcgcgcaagtccgccccggccaccggcggcgtgaagaagccgcaccgcttccgccccggcaccgtcgcgctccgcgagatccgcaagtaccagaagagcacggagctgctcatccgcaagctgcccttccagcgcctggtgcgggagatcgcgcaggacttcaagacgacttcngcttccagagctccgccgtgtcgcgctccaggaggccgccgaggcttacctcgtggggngttcgaggacacnaactctggcatccacgcaaagnggttacatnatnccaaggaaataa

SEQ ID NO: 81000 - DNA, 252 bp, Triticum aestivum
  unsure (1)..(252): unsure at all n locations
  Clone ID: PAT_TA_81000
cctcaacccaagcgcgccctcccccgcccgccaccggcagccanggcgacggagcnggccaacgcgccgccgatgaagtcggggaagcacgggnncgagggcacccaggaggtgcagcaccgcatccgcancaccctctcctccaagtccgtcaanaaccncgagaaggtgagcgcggagcnggngaanggcgccaangagaatcagctcaaggtcaanggccccgtgccgnatgcccancaangtgncaca

SEQ ID NO: 81001 - DNA, 422 bp, Triticum aestivum
  unsure (1)..(422): unsure at all n locations
  Clone ID: PAT_TA_81001
ccgccccgagcttttccggtccccgtccaggtccccagtaaaagcttccgcatgcggcatctcctcctcccagcacctcgccaacgccaggcatctcttcccgctcccgctgcccaagccctgagccccagcgcaagtccggtccccagatccccgctctgcccatggcggcgcggacgcaggcgtggcagttcgcggccgccttggtcttcttccacggctccgagtacgtcctcgccgccgccttccacggccacagcaacgtcaccgcaactcacttcttatcagcaagcagtatgttttggcaatgagttttgcgatggtggaacactgacagaaagcttttcttccngaaataaaagggatngtttgcagaaaatggccttcnaaggggctgttgggaaataatcgaaaatggtgtt

SEQ ID NO: 81002 - DNA, 571 bp, Triticum aestivum
  unsure (1)..(571): unsure at all n locations
  Clone ID: PAT_TA_81002
gcaaggctggcggccccaggaagaagtcggtgacgcggtccgtcaaggccgggctccagttccctgtcggccgcatcgggcgctacctcaagaagggccgctacgcccagcgcgtcggcaccggcgcccccgtttaccttgccgccgtcctcgagtacctcgccgccgagctgctggagctcgccgggaacgccgccaaggacaacaagaagagccgcatcatcccgcgccacctgctgctcgccgtcaggaacgacgaggagctcggaaagctgctggccggcgtcaccatcgcgcacggtggcgtgatccccaagatcaacccggtgctcctccccaagaggaccgcggagaaggagggcaaggagcccaagtctccaagaaagcgaccaagtcccccaagaagaccaccaaggttaatcgacgcgttcatgtcgtagatgtcgtagtgttttcgtagtgtcggtgtgttctgtagttgtgttgntacctgttgtgtnatgttaatgaagaatgnagaantctctacttccaaaaaaaagggggccggaccaattgcctaagtagngat

SEQ ID NO: 81003 - DNA, 237 bp, Triticum aestivum
  unsure (1)..(237): unsure at all n locations
  Clone ID: PAT_TA_81003
tacagaaaaatagaaatagaaaacaaaacagaaaaagagagagagagaaagaccagaggccacttacctggctagcccggcccatctggcctgtgccagtcatcacctacctctgctagtaggcacaggagggacaccccgacaccgccgagcttgccacgccacctccctgcctgcctgtcgtcgcccgcgccaggcaatgcctngaaacgcctcggcggngcngcccngacccct

SEQ ID NO: 81004 - DNA, 441 bp, Triticum aestivum
  unsure (1)..(441): unsure at all n locations
  Clone ID: PAT_TA_81004
acaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagtttacaaggtcgannacgccacnggcaaggtgaccaggtctcaggagggagtgccccaacgccgantggggngngggaacnttaatggcaaacnatttngaccgccagnattgngacaagtggggcctcacttagtctaaaccagaggttagnggtngtnggattntcnggctttaacgacntatgagag

SEQ ID NO: 81005 - DNA, 253 bp, Triticum aestivum
  unsure (1)..(253): unsure at all n locations
  Clone ID: PAT_TA_81005
atagaaaacaaaaggaaatatgttcgggtgaaacacaaaatgccacgtgnttctngattatatancatatagtttttttaatttgtagcaacacatgccgtcgttgagcttgtatatataggcagtagcttatattcaacacatagttgtgtctattcgtantgacnctttggtggaggcgcngaanatgtcgttgcggnngttntcatccgncacacagngggttttttcacgcnagagnctttggttggga

SEQ ID NO: 81006 - DNA, 350 bp, Triticum aestivum
  unsure (1)..(350): unsure at all n locations
  Clone ID: PAT_TA_81006
ctctnnacaaatacatgacttgatattatngtgtatnanattgtacacagtagatatatgataaggactctatntgnatactattttttgnaaaagaaanttcgacgggtatnaaaaggtaacaaggcataaccgcattgnnattctatgntctacnnaggaattttgtttggaaaatgacaaggnagtgctttatttttgnatcnttagagcgagcacanaanaatcagaanatatataagtatnttactttgggaggagaacttatggatagacctgaatcacagctcgagctnntagttgttganaatgttanagccatgnaccgtgcgttggtgaagatgttgctc

SEQ ID NO: 81007 - DNA, 565 bp, Triticum aestivum
  unsure (1)..(565): unsure at all n locations
  Clone ID: PAT_TA_81007
tgattggttatacagtccaacggttattctaataatatggtcaaatcttctgggatgatcnagctttcgacctcttaccaacctaggctgcaatacacgatctgcgtgtggataatcctaatttagtttcttggttcaatttagcctgctgcagtacaattctgatttgggtgttttgctggttatccagaanctgcgagccactcatcttctggcacacctgcgtttggatgatagcactctctgtntaatttgttcttctccanaattcaattagccccccaacaactctgatnntgatttgttgctggctccccagactggaattacntgtcctcttttggctctatcggcatggnatncctncttatgggnntcaactttctggacctttcttatcgaganantctgacncagcagacnnagtgcccgtgcgtactcatcncagctctnnagntagggctncanggaataatggacgtggggtgacctgaccntccagcgagncaggaaggtacgtatgcacgcgnacgannagcagntcgcctaagnacagtaagaggnt

SEQ ID NO: 81008 - DNA, 566 bp, Triticum aestivum
  unsure (1)..(566): unsure at all n locations
  Clone ID: PAT_TA_81008
tgngangctcaanatgctgctggnngtgtatnatgcgaggntgtcaagcnacangtncttggncggttatttcttcagcttcgccgacctcacccatttntncttcatgcgcnatttcatggcgacggagcatgcngttgtnctcgatgtgtatccgcacgtaaaggcanggtgggaggcgctgcnggcaaggccgncggtcaagaaggtgatagctggcangccgccggactgnggancgggagcgggaacataccagganaaggcatangcntggngtgcgngngatgcgcgaancatctcnacccaacccacgagcaataaaggaagcaaagtgngggtggggtatgaaagaacgtgtgcggggaatgttgccnaataccaatagaatgatgctcaaaaaaagaaggcaaggcnatgcccccatnctgcagaggancaaggtncacancaangngtgaagcccacanacgaaaagaangaaggccgtncanaaaaaanaaaaacncgngggggcnggaccanncgccanaggggcgaaangggggcnnggcgcggtnaanntc

SEQ ID NO: 81009 - DNA, 160 bp, Triticum aestivum
  unsure (1)..(160): unsure at all n locations
  Clone ID: PAT_TA_81009
acaacggcgacanagcctggngcgatcagtggntcttctgggtggngccgttcatcggcgcggcgatcgcngcgctctaccaccagacgancctccgcncaagcccaggcgctatcgctccttccggngcnacgcctagctagctcgccaagccatcagc

SEQ ID NO: 81010 - DNA, 202 bp, Triticum aestivum
  unsure (1)..(202): unsure at all n locations
  Clone ID: PAT_TA_81010
ccgcctcgccaaantccggcgtcaactgaccggcggcagcatgactaagatncaaagtnacgctgttaaggntgcnatnacgcagattgttggggaggcgaganaaaagaagnggaagttnantgagagtgtggagcttcagatnggtgtnaaaaagtaggaggagaaaaggagaaatgtttgagnggatgagtgaagctgt

SEQ ID NO: 81011 - DNA, 496 bp, Triticum aestivum
  unsure (1)..(496): unsure at all n locations
  Clone ID: PAT_TA_81011
aaaaggtagggtttccagttgcgcgccgccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacattggcttcatcaagtaccgttaagaatggnaactnaanggagcaagggctaggnatttttaacgaacnggggggggntagcgggggggattttncccaaaaanctaggaagggatactagaatgtngaancctgggaaaaaaccgngaaacatgtagcnanngcgttgannaaggaaangggaaancaaaaaatagnatnggggtgggagnaaaaaaaaccnggggggggcnggtnacnaanttgggnaanagggggggaaangggggnaanggggggntnaanggggggggggaaancgggggaa

SEQ ID NO: 81012 - DNA, 516 bp, Triticum aestivum
  unsure (1)..(516): unsure at all n locations
  Clone ID: PAT_TA_81012
gaaatggcgggtctcanatgcgcctccctganggccatgtattcgtnatgggtgataaccgtnatatcanctgttattctngtgcctggtgacctcttcctatnanctacattcttggnagatacatgatgtccttcacaaggccgtccctccaatagccaaggcgaagagcttcgatgaccaccagcnttgccgaacaccccctgatgccactcgatatgatgttatcgagctatgttgggcctcgagccctttctagtatgtagatccacgagaccttcctatgcagtgtgatgtagcgctgtctgnggagtagnactnaatccggggaagaactatgtagtgacctgatggtagctgtgtcacncaccccggggcngcnggcagnggnagtnaagccgctacangtggaagacccgcaaaatggcctaaagggacacctggagaacggancggcngatctaccggaatgtgaataggacgaagctgacaacagagtgnatgaacatggggggg

SEQ ID NO: 81013 - DNA, 456 bp, Triticum aestivum
  unsure (1)..(456): unsure at all n locations
  Clone ID: PAT_TA_81013
cacaaaanangccaacaccaatcanggcctccatccaatcccaagcnacctcgangatgtcttgctgcggaggnngctgcggctgctgcagcncctgctagtttggcaacggctgctgcggctgctacatgtaccccgatgtcnatgccgccggctccaccctcctcgtngccgccaccgcnacccacaaggcgagctccggcgggatggagatggcggcggaggatggcggctgcngctgcacccagtgcaagnncggcaccagctgcggcngctcctgctgcagcggctagatcattgancancgancatgcatgcaccgcgcgcatgcaacatancgangancganccatccagccaacgagtaccatgtaacgcnacctgaacgagggcctgtgatgatgnaagcacctgccagcatgagcagagaggncactcccangcatgaaaccgncc

SEQ ID NO: 81014 - DNA, 255 bp, Triticum aestivum
  unsure (1)..(255): unsure at all n locations
  Clone ID: PAT_TA_81014
ngcctcccctccccgtcnacacaaaggtattgaacctntncgtncgtntctnccagcnattcgattcanatgaattcnagangcgtgcccatntccatgctagcngcntctgcatgnatcaggagggtcagcaggaagcaggattcanctgggtngcctganagcngtgtacatttgtngctttggacgttccgtttctctctcntttccgcctgtgcgcgccgcggtgtccnncttggttncggcgtccggaaa

SEQ ID NO: 81015 - DNA, 398 bp, Triticum aestivum
  unsure (1)..(398): unsure at all n locations
  Clone ID: PAT_TA_81015
cgcaggtcatggagcatgtggcgaggcaggtcgcgccgtataaaaaggtccgcaaggtggtgttcgtcgactccatacccaaatcgccggccgggaagatcctgaggaggcagttgtcagaccatatgcagccttgccatgtgtccagactgtgatgaaccttgtgaccatcggcgagatcctcttctgtatgtgctgccatgggcagaaacaanactctcaatatcgtcaggtgtgcatggtgctatacaaataaaatggatggtanatgacgccccatcccattgtatatgtagtagtagcagatcgcaaccgttggantgntcnaagttagagttcaaaccatgtggtgccgnnttggaacatgatgtcgtagagnattttnttttgggnggnat

SEQ ID NO: 81016 - DNA, 235 bp, Triticum aestivum
  unsure (1)..(235): unsure at all n locations
  Clone ID: PAT_TA_81016
atctaaggcctcctcatcgaattcaggtagcaacttcctcttcnggtagctcttggtggngcnattaccgccgtacttcgctgctgtattgagtactttactccatctgnttttaagtgtgtcttgcgcaccttgagcctttgcttctgcttttttagantcctcncgatgncaacgagcctttcacgggcattctgttgctccgagtgtctgtcnggtgtgatgtcatccggac

SEQ ID NO: 81017 - DNA, 176 bp, Triticum aestivum
  unsure (1)..(176): unsure at all n locations
  Clone ID: PAT_TA_81017
gttttttttttttttttttttttttntttttttttttttttttttccanacgancggatcaatatcaatatccaaatgccagcacggcacataatccaganaacacaancnataacnccagcaatataataacnaaaactcaaaggaacangtccgttgtgcanggngccatacac

SEQ ID NO: 81018 - DNA, 372 bp, Triticum aestivum
  unsure (1)..(372): unsure at all n locations
  Clone ID: PAT_TA_81018
caagaaaaaaggagggctcnaangaaaagaagaagaagaggaaancgggtggccgtnccaccttgctgccgcccctnaacncngacctggctgcnctccaactcctcgcnaccttccaccnctcaacgaccaccanaacaaagcangggaattaaagagggtaaacagaaanaccaantcgaaggaaagnagnagggannagncaccgggagattaatggaagcacncggaccaccgcttctntccancggacgangccngcctgctgnacttcctnnttttcgacctcgnggagcaaagttgtggatngtntccnacggancccttgttggncctctccggcttggnttcactggtcatnttngtccctgg

SEQ ID NO: 81019 - DNA, 265 bp, Triticum aestivum
  unsure (1)..(265): unsure at all n locations
  Clone ID: PAT_TA_81019
cccnacgccgcgcccggcctccccccctntctcccggncncgccccccgnccnactgncaggcctcaaccaagttattcnncngccaaagactgangccntttcgtctgtctgtnaatcgaagttngtcnatgttgtggtacagtgaaaaatctttcaagacttnagtaatgttgttgagtcaatnattangaggnaatagtnaattcantnttnttgcaagaaaantgtgatgtttgatggnttggtatatangtgatggttga

SEQ ID NO: 81020 - DNA, 414 bp, Triticum aestivum
  unsure (1)..(414): unsure at all n locations
  Clone ID: PAT_TA_81020
ncngcagtgtgcctctacaccgcnatcaaggccnacattctcggcatcaagctcnatgtccccatcggcctgaccctcctccttanccngtgcggcgagaagtgccccgccgacttcncttgccccgtctgatccatccatccgtggatgagtnttatgcgtgcctggtcgttctactcgtanctngtttgcgtgtcntnngcgcgcgccgtgcgtgtgttttttctgttgcngttcatatgccgggcgtttgcgtgggctccctcgctcgtgcgtgcgtgcttngcaggcttgtnatngntcggtgtcattgtgtcncgttntggtgtcnggatgcgtgnnttgcatatttgtagaaggatancgtcttgngngtgtacctgggatagntagtttgtncgannttgaagaaag

SEQ ID NO: 81021 - DNA, 286 bp, Triticum aestivum
  unsure (1)..(286): unsure at all n locations
  Clone ID: PAT_TA_81021
aaagagancgccagttgggggttcgtcgntgccatgttcaatntcggcattgngcatttggncaacatngacgggagcgangagcatgggttcctcggcttccgtgacaccgtcanctccttcngcgcttgggtcgatnagatgagggcttccnaggttgttccgtgatgctcttgttntcnagtatctgtngtngtctncggcgtatgctactgcnncccatttggncgctcatntgngaggngggacntctgagaatnggtnaacatacccanacatttgnggc

SEQ ID NO: 81022 - DNA, 536 bp, Triticum aestivum
  unsure (1)..(536): unsure at all n locations
  Clone ID: PAT_TA_81022
gtccggttcaaatttaattcattacaaaatatgacaatacaccctcaagtttgcccggttcataaaacacacaccagcatgactacaaaacaaagcaacagcgatggctctcagccaaagcaaagcaagctatccttgtaagaagagatcaactcactccaacacctgtacttggtctattattacaaaaccaatcaatctctcgttctgcaagcgactgtcatttaanacaagcgcatcacacaatttaacttcgtggcctagctcaacactttggcaatcttcgattctttggcataaaccggcggcccacccgccgtttggcggacacatctcgggatgccaccagcagtaacctggcgtgtccatgctgctactaaccttcagattgcggcaagtcagttctctgttcgtttttttttaggggaaagtcgattctctgctagctagaccaaacatccagtatgcaanttactaactaacaaagcngtgatncataaggggaaatattttctgagggcaagcatcattcctca

SEQ ID NO: 81023 - DNA, 536 bp, Triticum aestivum
  unsure (1)..(536): unsure at all n locations
  Clone ID: PAT_TA_81023
ccaagatgcagatcttcgtgaagaccctgcacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagtaagcgcaagaagaagacctacaccaagcccaagaagcaaaagcacaagcacaagaaggtgaagctcgccgtcctccagttcttacaaggtcgacgacgccaccggcaaggtgaccaggctcaggaaggagtgccccaacgccgactgcggcgcgggcactttcatggccaaccacttcgaccgccactactggcggcaagtgcggcctcactnacgtctacaaccagaaggtttagaggttgcttgcgattgctctgctctttttancttactatcgagagtcgaattcaattta

SEQ ID NO: 81024 - DNA, 539 bp, Triticum aestivum
  unsure (1)..(539): unsure at all n locations
  Clone ID: PAT_TA_81024
cttcagtgtgcaaaatgatccgaacatattgcatgagtccaacttctcgcactggatggactagagtaattgttgagaagccctttggaagggacctggactccgcagaaganttaagttcccaacttggggagctattcgaggaagatcaactctacaggnttgaccactacttgggaaangagttggtccaaaacttgcttgtgcttcgttttgcgaaccgtttgttcttaccactttggaaccgtggaggatattttgatcaatatggaatcatccgtgtatatcattcagaaccatttgttgcaggttttctgtttggttgcaatggaaaagcctgtatctcttaagcctggagcacattagagatgagaaagtcaagttctgcaatccgtgaacccganaaagggacgaagagggaagncctgggacaatancagggccacaaggaagaccctacagtgccagatgactctaaaaccccaacggttgcatcnantgtacctaggggacacaaggaaagaggggagggggnccct

SEQ ID NO: 81025 - DNA, 528 bp, Triticum aestivum
  unsure (1)..(528): unsure at all n locations
  Clone ID: PAT_TA_81025
ctactgtcacatacacacacacaagtgctagctagctaatcgatcagccagccatggcggaggagaagcaccaccaccacctgttccaccacaagaaggagggcgaggacttccagcccgccgctgacggcgcgtcgacatgtacgggtactcgaccgagacggtggtgaccgccaccggcaacgagggcgagtacgagcggatcaccaaggaggagaagcaccacaagcacaaggagcacctcggcgagatgggcgccgccgccgccggagccttcgccctctacgagaagcacgaggcgaagaaggacccggagcacgcgcacaagcacaagatcgaggaggaggtggccgccgccgcagccgttcggcgccggcggtttcgtctttccacgagcaccacgagaagaagcaggaccacaaggaggccaaggaggccagcggcgaagaaaaagcaccaccaatttnggntanatcgtcgttgaagttgcggttggccggcttgcggccggccgtgcgttttgntaan

SEQ ID NO: 81026 - DNA, 274 bp, Triticum aestivum
  unsure (1)..(274): unsure at all n locations
  Clone ID: PAT_TA_81026
tatatatccaaatgatttgaaatttatacagttccttcatattcccaaattatcaccctcctccaaattgcagctcagtcaaaacatctatgtgagcccaggttcaatttatattttatggccagattggcacattggaaaganagtgttatccagatccctcctattaccctcaaactttttgggcactcttccatacccaaatcattgccacatgataatattcagatccattttcctggtaaatctttctcaggaaatttccaaagtttct

SEQ ID NO: 81027 - DNA, 519 bp, Triticum aestivum
  unsure (1)..(519): unsure at all n locations
  Clone ID: PAT_TA_81027
cggaaccaacaaatccccaccaatctcgtctccaatcgacccgaggctcgtcgaatcctccttccccaccgcctcangatgcaganctttgtgaagacactgacgggcaagaccatcacccttgacgtggagtcgtctgacaccatcgacaatgtcaaggccaagncccaggacaaggngggcattcctccagaccagcagcgtctcatcttcgctgggaagcagctggaggntggccgtaccctcgnctgactacaacatccagaaggngtccacccttccaccttgttcctgcgtctgcctggtggcatgcagatcttcgtgaagaccctcactggaaagactatcacccttggangttgagagctctgacaccatcgacaatgtcaagggcnaagancnaagacaaggagggggatttcccccgggaccagnagtgttgacctttgntggcaagnagctggaggatggttggaaantnggggatagaaaatncagaaggagtnaacttnanctggt

SEQ ID NO: 81028 - DNA, 193 bp, Triticum aestivum
  unsure (1)..(193): unsure at all n locations
  Clone ID: PAT_TA_81028
catgactgtgctcagcacccggaacaccaccatccccaccaagaaggagcagggctncnccacctacnccgacaaccagcctggngtgngcagccaggttgttgagggtganaggacaaggaccaggganaacaaccngctgncaagtntgagcnctccggnatcccgccnncacccaggggtgttccncaga

SEQ ID NO: 81029 - DNA, 292 bp, Triticum aestivum
  unsure (1)..(292): unsure at all n locations
  Clone ID: PAT_TA_81029
gtcgtggggctccatctggcggctggacacgcaccgcccgctgcaggggcccttttcgctgcgggtcaccaacgantccggcaggtcgcncntcgccgagcaggtcatcccagccgnctggnagcccganacggtgtacagctccctcgtncagttcgatnganccctcccgcncatccatggnangcatccatgcacgtncatgcatgggttngtcgagacgtcgcttgtgacgtccggngtgtgtngtcttcgtgtgctagcnacgtgtgctntntcgtngcgcatacgt

SEQ ID NO: 81030 - DNA, 393 bp, Triticum aestivum
  Clone ID: PAT_TA_81030
agcatggagtgaagcatgtgaagcagcagtttcagcagggcaatcaacaaaagcagacctgtaacagtaacaagtgtagtgtacccagtggatccatagtgctgaatgatgatgcgagcgtgggcaagagggacatcatggaagctgccctggtggagcctgggcaggctgatgcacacaagcatggagtgaggcatgtgaagcagcagtttcagcaggtcaatcgacagaagtggacacgtaagaggagcaagcgtaggtacccagtggatcaacaatctcttccgcaaatattctcgtgacattataggaataaagagtgaggttaaacgtgtgcgactggagaaccaacctccaaaggagttgcttgaagcagagatgtttatccaggca

SEQ ID NO: 81031 - DNA, 224 bp, Triticum aestivum
  unsure (1)..(224): unsure at all n locations
  Clone ID: PAT_TA_81031
gcctcgcctattgcagctactgcatgaccttctgcatgtgtgatctgtncccgggtcagtcgtgcggnggacccgcggttcacagggggcgacggcaacaccttctatttccanggnaagaaggaccaggacttctgtatcgtcnctgacaaggnccnccacatcaacgnacacttcancggcaancacnanccggganatgaaagcgngacttcacatgggtg

SEQ ID NO: 81032 - DNA, 514 bp, Triticum aestivum
  unsure (1)..(514): unsure at all n locations
  Clone ID: PAT_TA_81032
ccaccgcaccgcacgagtgangtgagagctttgcacgagaacttcatcagagaccatgaagggcaccaagctcgcggcgatcctgancctccaggccgtcctggtcatgggactcctctcacacgtgaacgccgattttntccccaagtgctgcaacaactgcaggtccttctcgggggtcgacgtctgcgacgacgcccaccccaagtgtccccagggctgctcggcgtgccncgtggtgtcgacgagccccgaaatgtggcgctgcncgnatatgaaatccaccgtcnacngcacctgcggtgnaccctgcaagaatactgatcggttcatgccgncatatatgttccncctaaaataaaataaaactcagccagatnagcacgtcatcgttcctatccgtgtgtgtgtgccaacaatcttataccagtatntcgttttcgcgctgtgtttcttctcagnaaaagtnngtgttcttgtttcagctanccgaatanccccgtaaaaacactga

SEQ ID NO: 81033 - DNA, 506 bp, Triticum aestivum
  unsure (1)..(506): unsure at all n locations
  Clone ID: PAT_TA_81033
ctctatagtcgttctggacganccttcacgaaatttgaattttttgggcggacagtttgaataccaaatggacgaactncaaatgtntgagcgggcccattcatgtttgagcctgcattctgaagcccatgccagcccgaatcanaaagaacttttttttagcaactgcatcctttattaagcgttcaaatacatggggatacagatgatatcgggcaaaacactaagccacacatggcgcccgggactaagagaagtagctgcctttgctaaggcataggcctccccattatgcttcctattttcaagaaganacgtgatattctgaaagcgcgacctctggtacttgatancttgcaggatggggtaatagcggcaaggnactncatcttgtaagttcatcactacctccaggcatctgangcacacacacggattngactgcagatngntgcaagcgangggctcgctnatgctgnngtngagatgntgataaggngccttca

SEQ ID NO: 81034 - DNA, 187 bp, Triticum aestivum
  unsure (1)..(187): unsure at all n locations
  Clone ID: PAT_TA_81034
gccaggtccctcggcgccgccatcntctacaacnagangcaggcgtgggacgaccactgggtctnctgggttggtccgttcatcggtgcggcgctggcggccatctaccacntggngtggatcagggcnatccccttnnagagccgcgactagncagcnaatnngtctgccgancntggacgggtgg

SEQ ID NO: 81035 - DNA, 246 bp, Triticum aestivum
  unsure (1)..(246): unsure at all n locations
  Clone ID: PAT_TA_81035
anggggacgagcacgagtttgaggcgccgggacgacgcctacntcctggnctcggcggagacgggcgggggtggagctgccctactcgtgccgngcgggggcgtgctcganctnngcgggnaanatcgaggctngcgcggttgaccagtngtacgggtcgttcctggacgacgcgcanaggggggagggctacgtgctgnnntgcattgnctacncnaagtcggnctgngtcatccacanccacaa

SEQ ID NO: 81036 - DNA, 321 bp, Triticum aestivum
  unsure (1)..(321): unsure at all n locations
  Clone ID: PAT_TA_81036
gtggaaggagggccggcaacaggtctggtcaggaaagcttcaccatcgacgttccaaccagagctgttgacataangnaaatcagatttgatggaataaatgatgagtatcttgttacnggggcaatgcctagtgcagcatccaggagaatggccagtnattacaggnatcccaggtatgtncgccgncgcgcgcacgcctaggagcacantgcagcagcaatcnggangttcagaagcatccngcctccaccgcctgtaacattccttcncctctncnctctgctgtccaagnccgtatttngtgtgcanagncggtagc

SEQ ID NO: 81037 - DNA, 213 bp, Triticum aestivum
  unsure (1)..(213): unsure at all n locations
  Clone ID: PAT_TA_81037
aagttactattgcttgctctcgatagattgaacggattaggacaagtagatctatcatgagttttgagtgcgaatcatcttcatcaacagtacaggcaagtncacactttgancatacgtcttactacccagttttattgcattanancaatcgtcaaacaattgcatggttagganctgattaanangtgggttttggnaagtagttgatga

SEQ ID NO: 81038 - DNA, 299 bp, Triticum aestivum
  unsure (1)..(299): unsure at all n locations
  Clone ID: PAT_TA_81038
gagaaatcaagttcaaanaaaaagaacaagatgagaatactaagccggatggctgcccgcgtggcgaggaattcgtcggtgaactgcctcagcgccgcggcttggctctgnagccgggtccggacgtcttgcgcacgacgttcaccatggctgancctccgcccggngtccaccccgnggtagcgnnggccgcctccgcgtctcgggccgacgagctggagcccacggncggctgcggctccgacgnancttctgtggttnagaaangnccttccctgcangccggcttgcggagccgg

SEQ ID NO: 81039 - DNA, 403 bp, Triticum aestivum
  unsure (1)..(403): unsure at all n locations
  Clone ID: PAT_TA_81039
acaagatccaccaccacagagtagtcagcctcttgcagactgaaagaaaattccagctcttagttacttcagactattaataagtagactccagagtctatttttcagtctgtatatagagttcttagagggcagcagaattttggtacccgtgtcattctttcattcctaaattcatttgtatctggcagaagcactccttgttatcagaagatgattcgggagtgctggccttttttacacttncaatgaaccttagtgcttcagtacttgtctgaaccctcaaagggatgccattcgactccttgaaagcaatacatcgtttgatttactagaanaaaggagngaaggaggtgggagganggggaagggagaaaaaaaancngnggggggnccgaaccga

SEQ ID NO: 81040 - DNA, 228 bp, Triticum aestivum
  unsure (1)..(228): unsure at all n locations
  Clone ID: PAT_TA_81040
gcaataaatatagaacctctttattatatcaacaaaggtantgttctgaatttacaaaaggaagtacatcaccgaccatgtacattacacgcacaacntcacatttnaagtccaaggccaagtntttaaatttnnagggtaagtngagttncctgtnntgctgncacgtaggatgancttcgcggtcaattngntcggtttncctcgnacgaggcgngnagcgcttcg

SEQ ID NO: 81041 - DNA, 173 bp, Triticum aestivum
  unsure (1)..(173): unsure at all n locations
  Clone ID: PAT_TA_81041
ngatagntatanccgtnctcgctttngtcttgttatccatgtcatccangtttnatttagcttggtttgttaanttattnttttgcttttatgcgacatnatatntcgngctatttgttgganatngtaancagtcccctccanacttattttactataacngcagaataaac

SEQ ID NO: 81042 - DNA, 564 bp, Triticum aestivum
  unsure (1)..(564): unsure at all n locations
  Clone ID: PAT_TA_81042
caacatgaagctgaatgctcagcttcaggaatctgaaattaataaaaaggaggccgaggaccgagttttacagttggatttcttctcaggaagtgttgcagctgtgaacatggatttgcacaataagattgaggttttagagaatgagaataaaaaggccgaggaccgagcaaaggaggcagaaagtgaaatggagagtgttgtggctgagaacaggaaactgaacgatcagctccaggtagtagagggccaagcagtgaagctgaaatttttttgtgaaaaggttgcaggtgtaaacattagttttgcaccgtaagcnggagggttcagaggngagataaaatgtccgaggagcaagcccanggagaccngngaaggngatgaaanctgttcntggatgnnaatgtgnaactaaagnggncgggtntcnaaaattnaatntgnttaaatngaaggggtttacngccttttgncgaatnattngtnaaaagggatttgcnaaangttctngccgtaaancatggtttngggnaaaaaaggggggggagggnncccctttnnncc

SEQ ID NO: 81043 - DNA, 152 bp, Triticum aestivum
  unsure (1)..(152): unsure at all n locations
  Clone ID: PAT_TA_81043
ntgnnangacnttttcttttctttcttcttcttnngtctaacaagctanttgactatnnagggtctagctataaatattctggctacntttattttcgcgttggttcnagtaaagataattagagccctnatagataaataaggatgcgttt

SEQ ID NO: 81044 - DNA, 242 bp, Triticum aestivum
  unsure (1)..(242): unsure at all n locations
  Clone ID: PAT_TA_81044
gtcggagctcaccatgaccagcgtgggctatgccgtggccaacatcgacctgatgctggacggaggccagaactggacactgccaggcgccagctcgctcgtgcaggtgaacgaccagacggtgtgcttcgcgttcgttcagacggattcgtcggtgccggcacatgctgagtcgccggcggtgatcctcggggggcaccagttggaagaaaacctcntgatattcnatctgganagggaca

SEQ ID NO: 81045 - DNA, 287 bp, Triticum aestivum
  unsure (1)..(287): unsure at all n locations
  Clone ID: PAT_TA_81045
tcctgaggtaaatcggagccggaggagacccgaggaagaaggagaagcggcgcgncgaggcgcggcgaggagaaagatggggaagatgccggtgcggatgaaggcggtggtgtacgcgctgtcgccgttccagcagcaggtgatgccgggcntgtggaaggacntcacnacnagatccaccanaaggtgtccgaaaatggatttcngccaagttcttcattanccccgtcgttggnactaccatnacngttttntanaaaggggccgggaaaaanttttcccaaaaa

SEQ ID NO: 81046 - DNA, 441 bp, Triticum aestivum
  unsure (1)..(441): unsure at all n locations
  Clone ID: PAT_TA_81046
atttcgatgaaattgatgatggaaattctgctgtctgctcttacctccaactcttcgtcatgctgctggacaagaagcagcacgtgcatgacctgcgagaaagaggtgtcatccaaggaggaggactcaccagcagtgagacgctcctcttcttcatttgcattggcaagaacatgcgggtcggaaggaactacctcaagataatggtaaaggtcgaggacttcaagcagaagatgacatgttgtgtcaagctgtggctctccattaagaagaacaggactagaatcgtgacggtgatttcagccattggtgtagttatcggcatcttgtcgtcgctcccagctctcaagccacgtaagacgtnccggacatgattctagtaccattagcatgcatgtcctacttgnaccccttaactattncacattgaaaaaaaaaaaa

SEQ ID NO: 81047 - DNA, 250 bp, Triticum aestivum
  unsure (1)..(250): unsure at all n locations
  Clone ID: PAT_TA_81047
accgcaagtacttcgaccgcnacgtctgccgcctcttcctcgncggcctctgcccccacgacctcttccagctcacgaaaatggatctcggaccctgccccaaggtccactcgctgcagctgcggaaggacnatgangaggtgaaancaaaggggncngagaatttcgacagggacctcgaggacatgntagacaggctcatcntggagtncnagcgcaagatccagagggcgctcaaacgcctcgccga

SEQ ID NO: 81048 - DNA, 363 bp, Triticum aestivum
  unsure (1)..(363): unsure at all n locations
  Clone ID: PAT_TA_81048
tcgagttttttttttttttttttttttttttnttttttttgcangaacctgntttgtanattcacttcagttcagatggaccatttcaaagacanacacataaactccgngaacanaaacnnaaaatttcacaagncacaaagacaccaatagcaaaccanaccanaacaccaaccaganggccggcgccnatttcattattcgcactcgatnananacggaacaatcaccacaagngcatcaaccgnttgcacctnagccagttgcaagggtcgcanttgaagctggcgncncagctgcanctntgggnggcccacacnggnttcggggggcntcctcgaactncaccttggggggcntgac

SEQ ID NO: 81049 - DNA, 320 bp, Triticum aestivum
  unsure (1)..(320): unsure at all n locations
  Clone ID: PAT_TA_81049
acgagatcggcgaggatgaggacggcacaagacggaccgccaaacctagacaaatctagaggaaaatggactttngacaaggagctccaagaggagaaagcttaagtgtggcttgggcatttaacgaagacctcatgtgcataggaggtgagctagagcaccagaaaactctccacggccggccaaaaaaagaaagtactccactgctctgctctcgggcactggggtatatataggcatctcattggtcccggttcgtggctgnaaacgggaacttangaccanatttggtcncggtttggncccggttcgagcaacaa

SEQ ID NO: 81050 - DNA, 474 bp, Triticum aestivum
  unsure (1)..(474): unsure at all n locations
  Clone ID: PAT_TA_81050
aaacagcagaaattagacgagaggcagcaaggaatcgttcgttggtgccagactgcctgatcgaagctaagttatcagaagatccatggccatggagaggttcttcacggcgctcgtcttccccgaggcgctgctggacggctacggcacgtcggtgctcagcgccggcgcggtcaacaggctggtctcaggcggcggcagcgcgacgaagccggcggtgactagcaaggcggacgccgaggaaagntttnttttnggggcanggaaattcgacagtgcaaaggcgcgctgtgttcgagctcgcgttcgacgggctcaattgcttcgacaccattgtcatgcactgancaccacgtcggtttgtngattttgatttgtatagnaacttggattggatngtngaaatgcttcacacgtaaaaaaacnaacaccatcgnccnnaaaaaaaactcnnaggggggggcccggtnaccc

SEQ ID NO: 81051 - DNA, 467 bp, Triticum aestivum
  unsure (1)..(467): unsure at all n locations
  Clone ID: PAT_TA_81051
cagggagatgctcttcggcatctcctacatgctcttcaacctctggctcaccgcctacctcatcggcaacatgaccaacctcgtcgtccacagcaccagccgcaccagagacttcagggacatggttcaggctgccacggaattcgcggcgaggaaccagctgccgcggcagatagaggagcagatgctgaaccacatatgcctgaggttcaaggcagaggggctcaagcagcaggacacaactttttgggggggggggacatcctccccaaggcgatgagatccagcatatcgctctatctcttcttcccggtggttcagggcgcctacctgttcaggggagtctccccaagcttcatccagcaactggtaacggagatggtgggccgagtactacgccccgaaggaggacatcatactgcagaacgngtacccatcggacctncaccttcttgtgaccggngaag

SEQ ID NO: 81052 - DNA, 478 bp, Triticum aestivum
  unsure (1)..(478): unsure at all n locations
  Clone ID: PAT_TA_81052
gttcggatattttgaggaaggaactcgcaacgccaaggatgcaacagtggaacgtgccatttcatcgagtatatgcatatctgaacagaatgattaatagccaaggccgacaatgatacttcgtcccggaaacgggaacttcgtgattttaacttgttggattgactccagcagattttgatcacaaatcataccctcctttcaaaccgtcatttctatggcgtccgccatcatcctgattgctgattcccccctttgggggggttccacttattcttcttattcttgtgttttcttgccaaaaacttcattcaaatttctcttcccagctatcatcccaggtgtacttgatgcctgcgaatcgaatttgattgtncnancgggtccgacaccaagaggttcgttcctttttcaaccagcgatctgaaactgatcgttcttctgcaaacttcttcttcttcgaaaacggccgttttca

SEQ ID NO: 81053 - DNA, 192 bp, Triticum aestivum
  Clone ID: PAT_TA_81053
gaaagacatggctgcttgttgatatgcttgagtatctaaattattatgtcaaaactagactattgctttgaatcacataaaagtccaaatgtccatgctataaagaaaaagagtatgatatgacttgatgaacaacactccacatcaaaaaatttgtttttatcacttacctactcgagggggggcccggta

SEQ ID NO: 81054 - DNA, 477 bp, Triticum aestivum
  unsure (1)..(477): unsure at all n locations
  Clone ID: PAT_TA_81054
gcgaccccaacgaaggacactacctcaccgcctctctcaacttccgtggctcgaccatccgcactcgcgaggtcgacgaccaaatgctccagttccagaagaagcactctgctgccttcgtcgactggatccccaacaacgtgaagagctccgtctgcacagttccccccactgacgttccacgctcgggtaccttcttggccaacaccaccagcatgcagcagctcttccagcgcgtcatcgaacaatttncccttttnncccccnggccatgttcaagcgaaaggctttcttgcacaactacgtcaacgagggtcttgatatttcagagttgaccgaagctgagtccaacatccaggatctcatctacgagtaccagnagtacgacgctgctacggctgccgatgatttcgagtcgaaggtgaggccgctgatggtctggagcnagatgaccttgcaganccggaagctgacgat

SEQ ID NO: 81055 - DNA, 466 bp, Triticum aestivum
  unsure (1)..(466): unsure at all n locations
  Clone ID: PAT_TA_81055
gcaaggccggcggccccaggaagaagtcggtgacgcgctccgtcaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccggaaacgccgccaaggacaacaagaagagccgcatcatcccgcgccacctgctgctcgcnttggggttttttnccaggaacgacgaggagctcggaaagctgctggccggcgtcacnatcgcgnangttggntattcccaaatntaaaccngntgttctccccaagaggacccnggaaaaaggngggnanggagcccangttttcttaagaagacgaccaagttcccccaagaagaccaccaaggcttagattcgatgcttccatgtcgtagtgttcttcg

SEQ ID NO: 81056 - DNA, 265 bp, Triticum aestivum
  unsure (1)..(265): unsure at all n locations
  Clone ID: PAT_TA_81056
cgaaccagacgccgcaccaatcccgcacccgcacagcccatcggcgacctcgccggagaagagaggagaaggtgagagatggaggcggcggcggcggcggccggcgtgcaactgggcacctcgaagccgcagatcgcgacccaggcggagatggcggaggcgcgcctgccgatcccctaccgcgaccagtgcgcgcacctcctcatcccgctcaanaagtgccgcgtcgccgagttctacctcccctggggggaaaaaaaaaaaa

SEQ ID NO: 81057 - DNA, 482 bp, Triticum aestivum
  unsure (1)..(482): unsure at all n locations
  Clone ID: PAT_TA_81057
cttgcaagtgcaatgtcttgcaagcgagggataatacagacttttgattgaacaagaaatttgtgcacttggaccaaatttacaacaggtaccgaacattatcacatttctgttgatgttcaaagaacaccaaagaaagtgtgagaaaatgggcgtatcacatatggaagaaaacaaaatagcaaactgtgacaaacttgatattttttcaaactttgctttctttccatcggctatttgaacaacaaaagtaacaatttaaaaattttttnatatttaacccatgacttgcatcttagtataattttatacaatcatttgggtgataatatgcgttccaggtttcttgtttattacatcatcttatttaaactgcagancaggaacaagacgggatcaactcgtaggcttgtngttgtctttgctcttcttgctcatctgaactgcngtggccccatgatggcaaccagcgtgcacaccgg

SEQ ID NO: 81058 - DNA, 242 bp, Triticum aestivum
  unsure (1)..(242): unsure at all n locations
  Clone ID: PAT_TA_81058
nggacctccgaggcaatcanngtccgccgcggccgccatggcgttcgagaagatcaaggtcgccaaccctatcgtcgagatggacngcgatgagatgancagagtnttctggnagtctatcaaggacnagcttancttcccattnntggacttgganattaagtactttganttgggagttctanaccgtnatgcangctgatgtnaaggntacnntggatggntctaganggtacttntct

SEQ ID NO: 81059 - DNA, 354 bp, Triticum aestivum
  unsure (1)..(354): unsure at all n locations
  Clone ID: PAT_TA_81059
gttttttttttttttttttttaaatcataagctctatatatactttactgcaattggataattacatgttgagccatttttttggcgggaaaaaaaaatggaccaaaggtttttttttttggtcaacaataaccggacaaattataaccggaaaacctgaggtaagctctggtaagcctccgaagccaccaaattaagcactaaattaatcatctcaaagagatgacttatgtaccanggtatgtcttccaggcactcatctactactacaaaatatggatctctccatgcataaaaaggacaaagaagaagaaaaagggtttaaaaaaagaaggttactgccaaagagcacaa

SEQ ID NO: 81060 - DNA, 465 bp, Triticum aestivum
  Clone ID: PAT_TA_81060
ccgatcctttcctcctaggtcagcggcacgcactcggccaccagcggcgggtgcgccaggccgccggctcaccctactgctctgcgcgaggcccgcacacccacacacacaaaaactcaggcaaaacgcgagcaattgcaacaggacggcggcgacattagaatctgtgactacaatggtgcatggtttgctgttggtgctgaattgaattggggaagaaaagccgctaccccgaaggaccgatggtttctgcatattagagatttgtcgcttgactgataatatgccataacgggattaggaaacccaaagaaattcttcagagttctcttctgaaaatgaagcagcagtagcatttgtgaagatgaacgatgagctgcttgatggaagaaattcgggattaggaaacccaaagaaattcttcagagtttctcttctgaaatgaagcagcaatagctttgtgaa

SEQ ID NO: 81061 - DNA, 685 bp, Triticum aestivum
  unsure (1)..(685): unsure at all n locations
  Clone ID: PAT_TA_81061
gggtttccctccgatttcattaatgaaaccaaactaggatcgaccaacatatcccatccaaactagtcgggttcgaaacatactacaaggttctattcacgagatctaagccaggatgtgtgctgaagcattcagagaacgaccaacatggctggaagacaaagatgagaaggccggttgcagtctttcctcgagagtgaaacatggtagagtataactgtagaaaccttaatcgagtgcaggagagagagcgcagcgaagggccaggcttctgccaactctagatcgcgacaccgataagggggttggctgggaggcaaccaacatgtatcattgtggncacnatcacgactcccggcancactttacgaggagctgagaaactgcacatatccacattgacaacgaccgaacagtggggtggactccaccgantgcaaggccggcttgaacaatgctgaaagtnaagtcaatcaatatagtcctgccttgaaaatatctgctcagtcanggctcagggatccncncattgttgctcatgtggatccaaatngcancaaggcgcaaaatgtactctagattgnangncacattgttggacaaataagcttctcnagnggtnaaaattcaattnccantttcnatcaanaaaaacagcccanttccacaaanaatcattttttan

SEQ ID NO: 81062 - DNA, 412 bp, Triticum aestivum
  unsure (1)..(412): unsure at all n locations
  Clone ID: PAT_TA_81062
tttttttttcctttccaaattggtcatttataccgtaattaatttacagatcagtgttttacggtgaattagcatataatcaagccattcaccatataatcaagccctcaggggcgttacatacaattcctaccaaatccacagtttcagttgctccaaccaaacaacttccagcttttccccagcttacagctgctgctttcccacagctcctagtagccttttcataatctacagctgaaccaggcacagcctaagccggtttgggcaagggtagatttccctttaactaatcatgcttaattaagttataacacatgggaagtgccccagcgcctgggggcagtctttcatattcgcacgttcatgtcagtacacatagatgatacaggtaagtantgataaggggggg

SEQ ID NO: 81063 - DNA, 464 bp, Triticum aestivum
  unsure (1)..(464): unsure at all n locations
  Clone ID: PAT_TA_81063
agccgaggtgctggagctggccgggaacgccgccaaggacaacaagaagacccgcatcgtgccgaggcacctgctgctggccatccgcaacgaccaggagctcgggaggctgctgtccggcgtcaccatcgcccacggcggcgtgatccccaacatcaacccggtgctgctccccaagaaggccgccgagaaggctgagaagccggcaccgccgccaatcgcccaagaagccaccaatcccccaagaagncaccaagcctaattctaataggtgcaaccttcctgttgtgtcccgnancctcctntgccaatgtccgtgttaattaattactgtggngtgttccaaaanangctcaactttacttttgctttgccccccatntaaccgttaacnaagaggaactcntgttcctccgtcttccgaacaatccgggcncnaatgaatgtttgttaaaaaaaaaaaa

SEQ ID NO: 81064 - DNA, 532 bp, Triticum aestivum
  unsure (1)..(532): unsure at all n locations
  Clone ID: PAT_TA_81064
gtgagacaaaaaagaatggccacagcaactgcctcgtcgtctgccccagctcccatcactattcgcatgaagaaatggatgccaatcggctactggcgcttcccatccaacgttaacgagagctgtccggtctgccaggagcatctcactctccgctgccttgagtgccaggcgaacgagggaacgaactgtggtctttccgttcggctcatgtggtcacgtcttccatgtttgttgtattgctggctgggtgaagaaggataaggacagcactaagacctctgtccgctcgatttcccggccgttgggaacccttccgacaagattccccttctctgaaggccctgccgaataatcaaatgatgaacctcttcccctttttggtacaaancttccttnacaacttcccttgantcctgatcatattcncaagatgaatgacaacggctcaaatcactttagcgacantctcntttgcaacaacaagctctcctctttaaaatgggnttgttttcncttcaaaaaaaaaaaa

SEQ ID NO: 81065 - DNA, 459 bp, Triticum aestivum
  unsure (1)..(459): unsure at all n locations
  Clone ID: PAT_TA_81065
aacaaccgtgtgacagacccgaacaagctgagcaaccagttctacaaaaacgtggcctctgggcaggtgttgttcacgtcagaccagacgctaatggatgagacgccaacgaccggcaacaagacagcggccatggtggccgacaatgccgccaaccctatcgcgtggatggtcaggtttgcgggggctatggtgaagatgggaggcattgaggtgctcaccgggactggcccggcgaatcagaaagcctgcaataccaccaacaacgcgagctaaattggtgggactgcatgcacgatgatacttaaacaaaaantacctaagcataaccngtggctaattggttnacctggtanaccgttcatccnaaancatagtacattttaaccagaattactangtatttcncctaaaaangataagttattataaagatcactgaaattnaaaaaaaaaaaa

SEQ ID NO: 81066 - DNA, 678 bp, Triticum aestivum
  unsure (1)..(678): unsure at all n locations
  Clone ID: PAT_TA_81066
cttgtgtaggtattctcatgctcgtcctggttgatttctagatgagtgtcatttacatttggatcgtttctcatagatacttcctagtgcacttggcttgttcactgtgaaagtgagatcaccacataatggtggaagaaatgagactcgatgatttgctactaaaataaaggaactttaaatgacccttcgtatcatctcagtgcttggggtggagccagttcagacctgggctgttattttangttcatttcagttccaaactgtcaagagtcaactatggttcttgggtgtcttcgtanatatggcttgtgctttccaataggaacatttctgtttttcgagggaangttagtaaactctgctgaaatcatgatcgctttagctaatgctagacgtgttcaatgtgcangtgtgnaactgtaatgcctcatgagactagtnaagaactgctgcatctcaaaagtggantcnacctttgagcacacaatatccngtatcatgcanctaaattatacataagaaggtcaattggncantagtgtaangnangacacgntgtaaggatganaacatgttacaaanaccanctcgcttttnncaactccgagtagtgggcgggttattcatgtcgngtttttcancnaagnaagancaantctgccggttnccgntttg

SEQ ID NO: 81067 - DNA, 256 bp, Triticum aestivum
  Clone ID: PAT_TA_81067
ctgaggctggccgtgttctgctgaattttgcaacgctactactgctactaccaccaagcaaatgagtgtttcgttttgaaggcagaggaaatgagagctctttagctgtataggatgttgcaattgttgctcgtttggtaactatcgagtactgagaaataagcagtgtgcttgtcagttacgtatctaggatattgttgaaccaccatttcgctctaagatgaacctatttggcgtacgccacaaaaaaaaaaaa

SEQ ID NO: 81068 - DNA, 574 bp, Triticum aestivum
  unsure (1)..(574): unsure at all n locations
  Clone ID: PAT_TA_81068
cacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcttggtgtcgacganccccgaaatgtggcgctgcgcggatatgaatcancgntcgaacggaacttgcgntgggccctgcaaaantacnattcgttaatgccgnaatatanatnttccgccctaaattaaataaacnccgacaaatacaacntaactgcctaactttttttgtgacaacaatanttacattattcttnttctnccggntttccncccaaaaaaatgggttntgtgtnaccancggaaanccctganaaaactgtatgatgtctggtgcaaaagtagtcnctgtcaccantaangttccgtgattaaacccccaagaaattgttgntgtaaaaaaaaaaaa

SEQ ID NO: 81069 - DNA, 648 bp, Triticum aestivum
  unsure (1)..(648): unsure at all n locations
  Clone ID: PAT_TA_81069
aacaagcttatgcttcccaccgccggacggcttgctctgatcacctccgtcttatatgctttgccagtcttccagattttggccattgaacctcctcgttgggctgtcaaaaagtttgacaaaagatgcagagggttcctttgggcaaataaagatgaggcaactgggggtaaatgtttggttaattggaagcaagtatgcttacctaaaaanttgggcggccttggggattccctgtctgctccaaaaaagtgaggcaatgagatgcaagtggctgtggtttccctgggatggacactacgcgacctgggcgtggttaactctgtccaacaacaactcggtcaanggtctcctttgaggttcatccaattcaacatgggggatggcccaaacgcatttttggcaaccttngacaacagagaattcaaccaagtcccgattatcaaacatgcacgtnatcnaatcaacctcaagcttgacgacggaaatggatcnaacttaaacaccttccagancntaacattactcagtgaagacncactgggactatcaaataganaactacttggttgctgaaggnatttcccgcaaaangaacctaagcaanaaccgttaattgcggccanccccaagnatttttggggcaaa

SEQ ID NO: 81070 - DNA, 536 bp, Triticum aestivum
  unsure (1)..(536): unsure at all n locations
  Clone ID: PAT_TA_81070
gcataccagtgtctagtgccgcaaaaccctgtctgtgcctccaaaagaccaccttagttgttggttcttcagttacatggcgggttccaagcatgtctcgtcgtgcacctgcattctgatcatgttggtcgtgtcgagccacctggcgtcgtgcccgtgcgaggcgaggaggctgatggcggcgtcggcgaagatcaacggcgatgaggcatgcatgtcagctgggtgccgtgccgtgcaaggtactgctagtggtactgcggaggcgacgtggaagatggcgaccaccgacagccgtggaaccgcgcctgggcacagcccggggatcggcaacaagctgcacgctgcanggacggtcaccgttaagcgaaactaagcgcaacatgctggatgggtacagattcttgttanatgaatgaactttcccttgattgtatccncgttcattgtatcaattatgtgtatgtgtaaaanttttanaaacaaaaaaactgtgacgtgtattcctttcacnggaataanttgtcatgccntcc

SEQ ID NO: 81071 - DNA, 675 bp, Triticum aestivum
  unsure (1)..(675): unsure at all n locations
  Clone ID: PAT_TA_81071
gctcagccacaacccagtacactcttgctggctacttgtttcatcagcatagcaatggtgccctccaaggtcgccctcttcctcgccctgaacctggtcctcatggcagccgcgcatggctgcgggtcgtactgcagcaacacaccggccatcccagtgccaaccccgccgatggccatgcccccgcccgtcatcccagtcccaaccccgccgacgaccggaggcggcagcggcacctgctcgatnaacacgctgaagctgaaggcgtgcgccaacgtactgaacctgctaaagtcaacctcggcgtgccggcaagcgaggatgctgccccctgctgancgggcttgccgactcgacgccgctgtctgtctctgcaccgccatcaacgccaacgtctcgggatcaaactcaaagtcctgtcnactcgtgctcctcctaaacaatgcggaaagantgccccgccgactnactgcccaactgatcaccatatcatcgttgatgcatcaaaacatgatctccnggtananctcanggttgatgtanaccatgnattannatttgttccctcantggcgcacaacnccnttaaaaaccccgcataggattnaaagaaacncaaagaggttgaatttaannaaaantttcctnggaaaaanttantntaaaaaaaaaaaa

SEQ ID NO: 81072 - DNA, 672 bp, Triticum aestivum
  unsure (1)..(672): unsure at all n locations
  Clone ID: PAT_TA_81072
nnggcnccgaaatcgtcngcacnttcgtgcnggtttacancgtcntctcngcnacngacgccaagcgcancgccagagactcncacgtccccacttttggnnccgcttcnngattgggttcgcggtgttcctggtgcacctgtcgacgatccccatcaccggcacgggcatcancccgganaggtcgctcagcncngccatcngctanaacaanaagcncgcgtngnacgaccacgggntcttctgggttggtcngttcatcngagcggcgntggtngccatctacnacgtngtggtgattanggcaatcnccgtcaagnggccgnaatntcngccaatcaatctgctatactgtgganggnatcatcgtgttttcgttgaattnctccttgcactcanatgtttttccacatancctnatttcagnttgnatctttcgtcaagcnttcagtgatnttgcaaaaccggtanagtagattaacatgttttgcttcaaaggtcatccatacatgaatagtccgaaantnaangccagtgatntanttncccgattcaanntntaaacccgggggggcngtacattcccaattggtcatactgcaaggcgtctttaaanctanggaacctggnggcattaccttccaaccctttanggtaacaagncacttctca

SEQ ID NO: 81073 - DNA, 663 bp, Triticum aestivum
  unsure (1)..(663): unsure at all n locations
  Clone ID: PAT_TA_81073
gttccacggaaccaagatgctgggttggctgaactcccagccactgttgctgcactgaagaaccccaactcaaaaatcctttatgaccagtacaaccatgaaagatatcctcctggagatcccagcaagcgtgcctttgcctactttgttctgagtggtgggagattcgtatatgcatcactgctgcgtctccttgtcttgaagtttgtcttgagcatgtcagcaagtaaggatgtgcttgcacttgcttcccttgaggttgatctatccagcattgaacccggtagcacagtgactgtcaagtggcgtggaaagccagtcttcatcaggcgacggacagacgatgacatcaagctggccaacagcgtggatgttgcatccctgcgccaccagagcaagacgctgagcgtgtgaagaaccagagtggctggtggtaatggtgtcgcaccatcctggttcantcccttccaactctggagacttggtggctggntcgccgtgcatggtccacataatctcgganaatcgcaaggcctgcccgtaaacttagggccactaagttctgaaatacagatccaagcaagncnaaacatacacgcataatanaaggtaatccgtccgtattgttnaggcagatttttcagcatcangatcagntccaga

SEQ ID NO: 81074 - DNA, 565 bp, Triticum aestivum
  unsure (1)..(565): unsure at all n locations
  Clone ID: PAT_TA_81074
tggcaagctcgatatggacacttcacagattggcctgggcgtatgacccagcagtcggcatattccaggttagccggggcacagattactcatcggtgtacatgganagcattgtgcggccgaaggcattctcagcgagcaaagaagtcgggaagacggtgcgcccgaaggtcgggttcacggtggtgccgggcttccggcttggcggcacggtgatccaatgcagggtgtacctagagtcctagactgctgagggcgatggaggaattatagattcaaatgatatgaaacaatatagtcaaaaataaactgtacatttgggaaacaaaaggagttgtgtaaaggcgatcaaagatgatcagtatgccagagataaaccctcannatcgaattgctacttgatataagagtagaangaaactagtattaactttttgattaattgtggcttgtgtaaaggggtgttctgatttgtangttgtcaaaggtcaaaagcgtttcaacattgnaggattacaactgcgcgcttccaatttgggnattacgtgatataaaaanacaactg

SEQ ID NO: 81075 - DNA, 688 bp, Triticum aestivum
  unsure (1)..(688): unsure at all n locations
  Clone ID: PAT_TA_81075
cgtcaactcggagtacgcgggcaccgacgccttcgttgcatattgtcgggccgttgcctcatcttccagccccttcgccggcaccgggatgccctcttggcgccttctgctcctcgcacctcacctaggcgctcctttcgccctcctgctgtcttgtttcacctcctgaggagagggacaagaaagggattacgggcaccttatctctttttagtttgtaagcctgcgggcacttgttagatttgaaacttgtaatccccttgctcatgtttttctttccatacgaactgtacctgtatgggacgtttttaatgaaaaagggtatttttcgggttctttgtgcgtgagcgaggcccatgccaaggaacgaaccttgttaattttaagaataacaatgtcgcccggaaaaaggcttgcaatccccccgcttggncaacgtnccaagctctcggnggaggnaggggcaacaaggttaggnccncgttanttcctgcaacggaatacaacaanttcatccagggananccttgtncggaaangganccggtggtttaananaaaacaggttaaangtccattttaangaattatacngganaagctannattcaacccggaacttgtnccngtgatctggttacccggttgttcgggcgacccggcacccttcangcagaaatcatccgac

SEQ ID NO: 81076 - DNA, 382 bp, Triticum aestivum
  unsure (1)..(382): unsure at all n locations
  Clone ID: PAT_TA_81076
taccacagaggcttggccgtccgcggcaacggcgattcggacggtcgtggcgaaggcagcggcggtggccgcgggtgggcgcagtgcgcggtgtgcctcagtctggtgaaggaaggggaggtggtgaggcagctgccggcgtgcatgcacctgttccatgtaggctgcgtcgacacctggttgcactcccactccacttgccctctgtgcagggccacggtagagcccccttcgaaagaccaggtgcctcctgtgtgattactgcgagatttgcacagagttttctgtgctatgtagcatgtatttttgtacacatcagatgtagaaattgctgtgctgcnagtgcgtaccaagaattctgcaccaaactaaaaaaaaaaaa

SEQ ID NO: 81077 - DNA, 631 bp, Triticum aestivum
  unsure (1)..(631): unsure at all n locations
  Clone ID: PAT_TA_81077
tactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgtttgatgaccaaggccgtgaaggtggttgacattgttgacaccttccgtcttcaagagcaacctgcttttgacaagaagcatttatctctcacatgaagcgctacatcaagaactctctgccaacttgaaggggatgacctaaatgctttcaagaagaatgttgaatccgccacaaagtatcctcctaacaagctcaaggacctcanttcnttgttggcnaaacatcatgatgatgcggctggtgtcgcctacacaaggagganctgctgatcaacttccgtacttcaatggctgaanagtcaattcaanccacgttgcaaatcaagcgnctcatatttgcctacaggtgcatcaccccaagttggtcnaacggcaattt

SEQ ID NO: 81078 - DNA, 645 bp, Triticum aestivum
  unsure (1)..(645): unsure at all n locations
  Clone ID: PAT_TA_81078
ggtgtgcgtttaagtattgctatcgaatcggcagatgctctggtctatatgcactcaaaaaccaatgccaaaatcatacatggtgatgttaaacctgcaaatatactcttggatgataagtttgcgccgaagatctcagactttggcatatcaaggttgattgcgagagacaaaaaacacaccggatctgtcattggtgacatgagttatatcgatccagtgtatctacaaactggcctactaaccgagaaaagtgatgtctacagttttgggtgttgtcatactgggaacttattaagtgggcagaaancacacattctgatggcggcagcttagtaaacatttccttgaagctgggaagaaagagaagaaagtgacagattgtttgacaaggaaatgtatcncacgagatttggagatcctgatantttgggcagcatcgccttgggatgtctaacctgatgtggtnaaagacacnatgacagagtagtaaacgcctccataatgaacggtccgtaagtctaacttcttcatgtaangtctgtcaataanagtgggacttacctaaatgtttttacaaanccataggaagacaggaagttcanttgtcanaaattgaaaatgttacttttcaaaaaaacaann

SEQ ID NO: 81079 - DNA, 634 bp, Triticum aestivum
  unsure (1)..(634): unsure at all n locations
  Clone ID: PAT_TA_81079
ctccgatccaccaccgccgccgcacagaccacaacatctcgagtagtttccagctcgccggaaagcagcaagcaagatggccggcaggaagggcggcgacaggaagaaggcggtgacccgctccgtgaaggccgggctccagttccccgtcggccgcatcgggcgctacctcaagaagggccgctacgcccagcgcgtcggctccggcgcccccgtctacctcgccgccgtcctcgagtacctcgccgccgaggtgctggagctcgccggcaacgcggccaaggataacaagaagacccgcatcatcccgcgccacctgctgctcgccgtccgcaacgaccaaggagctcggcaggctgctcgccggcgtgacatcgcccacggcggcgtgatcccaacatcaactccgtgctgctccccaagaatccccgccgccgccgagaaggaggcaagtccccaagaagaagacacacaagtcccaaagaagaagtcccgcaangagtancgtcccatanctaacaggttgctaatcaatccatgncnaataaatcgtagtatcctgtatccgtattcctaatctcacagttacatgaccgtattctaattnaagtnatattaactgaaaaaaaaaaaa

SEQ ID NO: 81080 - DNA, 493 bp, Triticum aestivum
  unsure (1)..(493): unsure at all n locations
  Clone ID: PAT_TA_81080
atcanatttggaggatgtcttgcaactgtggatccggttgcagctgcggctcagactgcaagtgcgggaaggtgtaccctgatctgacggagcagggcattgccgccgcccaggtcgccnccgtggncgtcctcggcgtggcgcctgagaacaaggcaggtcatttctaggtggccgcnggccattccgggcnagggctgcagctgcggcnacnttgcaantgcaacccctgcaaactgttaagctgcatgcactcttacngtcttncntactgtnanggngtaaagagtnnacgtganaaaagaacctctgatttgatggnctccnccaagggtgngtgtacangtgctgngggtnaaatcgctggctcnccgcaaacgcnccgccctgggntccttgtntntatntgggtnaantttccccgnaatggctcancgntcccaacgngggtggaattccaattttnaaaatggggttttcccaataacccccc

SEQ ID NO: 81081 - DNA, 525 bp, Triticum aestivum
  unsure (1)..(525): unsure at all n locations
  Clone ID: PAT_TA_81081
ccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaatgcaacccctgcaactgttaagctgcatgcactccgtacgtacgtgtgttggtgtgagagtatacgtgaataacgagcgtctgatctgatggatccaacaagggtgcgtgtgcgtgtgcgtgtggtttgcntgctcgctctcccatctctgccatggtgtccttgtgtgtangtgtgtgtcatgtgtccctgtaattgcntaactatcccactatggatggagnatgaatattagaatgaagattaccaaaaaaaaaaaa

SEQ ID NO: 81082 - DNA, 297 bp, Triticum aestivum
  Clone ID: PAT_TA_81082
cggaggttcggtagcatgcgcatgttggcgtcgtgtatcggcggcccgtgagatcaacgcactgctgctgtctgtactctatactctagtatagtctagcgtgtgtgtaccaaggaagaaattaatgcttaccgcgcattcggcagtatttttttcttttctgagatctggcagttttttgttttagctttcgcgcattccgcagtattttcttttcttttctgagatctggcagttttttgtttaaacttttgtgcattcggcagttttccactccctccaaaaaaaagggggggc

SEQ ID NO: 81083 - DNA, 692 bp, Triticum aestivum
  unsure (1)..(692): unsure at all n locations
  Clone ID: PAT_TA_81083
ctcgccgtgtgcaacctgctctcgggcgcgtgccacgtgctccccccgctgcgctgcgactggttcttcgactactttggcactagcgcccacgccgtcctcaccggcgcggactgttgccccgacgacggccagcggcaatcgccggacccggcctccttcaaggtgctggtcgccggcgtcagcgacgaccggcggcactacgttctccgcacgttctcctccggtgacccgagctggagcgcgcccagcgagtgcttcgacccggtagagcgcggcatcttcgggccgttcaagcggcgcagcgccgtcgtgagccacgggacggcgcactgggtcctctgggacctggtgaagttccacgtcctcgacgtgaacgccgccactcgccacgcctccttgcaggagctacagacccgccgccggcgggcgactccccctgtacgattcgccgcatctgaacgtcggacaaacaaggggcgacctgtctcgcttgtcgtcaaccaagatccaagtggaattggaccggnggacgnggaaancagcacaagatgcggcgtnatggcnccataggtntanatacaccgacanaacagtttcaaggcacgtcattcccgaaaagacganctttatacgacttcgngattnatttatcgaaatgccatgngagnaggcatcngnccaaaaaacag

SEQ ID NO: 81084 - DNA, 672 bp, Triticum aestivum
  unsure (1)..(672): unsure at all n locations
  Clone ID: PAT_TA_81084
ctcgtgccggtcgcatcttcatcatcaagatatatcttagcttctttgagagatgagagatgctcaatgcctgaatagaagccaagatatatcttgatgatgaagatgcgacaccttcagaatgcaaggctgcagctgctgagatcaggaaggaagcgggtgccaatcccaaccatcttgcacttacttttgagggggaatcagattcagaaggagaggacaatgaagagaccagtggtagtgatgaggagggaggcagtgacactgatgaggacaatgaagagaccagtggtagtgacgagaagagcaagggagaangtgacactgatgagtcctaaaatgggatgatcgtcatcaccaactgcaagagtatctgcgcggctggagcatggatttctaccgaaggagcatgaagctaattaatatctttgcacttgcgtgcacttgtcntggatccaactgaagataaagagaacactctggaaaatggctcnntcctccaactgaattncactttcacacnagtgtttgatgcactgtcctacttgngatcaattaacncgtaacanaaataaggtctttcncaaancngtccaaacttnacnttgaggccaaccattcctnangaaattncggaacttgtatttaaaaaaaacccngggccgacatccc

SEQ ID NO: 81085 - DNA, 678 bp, Triticum aestivum
  unsure (1)..(678): unsure at all n locations
  Clone ID: PAT_TA_81085
gagaaactggtacctcggtcctgacttttattatgccgtgaagattgggattgtgcaatacatgatactcaagcctatttgtgctatcttggcaattttgctagaacttctgggtatctatggagaaggaaaatttgcatggagatatgggtacccatatttggctgttgttctaaatttcagccagacatgggcattgtactgtcttgtacagttctacactgctaccaaggagaagctggaacctattaagcccctgtccaagtttctaactttcaaatctattatatttttgacatggtgggcaaggtatgctgttgcatttctgttttcaactgggctttttaatggacatcctggcacaaagtttgcaaacacgtatccaaggattatataatatgtctggagaagggggtggcngcaatggtcatatgaaagtatccagctaagcctacaggcgtggcganagaatgttataancgcntcatgtcgataagcaccctggggccaaatctgaaaaaacanagatgaaattacaacaggaactcnncccgatcanaaaagngttanttcccaaatntcctanttnttagaccggaaataggccanatcaaanaatcccanttcaccnngaaggntccanaaataccccccnttcgaattacnttaaccangggg

SEQ ID NO: 81086 - DNA, 545 bp, Triticum aestivum
  unsure (1)..(545): unsure at all n locations
  Clone ID: PAT_TA_81086
ggatcgcaaggttcctcaaggccggcaagtacgccgagcgcgtcggcgccggcgcccccgtctacctcgccgccgtccttgagtacctcgccgctgaggtcttggagctggccggaaacgccgccagggacaacaagaagacacgtatcgtgccccgccacatccaactcgccgtgcgcaatgacgangagctgaacaaattgcttggcgggccaacatcgccaaccgcggtgtgatcccaacatcaacaacactcctccccaaaaaggctcttctccaaggtcaacgttcaatacgacaaaactgaggccctaactttctcgctgcaccgctgacaanggttaatttgatcacaaaanacaaggatttctgttcgaccctagttaaagnctnggttnaagaaaacccgatggttggataagaaattaatttgggggcggtaatnntttacccaggggntaaattggaaaaaatttggggttaaaacaattaaggggctattntcggttaagggaaaatnaggacncntntctaaaaaaaaaaaa

SEQ ID NO: 81087 - DNA, 662 bp, Triticum aestivum
  unsure (1)..(662): unsure at all n locations
  Clone ID: PAT_TA_81087
ctcgggagcccgacgactatcccaaactctacgagactccggagacgagcgacgacagctacgcacccccgaggtcttgccgcgcccggagcaaggcggcagaatcgggccgtcgccatcgctgatctggatggggttggcgccggcctcttgaggcccactgttgatgatggcgttggccatgatgacacgtgtagttagggctcctcaaagttctttcctttttgttccctatgaggaatcgagaaacaccccggtggggcatgtaaagggtccgcgatgcattttgttgatgttatccttattatgaaatcatgcgaatgcttgtcctgtcccggttggtccccctttctaacctcgtganaactggcgctctacgctganagtcccgtcccaaagcaagctgtaccgtcctgggtatcaagtccnatccgtggtcaaggcaagagtnancggccgagtccattaaaaccctgagngcatctaagagncccntaacatcaacanctcaanagtaaaaggaggaaattntcaaaggccataataaaattccatntanataatntcagggtaaataccggaantgngtctcctctccaaattctgangtgaaacagtngcangaccccctattcnaaccttggtnattaggccgccngggg

SEQ ID NO: 81088 - DNA, 256 bp, Triticum aestivum
  unsure (1)..(256): unsure at all n locations
  Clone ID: PAT_TA_81088
gnacccactgcttagtttcgtctcgcgcgcnccgttcgtntgttgggcgtttgcgttgcttagatatcgccaataatggancaatcantttgtcttgatgattaagcgtccgtgtgtagtgcgtatatctttcagtanatcgatacncactggtatgcctagtacnccatctctactttttcantgtgtgtaatcgntggagctanaccagctgcgataagctaaatcnttggnttanacacangnccaaanagaa

SEQ ID NO: 81089 - DNA, 227 bp, Triticum aestivum
  unsure (1)..(227): unsure at all n locations
  Clone ID: PAT_TA_81089
ncantgccaccgcattcatcggntctccagcctcccatgtctccnacngtaccngatctcccnacncttatgatnngtcagctgggcacgnccnctantgtggncanagcccaatganggagccatatgcatacccacctgctgtgcaggtgccaaatgttggcnttgggatgcaataccaagcccctcgcatgacctaccccatctacaccgngttacancagttg

SEQ ID NO: 81090 - DNA, 192 bp, Triticum aestivum
  Clone ID: PAT_TA_81090
cgagaaccgcgcgaggcggctggatgagcggaaagatctactcgttaggatagcttctcttctgggttctgattgactatatcatcgggcatgtttgagcctgtttgttcgtggaactctcctgaccgtaagaacactggaatggtagtgcaagtttttaaaaaactgttttgtttagccaaaaaaaaaaaa

SEQ ID NO: 81091 - DNA, 717 bp, Triticum aestivum
  unsure (1)..(717): unsure at all n locations
  Clone ID: PAT_TA_81091
gggtggcctaccttgcaacacagacatagaagaaaacattggagacaattactcaaacaaccctccgaagctacttgagagcctaagaatcgacggatacacatgcaaggggcagcttcttccatggttgctcaaagataacaagctacctgcacttgtcaaggtaactctgcaaaatacctatctgaacaagggtaatatggaacacctcgccgagctggacaacttgtgctgtctcaggcttatgtgccgcgcctacaccgacagcaggtctccttcctttgtgctaaattcaaaagctcaagtatcttctcgttgagtgtggcaacttgatgagatccgctttgatgttggagcactcctgactcaccaaatngtcttgtccttaacagcatggagatcctactcctgtctctctgggataagcatcctatacatttaaggactcgatnaaccgcgatgaatccaagacagtgatcaagaaatacaaacatcaaacaagaactgctctagaaggataaancagcaggacagaactacgaactgancgntccttancacgaatcattctcaaagncttcncctccattattgtaaagnaatggccattctttgtatccaaatcggaaangcaaaaaggcatatanttaggaaataannatttncatancaancaatggttttaatgtttnanngttccttatgaaaaaaaaaaaa

SEQ ID NO: 81092 - DNA, 425 bp, Triticum aestivum
  unsure (1)..(425): unsure at all n locations
  Clone ID: PAT_TA_81092
ggaaagggcggcgccaagcgccaccggaaggtcctccgggacaacatccagggcatcaccaagccggcgatccgcaggctggcgaggagaggcggcgtgaagcgcatctccggcctcatctacgaggagacccgcggcgtcctcaagatcttcctcgagaacgtcatccgtgacgccgtcacctacaccgagcacgcccgccgcaagaccgtcactgccatggactctctacgcgctcaangccaaggccgcacctctacggcttcggaggctaattctgtantggacaatcccncgtttgctttgngttaaaantccgtgggnggttgatttacngatttggcttggccntttatccntctnggttaaatancggtttaaacctgttcgnttaatgcatcanttcgnttcggaaaaaaaaaaaa

SEQ ID NO: 81093 - DNA, 613 bp, Triticum aestivum
  unsure (1)..(613): unsure at all n locations
  Clone ID: PAT_TA_81093
ccgcagcggctttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagaccccgaccacctcgccaaggaaccctttggccaagtgccaactttgcaggatggtgactttacttcttcnaatcacgtgcnattgcaagtatgcgtgccgcaagaacaaccaaactttnaaggagggcgacatcaagatcaacatggtggttttttgcccaagtggaggccacatanacgcgcctacccatccttcatgctancacccatctggggaccctacaaaagtatacaaacttaaataaactcggattcagccactacatcatacggtggaacctattcgctacatttcgtaccntcttgggaaccanattcgtcactnccttagctgganactttgaagcttctcaagctccaacctttattnggcctcccaaaccngttcccattccnaannttttaaccccttntaggt

SEQ ID NO: 81094 - DNA, 667 bp, Triticum aestivum
  unsure (1)..(667): unsure at all n locations
  Clone ID: PAT_TA_81094
ctcccacccaccgccgacctcgccgtcctcctcacccatcgccgccgacctcgtccctccctcccctccccgcatttcccggccacctctacgcacgaggagatcgagcgagcgcccgagcgcgcccgtcctcgcagcctcctcccacgattccccgcacccgagccccacgagaggagctcctcctgtggttttgcacgccgccgccggcaaccaccagccacagcttgccggagccagcagatggtgcactccgccgccatggacgctcgcgtccccgaccttgcagcgcgccgccccgatgccaattcctcctcgccgttctgcgccgccgagccgaanctcgcccaagtcnaagcgtcgccgctgtttgcctcctcgccatggctcccctgcttcgtcgggttaacgacagactcttctccgttaangtgtctcccatcgtctcgttantgtcgggctcgattgatcagcagancccacggtgatgcttcctcggnaccgaggtaaatggaaagtgtatggaaaagagtacanaggtgaaanaaanangatttgcgtaatgaaactttcaaaaaaantccncaaaaattttcccaaggttgttttttttggcacttaaacgnggtaaaanagggcnantanaaccggaattttnaaaangggg

SEQ ID NO: 81095 - DNA, 451 bp, Triticum aestivum
  unsure (1)..(451): unsure at all n locations
  Clone ID: PAT_TA_81095
gacgaggggccggaagaagggcagcaaggccaagaagggcgtggagacctacaagatctacatcttcaaggtgctcaagcaggtgcaccccgacatcggcatctcctccaaggccatgtccatcatgaactccttcatcaacgacatcttcgagaagctggccggcgagtccgccaagctcgcccgctacaacaagaagcccaccatcacgtcccgggagatccagacctcagtgcgcctcgtctccccggcgactcgccaagcatgccgtctccgaagggcaccaaggccgtcacaaattcaacctcatcctaagctggctcgtcntcgtttcatgaacaattnaagggcggnaggcntcctntntgtaattancantantacnatgttacanccttgtaaaattgttcngcttgcttgttggctttaangaataatgatnttccgtttg

SEQ ID NO: 81096 - DNA, 523 bp, Triticum aestivum
  unsure (1)..(523): unsure at all n locations
  Clone ID: PAT_TA_81096
gactggttttcgcatccacggtcaaggttggcgttccatgtattgtacaatggagcgtgacgccttctgtggcattgcaccaatcaacctaaccgagcgcctccaccaaattgtgcgttggtcaggtggatctttagagatgttcttctcactaaataacccactcataggcggtcgtcggatccaatcccttcagcgtgtctcctacctcaacatgacagtctacccagtcacatcactctttatcctactctatgctctcagcccagtgatgtggcttatccctgatgaagtatacattcagangccattcaccaaatatgttgtgttccttctcgtgatcatcctgatgatcaagttattgggtggctcgagataaaatgggcgggggtcacatggttggattactggagaaatgaacattcttcatgattgggtcgacaanncataccaacaaccgtgctnacatggtggggaacccttacaangaagggatcnctcagantactcgancaacagcaca

SEQ ID NO: 81097 - DNA, 556 bp, Triticum aestivum
  unsure (1)..(556): unsure at all n locations
  Clone ID: PAT_TA_81097
ctccaccccagccaaacttcgaagaagcagcagtcgccgcaccatccatggcccccaaggctgccgagaagaagccggtggagaggacccccgcgggcaagaagcccaaggcggagaagaaggtgccggcgtccaaggagggtggcgacaagaaggggaagaagaaggccaagaagagtgtggagacgtacaagatctacatcttcaaggtgctcaagcaggttcaccccgacatcggcatctcctccaaggccatgtccatcatgaactccttcatcaacgacatcttcgagaagctcgctggcgagtccgccaactcgcgangtacaacaagaacccaccatcacttcccgcgagattcaaacctccgtcgcctcgtctccccggcgagtcgcaagcacgccgtctccganggcactaaggcntcacaaattaactcgtctangtctcctgcattaattcaatgttaattctcccctcgtctgatgaatctgtacctactgtgttgttctaaanctcacctgtanatgtgctcctgataatatcatntgcgctn

SEQ ID NO: 81098 - DNA, 574 bp, Triticum aestivum
  unsure (1)..(574): unsure at all n locations
  Clone ID: PAT_TA_81098
ccccaaatctcctcagcctcccgcgcatctcctccgacatggcccgcaccaagcagacggcgaggaagtccaccggcggcaaggcgccgaggaagcagctggccaccaaggccgcccgcaagtccgccccggccacaggcggcgtcaagaagccccaccgcttccgccccggcaccgtcgccctccgcgagatncgcaagtaccaagaagagcaccgagctgctcatccgcaagctccccttncaacgcctcgtccgcgaaatttnccaagacttnaagaacgacttcgctttcattctccgccgtnttcgcctgcaagaggcgccnaggctaactgggtgggctcttccagganacaactctgggcatccaagcaaagggnttacatcatgccaaggaattaacttcgccgccnatcgttgaaaaaaggctaactcgttntctctcngttatctctcctaacctgattgttatcgtggaatgtcntgcaatgttttctgtctggncangtatttcgtttatgtacatcttgcgttatattactgaatgaaatntgcatcgttanaaaaaaaan

SEQ ID NO: 81099 - DNA, 184 bp, Triticum aestivum
  unsure (1)..(184): unsure at all n locations
  Clone ID: PAT_TA_81099
anacanaacaccaacgacaanacgacctcaaagtaatcngatcgaaacggnagtgctaagtgagatggtgttcngtaaanaaggaaaanatntttgttggtggttangatnaatggtttagtcccttctagctaaatgtttnacantaccagaaatcnttcngctgccgtnanatcagagattg

SEQ ID NO: 81100 - DNA, 635 bp, Triticum aestivum
  unsure (1)..(635): unsure at all n locations
  Clone ID: PAT_TA_81100
ggcgggcagcgccgccattgcccctccctccctgttgccactgccaaacatcgtcaagcaaagctcgtgttggctagcggcggcgggaatttctctcgcgtgggtcgttggggatcagtccagcaaggcatggtgttgctctaatggcaaggtggcctaggccatcgccgactctcccctaggtggcactgcgcaacacccgatagtgcggcgtggatcgcgatggtggcggctttggttcccggtgacacgacatccggcgtgctctgcggcatctcccaagtaacggcttcggcttgtcccatggcgtacatcgcaacaccgacaaggcggcgtaattatggcgacattgggcttctgattcccgngacacnnatcangcttctatgcnactntcccaagcnanctcgtcgggagnanaacgctggcttctccgtgcntncataatgctcaatcgggaagnacatgttatnaaccgacatcntacnatcacaatgggattnctttgtatctttacaatttggcctgacaatggctggtaaacnccctggnagtgttcccgtctnanttcaaacgtgcaacangttcatgcncgaatntntagtcccaancggtgcttgannaataanaggaag

SEQ ID NO: 81101 - DNA, 654 bp, Triticum aestivum
  unsure (1)..(654): unsure at all n locations
  Clone ID: PAT_TA_81101
atattgtatcacactatcttatctgcaaaagaagaaaacgtgttagtgcctacatgtagttttgaacattactacaagcctatttggtttgcaggatttataaaatgcactaacatgccatctttgatctgacatgattaacatgtgcatttgattacattctagaaaaatgtagtcttcttcacaagaggttggagtggatgaaaagttccctaagaaaacttgaactcccttatggttaacatttaacaggaaaggaacatcacctcgatatatacttctccaaggcacggaaatcatctcaggaaactgacagcttgctccaagttggggcccgataattctattgccaagaccttcactgtgtgcantttccaaggcaaacttgtccggancattttctgaatgacagtgaacaaactcttcaaaattagaataatttaatttttaaaaggaaagtaaaaggcgctgttgtcntnaanagtgtgggtcaanaaaaattcggntattgtaaacaatacccacactgttaattcgggcaaaatgaattgatcctgtggncctctgataacaaaataaccccaatgaagggttcccaaacnaacntgggaaacttgntttccccccaaaaaanaaantttnaaancggggggg

SEQ ID NO: 81102 - DNA, 471 bp, Triticum aestivum
  unsure (1)..(471): unsure at all n locations
  Clone ID: PAT_TA_81102
aagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccccaaggcgagctccggcgggatggagatggcggccgagaacggcggctgcggctgcacccagtgcaagtgcggcaccagctgcngctgctcctgctgcagctgctagattcatcatcgatcatgcatgcaccgtgccgtgcgtgcatcatcgattgtatcgatntactactaccataccatgtaaccgcaacctgatngaaggcctttaagtaccacctgacctgcatcagcatcangtgccatccatgattgtaacangccccctaaataaaactcccttgatt

SEQ ID NO: 81103 - DNA, 712 bp, Triticum aestivum
  unsure (1)..(712): unsure at all n locations
  Clone ID: PAT_TA_81103
gccatgtctcgtgtgattcaaaaggagttgcaagaggagatacatcacctcggtctcgatagctcttgcacgtgcttatgtcatcagtccacttggcatttggggagacaaaggtagatccatggggatgaccatgggatgctccgcatcatttgttcttcaaaatctatgtttttttaatgaacgtttttcataattgataaacttttttttcaaattttgaatttttttcaaaattagatgaagttttttttcaaatttgatgaactcttttcaagatcgattaacttttttgaaaatgaatgaactttttaaattttgtgaagttttttttcaattttcgatgaattttttcaagtttgataaaataaatccaatttgatgattttcaaattcagtgacttgtgttcaaatcgatgatctttttgcaagatagatttgtttcaattttttggaaacacntgattttangtgaacatttgaaatcacgcctttcctttcaattttgaagatttcaaaanccaccgacggtaacatcacngtgacaaacataagngtcatgcnatcattantcgcactnaggccgccanagacantgctgcccantagacccctgaaccaacgnccatggcntaagatgncnaggccaacnccancggcncctgnttnctccncagtnaaaggnccgtaacactcccnagacatancggcc

SEQ ID NO: 81104 - DNA, 746 bp, Triticum aestivum
  unsure (1)..(746): unsure at all n locations
  Clone ID: PAT_TA_81104
cgctggtgtcggagaacgtacccgtgaaggtaatgacttgtacagggaaatgattgaaagtggtgtcattaagcttgatgagaagcaggctgagagcaagtgtgctcttgtctacgggcaaatgaacgagcccccgggtgctcgtgctcgtgttggtctgactggtttgactgttgctgaacatttccgtgacgctgaaggacaagatgtgctcttgtttattgacaacattttccgtttcacccaaggcaaactctgaggtgtctgctctccttgggacgtattccatctgctgtggggataccaaccaatccttgccaccgttcttgggaggactgcaagagcggttacgacgacaaagaaggntccnattacatcntccaagctattaagtgcctgctgatgattgacggtcctgctcctgctacaactttgccatcttgacctacacgtgtgtcacaaaaattctgancgggcattacctgcgtcnatcttggaccnananaagaagcttccccacttcngggtgtggttacaaaaacgccgtgngtcaaaggtttcaaacnaaaaatctcaganacattccatttggatgtaccnataaataaaaaatangttcctnaagaanttaantccacaaccttccttccatttnnggccagaattgttaaggggtaattcnngtttggataaaanccaccnttaggggggcaattccggaattcaaantnngggccccntttttt

SEQ ID NO: 81105 - DNA, 395 bp, Triticum aestivum
  Clone ID: PAT_TA_81105
ttttttttttttttttttttttttttcggtgaacaataccatcaagaccagtagtatactacatgccactcatgtatctgctacactagctttatatactctgtaaaacaaatgctataaagtagagaaattcggaaatgcagcaaggaattatgtgctacgcttcagcttcccactgaacacaaaactatcatggtattcatgccaacaatcagaatgtacaatccagcaaactatcactatcgttcgactaaatcaacacaacttctcaacctttaccccactttaactcgcaatctacaccaaagccaacgcacatcgcagaacaacccacatagtagcgtctttctgcctgtatgcaggttgaaaagacctactatgtggggtacaacata

SEQ ID NO: 81106 - DNA, 356 bp, Triticum aestivum
  Clone ID: PAT_TA_81106
cagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtattccgtctcttccgtcgctgtgttttctctctccaagaaaaattggtgttgcttgttgttcaaactatccggaatacctcccgttgaataaacagctgttatgattgtgccttgctgccaaaaaaaaaaaa

SEQ ID NO: 81107 - DNA, 436 bp, Triticum aestivum
  unsure (1)..(436): unsure at all n locations
  Clone ID: PAT_TA_81107
catataacagttccaagttagagcaaccacctgtgatggtggagtaggggagatgtgctcataatctacatgtatgttctagaaacaggaacatgtgacatattcacaggcattatgtgtaaagtaagcagatgcaattcaccaaagttagaagcaatacaagctagagatcataagcaacatgcaaccacatataatagtgccaagttagagcaagcacctgtgatggtggagtaggggagatgtgctcatcatctacacagctacgttgactgtccaaccttgtgttgtcctgcaaatcttgttggtaagatggcggattagaatctgtagaacctctgtttgaattgctccgaaggactccatcatcnactgccgaactaattccctcaactgtattgatttgcattgtnagtcaancgataaaaaaaaaaaa

SEQ ID NO: 81108 - DNA, 765 bp, Triticum aestivum
  unsure (1)..(765): unsure at all n locations
  Clone ID: PAT_TA_81108
gcaagatggagcctgtgttccgatagaaagcaagagagcaaagattgattgaccctgccggctgcggagggcctcgttcagatcccctccactggcaccttgggagggacgaaccgcaacgccgttgtctttggatcgagatcgtaacctcatgcccggtgcccatcaacaacagaagatttgatcggtgacaccatccccggtgaccatcaagcaagagaagattgaagtaagccatggatctggccatgggggccatgggctccctccctcnaacaaattaaagcgangttatcnagggaaggagtacaagctacaagaagggcgttcaagaaaaagtcaaatccttctctgcccgaactgggatattatccccctgccctttggnaagtggcaaagtgccgcnagntaactcgacgntaagttaaactttgggctgacatgtcagggactgtctaacnacatggaggatttgttgaccncnccggtgctnttganggcatgacccaatgctgatagttaattnaanaactcanggncaanaggaaactnttaaanggcaggcncccgtagattcaacattcaaaaatcatacgntcaaatntacaacactaaggaaancctaaattctncaagggcacaagaccctttgngagtttnaggaaaaatcncgccaaacngggntttnaaatntgggntcnttacncccaaacccttgtgtgggggaccctnnaaaanccccaaaataaangtngcgccnaaaaa

SEQ ID NO: 81109 - DNA, 640 bp, Triticum aestivum
  unsure (1)..(640): unsure at all n locations
  Clone ID: PAT_TA_81109
ccccgccgcctccgcactgtgccgccgcagccgcagccatgggcgcgtacaagttcgtgtcggagctatggaggaggaagcagtcggacgtgatgaggttcgtgcagcgcgtgcgttgctgggagtacaggcagcagccgggcatcgtgcgcatcacaagccaaccgcccgacaaggcacgccgtctcggctcaaggcaagcaagggtatgtgtctaccgtatccgtntcaagcntngtggcangaagaggcaattcccaaaggtattgtcnatggtaanccaacacaaggtattacccaactcaatttcaaangaaaaaaagctttnctgaanaaaactgggccaagtgggtgtctccngtgccaanccnaaggtgaatgagacctaccncaatactttagncaccctgttganttgctaaatgcnttccaanaccaaggtaactggtctcaaactgtgaaaacacgtaactccgggtcactnaccgaaaaaatcctgttcttgaagggacnnacaaaaaaagcccagaaacactgaggaacaaantntctcnccacgtaantncagcacttnagntcttacacaaattgaccttttgaacctaacctgnaactnttagaaacttanaatcattcttta

SEQ ID NO: 81110 - DNA, 576 bp, Triticum aestivum
  unsure (1)..(576): unsure at all n locations
  Clone ID: PAT_TA_81110
gacagcactaaatacagaagtcttgtaggtgcacttcaatatcttactcttacaagacctaatatatcatttgctgttaacaaagtctgtcaatttcttcatgcacccactattgttcacctgactgctgctaagcgaatagttagatatgtcaagaacacccttaatattggtcttaacttcagcaagtcatcatccacattgcttagtgctttctcagactctgactgggcangttgtttggatgacagacgttctactgggggatttgcagtgttctttggtcctaacttgatttcatggtgtgcaaggaaacaagccactgtctccaaggtccagtactgaagcaagaatacaaggcattagcaaatgctacagctgaaatcatatggatgcagtctccccaanggagcttggtgtaaaaagcaaacaactccatgctaaggtgtgacaattgtgtgcaacttatttgtcngcnaacctgttttcatgcnngatgaaacatattgaattgnttcantttgtaaaaancatggccaaaacacttgaatcntttgtgatccaggataggttcaa

SEQ ID NO: 81111 - DNA, 730 bp, Triticum aestivum
  unsure (1)..(730): unsure at all n locations
  Clone ID: PAT_TA_81111
gcgagatggacggcctcgacaacggaggcgcgcgtgagatcctggggttgaccaatccatagggtgccacatcttccctctgggtcgcctgatgtagccatactgtcgccggatctcctcccccctctctctgtgtgtttttctgtcaatagctagtagcataagttggagctggctgtaccaggaacttaatctgcatttattcaactagatcaagtacaagtacattagttccgtaatctgctattaatacatctccctattcataaatttccctgaagtantgcatgcatatatttaagtgctggntaattaagaaaatgggatgtgattccnaacttgattgctgtaggctacaagatataccttgttgggtcaacctgccgtagaatatcccctgtcaatcattatgtgtatgcnattactccggggacattgagaacaccatcnattgttaaatttgaacancgggtacaactacantgcagaatcatcatcaaatttgggaggangataaaagatagataaccatgctttgaaacangaatcattangcncatccaaatcatgtgacgcaatcanaggnaacaccnngctncaattctacgacngacaaaaggaaattcaanattnanccttcancngttanaaatcacgatggggttcgaaaggagcnaantttttgcannccctttaaccttnttcaaacnggttaaaatnnacagggtgc

SEQ ID NO: 81112 - DNA, 636 bp, Triticum aestivum
  unsure (1)..(636): unsure at all n locations
  Clone ID: PAT_TA_81112
ttttttttttttttttttttgactaagaatagtgcactttacataagcaacaacataaatttagcgtcttgaaaagcatgtgataagaggaccaaaagcaaaccatagaatgtcacaggatagagcataattaagagtacttagtgctagattatattcacacagggcctacagtgtcgtcgatggtgcatctagaggcggtgcagtgtgaaaaccaggctgcgctttgaagtgatccctgaaacaaatgcatagatgtctccctccacgaattttggcgcggtgacaaaactgaaaccattgggtgattataagtggccctccttgtccggaactaaagttaagaacacatttccnaaagctgaaatacaaattagttccagagaaacaacatanttaatattaataacatacagttattacccaccgtgttttccataaaaaatacattatcctgctagaacaacaaactgtggcantaagaaactaccaagaacacatatcaggaggtgatntcaaacaaaggacgataaattacacacaaatgtaaattttttgtttcaattcanagttacncgagcaataagtggcagaatcaatatnntaacngggcgcanantcacacatcaccattcc

SEQ ID NO: 81113 - DNA, 655 bp, Triticum aestivum
  unsure (1)..(655): unsure at all n locations
  Clone ID: PAT_TA_81113
cccgtctcatcgccggctccacctggctcggcttcggcggccggtaccaggacctcatcggccagaaggggctggacgccgtcacgctaggccgtgcccagatggccgcggcggtcgacgtcctggcgaagcatggcaccaccaacgcactggaggaggaggaggagggagtccacgccgacccgtacgccgtgcccaagaccatgctggcgaagctggtgatcatggtgtgcgaggggctgcggttcctcaccgtctccggcagggtggacagggagttcgacatggcggaggtgaccatcaccgagatagangggaagcaggtgaacaaatgggatacgatctcggcggcggtgttcaagtgggccgtcgacccgactgctccgttccccgacctggttgcgttggacgtcaacaataaaacagacgcggaancacgtctgctcgtcaaggtnaaactaccatnaggagtacaccgcncggtgagaaaagaacatattgatcganaccngtgtctatgtctgtaatatcatttttcccggattgtctgtataacnttgnagtngctgaaaaaaaanggggnccgtccaattnccaantgagttttanccccnnggctnttanatncanggaaaccgggtccattaacntgaaa

SEQ ID NO: 81114 - DNA, 719 bp, Triticum aestivum
  unsure (1)..(719): unsure at all n locations
  Clone ID: PAT_TA_81114
aatcgatactgatggtgccatgtcatcacaattagctaaaccaaaattttccacttgacaaaaaaatcaaagtcactttctaatttaagataaagacaaataattgatttcctctaacagaaagaataaaatcttcacctttttctaaaatttcccctgatcattatcttattaaaaactataattatttgcgcacctagtattccctagaaatttataaatgggccagcaacgaataaaatacctcttcaaaaaaaatgtttttaacattgcaaaagaaaaattggaggctgttgtactagctccaaagcattgcctagtatttatatgataaatatcaantcaaactaagatcatttggtatttaattaantgccaaacttaagagggaataaagaaacggtataagaaaaataagaaatagagaaattcctttgcgctcggcctaacgatcacgtccaagcctaaccaactaaacgtcttctccnactctcgcaggagatagcagaggcatggaancggcatccgtggcacacggcggatgcgacgcctgcgcacagaatgctggaagataagaggcgtcccagtctgcaaaccagcgctttcatttcctgtatcctcnaaaagngcaanngcatcgctctccctatccngnacgtnccnctccgaaaanagaacccccattnttgnaccacagacattngggctnccccaccaat

SEQ ID NO: 81115 - DNA, 698 bp, Triticum aestivum
  unsure (1)..(698): unsure at all n locations
  Clone ID: PAT_TA_81115
ggaagagcgagtggagtcgaggaagcagcaggggtagcaggaggagcgtaggaggagggggaggggtgcgagagagatggggtccggatctttcctcaaggtgctggccaaagaacttcgacgtcctcgccgggccattagttccgcttgcttatcctctatatgcttccngtgagagcaaattgaaacaaaatctccaagttagatgattnagcaaatggcttacttaactggggtgctgtactccctttatcactttgttttgactccactttttgctcccgatacttngaatgggcttccnatcctgggccctaatgggaaaactgttccttcnaactgctgggcnatccttcccttgcctcnaatgggtgctgcctaatgttttaacaacatttttccccnaccaatgtttggnnaaccnccaaataatccaacatcngggtacttcccaaaggaaggagaatttnagtaaatctgatgacttctctaaaccgctgagaaatatattgaactaaaatgggccggaacatttgngaaancaattancaagtcacaantcaaancctcaantttagnccacaggnggtcattcttcagaggcgaggctaaaaattggcaggctaaaaaattcanggggaaaccattcacaaaantttcncaaaannatttctggtncccaaaanttttcccancct

SEQ ID NO: 81116 - DNA, 755 bp, Triticum aestivum
  unsure (1)..(755): unsure at all n locations
  Clone ID: PAT_TA_81116
taggaagcaaaactgtgtgtgcttagataatctttcaagcatttgatcaatataaggcaaggggtaatgatattttctagtttctttgtttaattttctgtaatcaattaccattctatagcctgtaataattctttgtggaataagttcattcttatcattaggaacaacagtaatacctcctttcctaagggacacaatgaacaggacttacccatctactatcaactataaggataagattatacctacttccaagaattttaaagattcccgttcctaactactccctcaattttgggttcaaaccgacgttgggtgatnaacaacgggttaacaatcaactccaatattaattttggttggacatagaatggggactggatgcccttaaatccaccaagagtatatccaatagatgcgcngtgctccctaanaactttaaatggccggggaagcattattcaaaatttacccacgatnnagcaatancaactaagagatcatacaacanagggaaatgtgttacgtacccatagaccaaacggaacgttataacncggtatgntcaactctccattcnacgntagtacnagcacaaaccccgcattgaacttaaccgngctcccaacctatcatnagcaggaaattccacaangttcacnaanaattcgcagctaagntaacnangggganggttttatnccaantttgggatttnaacccgggntccataaaaacncctaaacgcatga

SEQ ID NO: 81117 - DNA, 640 bp, Triticum aestivum
  unsure (1)..(640): unsure at all n locations
  Clone ID: PAT_TA_81117
agcagcgcctcatctttgctggcaagcagctggaggacggcaggacccttgctgactacaacatccagaaggagtccaccctccaccttgtcctccgtcttcgtggaggcatgcagatctttgtgaagaccctcactggcaagaccattacgcttgaggtggagtcatccgacaccatcgacaatgtgaaggcaaagatccaggacaagganggcatccccccggaccagcagcgcctcatctttgctggcaagcagctgggaggacggcangacccttgctgactacaacatccagaaggagtccaccctccacttgtcctccgtctcntggaggatgcagtntttgtcaagacctcactgggcangaccattacgcntgaagtggntcatccgacacatcgacaatgtnaaagcaaagtcanggacaaggagggattcccccggacancagcgtccatctcctggaagcanctggnggacgnangacctgcnacncacatcagaggatcaacctcacctgnctggtctcangagcatcagtnttggaaacctnctgcanacatnncttagtgntcccggacatnacatntaagnaanttagacagggggatcccggcanagctcacttnggaacactg

SEQ ID NO: 81118 - DNA, 689 bp, Triticum aestivum
  unsure (1)..(689): unsure at all n locations
  Clone ID: PAT_TA_81118
gtttgaaaattcattctaatatactgcacatggaattaacttgcacacgagtacacaaatatgatttttcaaaccgttttggttaggcgttagatgtagatgtagttcaaatttgaattacggtcgttaaatggctagaaaattacttatttttttaaaaaagacaaatgacccttagaattttcaaatatttcacattacagttgtagtagtgcacgttagacgtagaaaacaattgaangccgtaagagaaagctatctctcgttcgtcatcaaacatgcattgttccctcctcggaaccacnagccttctantaagttgcttcngtttgttaagggtatgtgtccaaacttcatccaacatgtcaattttttaacacatcatcatggtggaatgacatnctcaaccaaggttcaatgtgttccnganattccaaaaaaattggaattaaatgcaagtnactcaaccatacatatcagtgttcaagtcagagacaatatgtcgaaaatccntcaanttacgcactggaattactccaaacantcacaatatgattgcaacnttaggtngcatncagtnaagtgtcaattattaanggaaaancctaagtntaaagcatgtccaaattcaaattcctaaaananccttacttaaaatggcctaagagnncccttccnaaagatnttnc

SEQ ID NO: 81119 - DNA, 570 bp, Triticum aestivum
  unsure (1)..(570): unsure at all n locations
  Clone ID: PAT_TA_81119
gcgccctgatgatgatnatggagccgcacggcggcgtggtcggcagcgtcgncccggactccttcangccgtacccgcaccgcaacggcgtgctctacancatccantacgtggccttctggtgggcggacngcggcgcggcngangcggacaacgggtggatcaacgggctgtacgggttcatggagccgctggtnagcancaacccganggangcgttcgtgaactaccgcgacctggacatcgggcanaacncngtgggcgacnacggtgtgacgccgttcctacccgtctagcctttccttcntgcaacgagtgaacttccttnaaaaaaacaaantacaactgtaannatntaagctgaaaaatgcggatcacttgtacncaaccaacatgcttgatgtcaattggtntgcttgaaaaanaaaaanaaatctaggggggccngnaccaatnncctataggatctatacccgctcacngcntctttananntctatggaaaacctgngttccaatttaacnctgcaaaaccccttccactggtatacaaaggctacatgcctcaaa

SEQ ID NO: 81120 - DNA, 712 bp, Triticum aestivum
  unsure (1)..(712): unsure at all n locations
  Clone ID: PAT_TA_81120
acctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaactcggcgagatcgtcaccaccatccccaccatcgggttcaatgttgaaactgtgggagtacaagaacatcagcttcactgtcctgggatgtcnggggtcaaggacaagtnaagncactgtgggaggcattacttcaagaacacacanggtctcatccttgtttgtggcaacaacgatagggacctntttttttaancaaggatgactccaacaggatgctgaatgaggatgattactnatctgtccgcttgtgttgcnaaaancaanatctcaaatgccataatgcgcnaaattactganaacttgcctgaancctccagnaaacggtaatcanacanttcanaanggaaggattntaaggctgacngnttcacaaattcagnacccnaatttccaatttagggcaggccccttgggcattaacncggncaggatttttgaggaggcancanccctntnggtttccanaattancccc

SEQ ID NO: 81121 - DNA, 617 bp, Triticum aestivum
  unsure (1)..(617): unsure at all n locations
  Clone ID: PAT_TA_81121
gctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcattctttgttggcgagagcatgcatgatgatggcggcgtggtgttcgcctactacaaggagggactgctgatcaacttcctgtacttgcacatgggctgaaagagncaatgctaatccacgtagcnaaatcancgtcgcagtattttctcgctcaaggntgcagtcactctcaagttgtgtcgtacaacaatgttagtgctaaactttcganaatgtggattcttgangaanctaaattggtgttagtttgc

SEQ ID NO: 81122 - DNA, 481 bp, Triticum aestivum
  unsure (1)..(481): unsure at all n locations
  Clone ID: PAT_TA_81122
gtggacatggcccaggccgacaccgacgtgaacctggcatgcatggccgtgcgcatgatacaatgctgcgagatcgaccggctggtcgacccgcggctcgggtacgggtcgtcggcgagcgagacgaaggggacgatcgacatggtcnccnaaggtggcttcccggtgcctgaagccggagcaggacgtgcggccttcnatcggcaaggtgctggacgtgctcaaacagctcaatcacagcattaaccgagaaggtgacctgcgcctccnactgatggcccgtgtttggtgaaagaaagaccagaacggtnncctgatcccctngatgaaccattggtttaacccaacaacaactttcaattatacaattgataaaccggaaatacacantgtgaaccaaacnccctttggtcccnggtttgtaaaacaccctaaacagagatttaatttaataattaaccaaaatcaaatnanaaaaaaa

SEQ ID NO: 81123 - DNA, 557 bp, Triticum aestivum
  unsure (1)..(557): unsure at all n locations
  Clone ID: PAT_TA_81123
cattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactgggactctcacattgaggacattcaacggtgggaaggctgctgggcctgcatttccgtctcgccctgggacagtgtggcnagagctgaatgggtacatccctggnaagggcaaggactggattctacatgangaactcccanaagaagaagggcaaggtgccacacttaagctgaanactgctgcatttactngttggtttcctaaatttgcgtcaantcattttgcagacatactgaacacatttcngtaaacgtcnaatcctaagttgaactgaaatgttttccggtttggttgtatcaaagctaccanattcataagtttgtccacttcagtaaaaaaaaaaaa

SEQ ID NO: 81124 - DNA, 576 bp, Triticum aestivum
  unsure (1)..(576): unsure at all n locations
  Clone ID: PAT_TA_81124
ccaatcctctcctacgctagacccgtcgccgcccctcctcgccggcccactctcccctggcgatggatccgggcaccaccgccaggccgcacacgggaggcgacgaatcggacctccaccgccacgctcgtgaatggcctgaccaatttgtgcacgaccttcacccatcgggccgcccctcgccggcgtcttcctcagatcgaggacgaccgcaccgccgccacgagctgcagtcccggggagcaaccaactccactccgaagagttgagtggcacccacaccctcacccctgctcgaccttcttcctactctccctccaccatcgtggcttcctccatgaggcatgttcgtcccctcccgcactgcatcgccatgcaagccgcactgcatcactctttgagagttcgctactctgtctacgtgcttactccgtccttgtgatcaaactagaagagacacaatgaaagntacctgctagtatgggagtgggtggtcacttcggtgggctaaggtcctcaataaaaacgcatccgctangtatattcatacaacaangtgcnaatttgcnctcgatg

SEQ ID NO: 81125 - DNA, 164 bp, Triticum aestivum
  Clone ID: PAT_TA_81125
ataaatcatcagtagacataaaaatggtttccggttatcgttttgctgcccctcatgtcaggatgttgaacattggttaaacttagctgtgagttcttggcctcgtttgaacttcagaactgaagtgaaccttgcaattcgtgtgcctgttcaaaaaaaaaaaa

SEQ ID NO: 81126 - DNA, 203 bp, Triticum aestivum
  unsure (1)..(203): unsure at all n locations
  Clone ID: PAT_TA_81126
nggtccccgtctccggagggtgaagaggaggagagctcgccagccagccagccctgctcagaagctctcagggctctgcaaacgtgcggagaaattcggaggaattcaaatagttggaaatttatacaccatgtgaactgaactgaactgaactgatcgatgccgccaatagttaaaaatttacatgtatcaaaaaaaaaaaa

SEQ ID NO: 81127 - DNA, 605 bp, Triticum aestivum
  unsure (1)..(605): unsure at all n locations
  Clone ID: PAT_TA_81127
cagcgctcccccctcctcaacaacctcccggcgcatctccgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgggagatccgcaagtaccaagaagagcaccgagctgctcatccgcaagctacccttccagcgcctgggtgagggagtcgcccaggacttcaagaccgacctccgcttccatcctccgccgtctccgccctgcaagaggccgccgatcctactcgtggggtcttcgangacacaaactctgcgccatccacgccaacgcgtcacatcatgcccaaaggacatccaactcgcccgccgcatccgtggagagaaggctaaactctgtgcgtgtcgtcgtantcgtcgtcttaccagatgtgtcagcggtgaaanttgcgtgttgtatgtcgttctgcatgggggatgtatgtnctatcgatgtcactcttgtgtatagtactaatgaaattttgtaccgttcaaaaaaaaaaaa

SEQ ID NO: 81128 - DNA, 466 bp, Triticum aestivum
  unsure (1)..(466): unsure at all n locations
  Clone ID: PAT_TA_81128
catagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagttncatcatcgttcatgcatgcaccgtgccgtgcgtgcatcatcgttcgtatcgatctactactaccataccatgttaccgcaacctgattcaagggctttattacgcacctgactgcatcaacatcangtgccatgccatgattgtaaacangcccctaaataaaactcccttgatt

SEQ ID NO: 81129 - DNA, 699 bp, Triticum aestivum
  unsure (1)..(699): unsure at all n locations
  Clone ID: PAT_TA_81129
cggccatcgactctcagtgcaccagatcgttggcggcggcaaaggtaaccactactcttctacccccagttatctcctcccgttttctgctgagttcggggtaaatcgctcttacactacagctgtgtgattgcaaacgcgaattggatgttgtgaggcggatggatgattggccagattgtcactgggctttccgatggtctctctcgattggatcatgtgtatttgcgggagtaatggcagggttgagtaaaggtggttgaccttttggctttcatttccgtaggttaagtagaagaagcgtgcgtgagtgtggccaaggctgggtgtangctgtagactgtagttcaaattgtgtactgtggtttcaagagagcgcgtgctaagatgtgagtgtacacaggtaactgagncatgccattaagttttgctctgaatctagctgatgcntatcaactcaatcaccattganatacatgtgantcataactcaaacaaacatggcatgttggcactgtcatactgaacatacctaggtatatatacgcataagtatattaantctttcgcactgttngtagacataccaataggacannatagatacaccntaaacagcgacnatantcacaaccaaacggtccagtaacattcnactataattgaccattngatattcgaaanattcctatnnngctt

SEQ ID NO: 81130 - DNA, 599 bp, Triticum aestivum
  unsure (1)..(599): unsure at all n locations
  Clone ID: PAT_TA_81130
gcaaggccttccgtacaggattttattggccgaccgcccgggcagatgctcaggacttagtccaacgatgcgtcggttgctagctctttgctaatcagccacatgccacccaccgccctcaaaactatacccatcacttggccgttcgcggtctggggccttgacatggttgggccccttaaagggggaacccacaagcacaaatacttattggtcatggtggataaattcaccaaatgggatagaggccaaccggttaaaacggcagaatccggacctgtgatagacttcatatccggggtagtacaccgatttggcncccccacagcatcatcactgataacccacgaattcacggccgatgaggtgaaatctgggtgcaaaaacatgggcatcaactcgactaccctcaatctacaacctcaaactaatggcaagtggaacnacaatggtctaatcatgagcggatcaaaccagatagtgtggtcctcatgggatcaacaccactgggtaaggactcactccgtntcggggctgcgacangcaaacgacancgnttcaacatttttaggaacggctagcattttcctganaaatca

SEQ ID NO: 81131 - DNA, 493 bp, Triticum aestivum
  unsure (1)..(493): unsure at all n locations
  Clone ID: PAT_TA_81131
ggccgttcggcgagaacatcttctggggttccgggcagtcgtggacggccgccgacgcggtgaagctgtgggtggacgagaagcagaactaccatcttgacagcaacacctgcgacgccggcaaggtgtgcgggcactacacgcaggtggtgtggcgcaagtcgacccgcatcggctgcgcgcgcgtggtctgcacggggaaccggggcgtcttcatcacctgcaactacaacccccgggcaacttcnaacggcgaccgcccgttcgcgttcctcacccttggacgcccgaacctaatactnccgattgatgtgntcatacatgcatactacgtgcgtgtgtttannttgttggtttgaatatttatactctacaaagttactacgtacgtaaataacacacattccggcctgcatgtaccatgcggcctgttggagcgtgtaaattatcaaacatctttactttgttttgttgttcaaaacttggncctanc

SEQ ID NO: 81132 - DNA, 369 bp, Triticum aestivum
  Clone ID: PAT_TA_81132
agaaggacacctccgtgtactcgggctgcaaggattacggtagtgcgtccgtgtgctccgccaagatgttccccctgtgccctccctcgtacggctactgcaacttcaccaacacgaactaatgggcgcggcatgcaccacgcacgaggacaaggaaaagggagcatcagcatcaacgagatcccttctctgcacaaccgccaccaccaccacgttgcacacatcacgagtggcaccaccggacgggctgaacctgggtgtaaaacatcgatcgcgtgccttgtgttgtaacgcgcatttccggcagaaccgtcgcaaaaccattgtgacttgagtgtcccctttccttccgctgggaaaaaaaaaaaa

SEQ ID NO: 81133 - DNA, 642 bp, Triticum aestivum
  unsure (1)..(642): unsure at all n locations
  Clone ID: PAT_TA_81133
ggtaaaagaagtgtgctatggcatctctacccctgaagaatatctagcttcatttggtgctcactacatgcatgcactgaatagtccttttcaatgtttccttggtcttaagtgcaaggcaaaatatgcccctggatttttcgcggaatgggtaatttagttaccatacttgcttgataaatttgtataaaacatantcaatttagatgaccttactgttttggtatgatactttgcggctttcagctggttcctctgcttaatttgcacatattttttttaaccagacttcagttaacaccaatatccccgttangagggtgcttaacccaagatgggcagtactactgattncggacacacttaaaccacgacatccagaacaaattaggatggaacttnancncaggcttggnaagttnatgatgtacaactttaacgnaatcaaaatccggtcagttgctgtcctgtgaataaagtggatcaatgatagtaacccagctcaccatcaggtcacatagtgtcctttaaccatgggatttgcgcaaattaacacccggtcataaatgggtataaccgnatgnggttntaaagnagttttatanccaggncatttnaaattnanagnccatgttntcgccc

SEQ ID NO: 81134 - DNA, 675 bp, Triticum aestivum
  unsure (1)..(675): unsure at all n locations
  Clone ID: PAT_TA_81134
gcgaagagctgcttcaacgaggtagtttaattgaggctttcgacatatcatatacgatgatggagtacgaggaaagtgacgagatggagtggtggggagaagtggatacctgcttcgaactaaacacgccctcagaccccgtgggagagggtggtgtttttaagataattgctccacgtccgcagaaaaacatcagaggcgcggtttgttacgtgagccatcagaagcgtctccgcaagaatgcaagacattctacaatttcatgtcgatttgcgatcaactgttgctcaaaccataccaccgagtgggtctttgacactggggccatttttctgtgacgggtaacttgggcaaccttcagggcatacacctgctccccctgttaacgtcattgtanccaatgggacaaacaatgtctcacacattgtgggtanggtggttggggactnagttctcggtgtaagnacatccaggagcacagattnatccaggtggcactccccgactgggatcacacacacacgacaggtgcctaaacaaggcggatgtcttgcaagcgtcgcgnaanaaacnanctggctccgcgaaacaacggcaaaattttccnccgtgccagcangnccanggggacnacatattncgcacacgtggaaaactngnacatccgcngaaaac

SEQ ID NO: 81135 - DNA, 697 bp, Triticum aestivum
  unsure (1)..(697): unsure at all n locations
  Clone ID: PAT_TA_81135
cctcgatctgttcncaacctcccctccgtccgtcgcagctccagatttccttccccatggntccgatcaagatcggnatcaatggtttcggncggatcggcangcttgtggccagggttgcgctccagagccccgatgtcgagctcgtcgccgtcaacgaccccttcatcaccaccgantacatgacctacatgttcaagtatgacactgtccatggacagtggaagcaccatgaagttaangtgaaggactccaagacccttctcttcggacagaaggangtanctgtgtttggctgcangaaccctgaggatatcccatgggctgctgctggtgctnagtacgttgntgagtccacggtgttttcactgacaaggaaaagntgcanctcaattaagggtggtgccaaanaaggtcancattncggccccancaaanatgcnccatttttgtccgtggntcattaaaangataaanttngantccaaatngnccaaagcaattgcacanaactgcntgcnctctgctaggtacaataaagtttggnatgttnggttanacaattttagcagncnaaccaaaatntnntggctcaaaganggaagnggaggnncacttantntcagcnatgnccnagtttgaagtnccnnttagagtnngaagctcttcagggattntttntnagtaatnaaacnat

SEQ ID NO: 81136 - DNA, 449 bp, Triticum aestivum
  unsure (1)..(449): unsure at all n locations
  Clone ID: PAT_TA_81136
tggttttgaggctggtatctccaaggatggccagacccgtgagcacgccctccttgctttcactcttggagtgaagcagatgatctgctgctgcaacaagatggacgccaccactcccaagtactcaaaggcccgttacgaggaaattgtcaaggaagtctcatccgtacctgaagaaggttggctacaaccctgagaaggtccctttgttcccatctctgggttttgagggtgacaacatgattngagaggccaccaactttactgggtacaagggcctaccttccttgagtccttgaccaaattaatgacccnagagcctcaaacaacccctgctctccccttcaagattttaaaaattgggggcattnggactgttcctgtttgaccctttagacgggttcancaacctgtaggttttactttggcccaatggtctgacaactgag

SEQ ID NO: 81137 - DNA, 190 bp, Triticum aestivum
  unsure (1)..(190): unsure at all n locations
  Clone ID: PAT_TA_81137
tcgagtttttttttttttttttttttttttttttttttttttttttttttttaatagtataannatatattcatccataaaaanngcttanacaataacacaacntattacctgaatcatannggtacatananacanccggtcnaaacaacagntggcctcaaatcnggcnggcatggttaattacaga

SEQ ID NO: 81138 - DNA, 737 bp, Triticum aestivum
  unsure (1)..(737): unsure at all n locations
  Clone ID: PAT_TA_81138
gaaatatgtgccctccggctctccgatgcataagtttgttaggcagtacatgcggttgcagtttaatcgtcaatcagatgagagttatgaagagaagaaaactaaaatcgtaagtgcagcttcattgagaaagaaacggtagagacatgagaagtggagctaggtggttttcctagtaaaaatgaccggtaatggttcagagtttgggtgagaatgcgggccttttgagcacataggcatggtgtcttgtcatatacttcaggtgatggattccttgggcatgacaaaggtgtcggataagcacattgtgagaaggcggaccaacgatggtccgagacatactgccagagcacttgcatcactaccattgcattagcttggtgccaccccctgactttcgtcataatccgatgtattgcaagcattagattgntccgattggggagatccaatgtggaacttaacactgatgggactcatcaataaactatgaagngatggctcnttcgaccaagcgaggaatgggctgggacaggaggatctgtcagtggcaagaacangcatgtcatgaaaagaaccaagntgcagataatagtttcgccggganacaanctttgttgctggantcacaanaaaantcaggagccncaaccagagcagcactacaggtggtaataatccgtcacgaattagccacaaaatnnccaaagaattccantagaacaatccaattggtn

SEQ ID NO: 81139 - DNA, 701 bp, Triticum aestivum
  unsure (1)..(701): unsure at all n locations
  Clone ID: PAT_TA_81139
ttaaacagaagggaggtaaacatatgctcgcgcgcttttgtgtccgtgtttcagtgtgtttgtaagggtcaactactttgtactgattcatgatatgaataaaaaattaagtatgatgtaaaaaaacagaagggaggtaaacatacgctcgcgcgcattggtcggcccacagaaggaggcgagcgcttggctctgttcctggtttgctgctcggggttcacctgtcccaggttgaccagcctcaaaaaaaaacctgtccctgttgactgggccgctgttgaccggttgaccatccgacctttcaaaggaaaaaatatttccaaataaatctgaaaaaaaaacaatgaatcaaaaaaattcatgattcaaataatccacgtctccaaaatatgtaacgggattcaaagaaaatgttggntttgaaaaatcatagcctgaaaaatcaatggatttaaaatatgtccacgggttcaaaaagaccaaggattaattttaagatctttttcaaattcaaaagaggttangtatttgaaaacaagtaaaaattcaatgttcacggcntaaaaagatcagatttaaaaaatcagaatttgaaatgtcccggttcaaagttcnanttaganttgtttaaggttagaaanttaaatccatttaaaatcngatttaattnattanantcattaanataaaccaacataaaa

SEQ ID NO: 81140 - DNA, 575 bp, Triticum aestivum
  unsure (1)..(575): unsure at all n locations
  Clone ID: PAT_TA_81140
ggtgcccactgcaatgtactccctctgttccaaatgcttgtctcagctctcagatttgtgaggtaatgccatggaaaacaaaatcggtctcacgggaacactaagggaaatacgaagcgcgcgcacatcgtactcactccatgttcacgtttggaaaaatactggcatggcatgctccgtcagagtctgaccaacaggaaacagccatgttccacttgcatctgattgcacgcaaagtactctgattacagcaagtactctgactgggtgtgtgtgtgtgtgtgtgtgatcgagctgcgtatcgatcgcgagcttctgacacagagacaattgaagatgtgatggatgtatctgtgacatgcaacctgcagaagacaagattcctagctacgtacttagctagacaggcaccaaatcaggtcaagactctgcattattagctggggaattttgacagttgaaancacttatntccctaactgtgcatgcaanggccatctatgatcncaggggggtcataggataggatccctgggtattaggncccttnaaaaccaaacccggccaatttcatt

SEQ ID NO: 81141 - DNA, 473 bp, Triticum aestivum
  unsure (1)..(473): unsure at all n locations
  Clone ID: PAT_TA_81141
tctcggcaagggcggcgccaagcgccaccggaaggtgctccgcgacaacatccagggcatcaccaagccggccatccgtcgtctcgctcggaggggcggcgtgaagcgcatctcggggctcatctacgaggagacccgcggagtgctcaagatcttcctggagaacgtcatccgcgacgccgtcacctacaccgagcacgcccgccgcaagaccgtcaccgccatggacgtcgtctacgcgctcaagcgccaagggcgaacctctacgcttcggcggtaagctgcgcccgctgtcatntccgttcatctatctgcnactgcgttctggtgcaatcnttctttctaagcttcttcttctttctgtcanccgccgttattaatggtgcatgtttgaatcataattctcaaatgctggtgtcaacggtccgtatantccctgtggaagcatggtataatcatggatgttggtctct

SEQ ID NO: 81142 - DNA, 529 bp, Triticum aestivum
  unsure (1)..(529): unsure at all n locations
  Clone ID: PAT_TA_81142
gcaacttcttcggctgcgatctccggcatggcagcgacttgttcgtcaacaaccactggttcgggagcggcctcttgtggtatgaccggcgtcacttccctgggcacaaccgtcctcgtgcctggctccggtgttcccttggagtggttgcgctgcacccagcggttgccagtttggtggcgtcggcacacccagctgttgccgtgatgacgacggcggaagccaccaccagggccggagcggcgtccggggcacccagcggttgcggcggcggaggctacaattcctgtccaaggcggcatggcggcgagtgccaaacgccccggcgatggtaagcacaatgccgaattacaaacctggggcgatggcttcttgcgacaaccttgcaaaagcaaatgctattcccgcaaattgcatcttctcaactgtttctcgtactttccnatcctcctaactctcngttcaaaatanttaatgatgtacgtcaacctatatacatgtaacagctgtaactcgtaaaaaaaaaaaa

SEQ ID NO: 81143 - DNA, 325 bp, Triticum aestivum
  unsure (1)..(325): unsure at all n locations
  Clone ID: PAT_TA_81143
agagagggagattgatgacacgatggctcggggaaataaggcgattgattactggatggatggacggatggattgttaccgcgagagggggtcctgggattccaggagggtattgtgattccgatgatgatgattgctgctgctgctgctgctgctgatttgtaaattcttgatgctactacttgtataagtaatgctgctctgctcctctcctgtgttccttgaaatgttcctcctcctcctgaaacaagacggggggattcctgtgcctgtctgtcccctgcngattggattggattggaattggattatgcaaaaggggggg

SEQ ID NO: 81144 - DNA, 387 bp, Triticum aestivum
  unsure (1)..(387): unsure at all n locations
  Clone ID: PAT_TA_81144
ctactttgcacttctctaggtgaacctcggttggagggggcatcatagcttangattcccttcatgcctacacgagggggggcttctagctacttcgcagtttgctaggtgaaccacggttggggggcatccattcatagcttaggattcccttcatgctgacacgaggggggctgctagcttctttgcactttgctaggtgaaccgagttttgctnnggggngcatgcattcatancttaagattcccttcngngctgacatacgggngggctgctanntactttgcantttgctaggttaaccatggatgagggggatccantcannacttacgttcccttttgggnnacantgatcccttaaagggcttnnggncacccaagtg

SEQ ID NO: 81145 - DNA, 674 bp, Triticum aestivum
  unsure (1)..(674): unsure at all n locations
  Clone ID: PAT_TA_81145
gctcatttttgtgagtccgggaaaattgtctccatgcgcaaatccttttccctaaccctctctttccttttcttctcttttattgttttctgctaagaaaataaaggggaagagagagaagagggccgcttccccgcagcccatttgacccaaggctaagccggcccaaggccagccacgccgccctctaaccctagcccgagggaaccccatctcccctttctctccgatnccttcctccctccccgtngcgccgccaagagatccccgaccccatctcctcgggggagcnatctctctcctctngttccctctgcccgncggcngcgcacacacacaccgnncgccaaggttccnattcgcgattccctcctnagntcnctctcctttnctcggtctctctnaacccggaacgcccaaaccgaanccaatttgccgctcctcgtcannacgccccgngggcaacccgcctgcgggttcccnagaacaaaagtggngccaacgcaccncgcgttggnacacaagagggaaccgtcgcnanccccctggttctcgcccgctcaaccgcananggatccctcaacccggcggccaaggtcctnccancccagaaggcnccnaggggcgaaaattccaagngggttnccccangggttttaagnngngaaccggcn

SEQ ID NO: 81146 - DNA, 467 bp, Triticum aestivum
  unsure (1)..(467): unsure at all n locations
  Clone ID: PAT_TA_81146
ccttctcctccgtctcgcccgcgtgttggggtaggagccatggcggaccagctcaccgacgaccagatcgccgagttcaaggaggccttcagcctcttcgacaaggacggagacggctgcatcaccaccaaggagcttgggaactgtgatgcgctcgctggggcagaaccccactgaggcagagcttcaaggatatgatcaatgaagtgggtgctgatggcaatgggaacgattgacttcctgantcctccaacctggatggcgccttaagatgaaagacactgattccnaaggangagtttaaggagtttccgcctgtttngacaaaggaccaaaaggttcanccccnggaactgatcccgcnagttnatgacaaccttgggggagaactgacanaccagagtggatnaatatccgttnagctgagtcnatgggacgncanttaattcnaanatttntnaagngat

SEQ ID NO: 81147 - DNA, 671 bp, Triticum aestivum
  unsure (1)..(671): unsure at all n locations
  Clone ID: PAT_TA_81147
tcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactgggaagcacagtgacatcaagctcaaggacgacaagactctgctctttgggcgaagaancantaccgtcttcnggcgtccaggaaccctgaggagatcccgtngggttgaggctggtgcccgatactttgtggganccaccgggtgtcctcaactggacaaggacaagncgctgctcacttntaagggtggtgccaagaagtggcatctctgccccaaancaaaatccctaagtttgtggtngtgnccaacgaggacaanaacctcaagacttaacatgnctcaaatgctaantgcacaataacgnctgccccctaactaaatcattaagacaatccggtatatgagggttganacacnttaatcnacacgcacacaaanacntgatgcctcacaaggacggaagtggaggccaacttaacatccacacnnggcgcaagtttgaaggntcnngtaagaanttcggntttcggtcccggggnanntttccgtaccaggggc

SEQ ID NO: 81148 - DNA, 380 bp, Triticum aestivum
  unsure (1)..(380): unsure at all n locations
  Clone ID: PAT_TA_81148
gcgatacggaggcaggccccacgcggcggtccacggcggtcgcgccacgatcgccaaagtgacggacggtgcgagctaggcggctggctggtcgatcagacgattcagagtcttggtcaaaactgtctcactctcacgatcttgactgcttcttatatagatncaatcatactactgggtactcgtattttggctgaanttccgaatccnaatccggtgatactcctaataacaactgngacgatgaatggaggatacgttngacccgatgtggatcatcctattccctttaatataccgctggtactaaccttttgtnnatatatacactttagcacnanaggatgaaatacatnaccnaaattgnaccccgggaaaaa

SEQ ID NO: 81149 - DNA, 349 bp, Triticum aestivum
  unsure (1)..(349): unsure at all n locations
  Clone ID: PAT_TA_81149
ctggacaccaatgccaaagngaatgtaccaattggcgacnataangangctgangaaaatggggacagggatgtanacaanccaaaaggaaaagttgcagtttctggcattcagtcaagtggttcaagcggtacganagatgcantncacangaagtcacattctgatgcaagtggttcttcatcangncaatctgcggctgcnccacccgctgcntctttnggatcanctancctgaaaccgagncnatcnggtcnaacctctgangaagtcagccntcantctaccgattcgggtttcgcagtccatntgtantcccgacnagngagccagcagcacatgtcaatgc

SEQ ID NO: 81150 - DNA, 694 bp, Triticum aestivum
  unsure (1)..(694): unsure at all n locations
  Clone ID: PAT_TA_81150
gctcctnagaaacttagtnggattcccccggggcttgcaaggctccgccgcaagcgggaggaaggaaaggtcttcccgccctgctccaacgttgctgctccaagtgaagaaaacccaccaagcggccaagccccgtcaaagctccctccaactggctaactaacccaagaaataaccggtgggtgggtaatcaatgaaatnggnaattngggtncaaccaattggctcaaaggggnatggttttcggtacggggnaattgccatggcgccanagggctgtttaatgcctgtgaatgggtccccngcaccattcaagcatganactgttgtccggtaaggctgctgcatcnatgactccaaatgggacaatgctgccgaatgacaattgntggnaaccctttccnaaggccttccnaagattgcatcaacccacttacgggaancgacatccagnaatngccanttttaccccngaaaatgntgaaaaaannccccccnttgaggaacaaggattggggggnaaccctttaaccnanaactttgcttnattgggggttaantgggccgaaacgnttttnaccccngnggggggggganaaattcccccaaaatttnttgggaaattttnnccccttncaaattttttntaatacccccnatnttggnccttttcccggaaatctcctnnatgggg

SEQ ID NO: 81151 - DNA, 488 bp, Triticum aestivum
  unsure (1)..(488): unsure at all n locations
  Clone ID: PAT_TA_81151
gtccactccaaaccctagcctcctcctcctctcgccgccgccgccgccgccatgtcagggaggaagaagacccgcgagcccaaggaggagaacgtgacgctcgggcccgccgtccgcgaaggggagcacgtcttcggcgtcgcgcaatcttcgcctccttcaacgacaccttcatccatgtcacggatctgtcccgggaaggaanacgctcgtccgcatcaaccggtggcatgaangtcaaaantgattcgtgatgaatcatcccccttaatgcaactatgcntggcatcccaangatgttgcctgtnaaatgttanggactttggnattacggtccggcanattaacncccgngcaacnggggggnaanaagaaaaanccaagtcctgggggccaaaactgccctaaaacctggcanttttgggaataaaaattggcccatnnggatttacccgngcccaaatgaaanaccnccggaanggggaaaa

SEQ ID NO: 81152 - DNA, 560 bp, Triticum aestivum
  unsure (1)..(560): unsure at all n locations
  Clone ID: PAT_TA_81152
tttttttttttttgcagaaaaatcagtattacgcccaactcagaaacttcgcagtggttgcatccgaaaatccctaagttgctaattaccacagtacagcagtgccgttgcttatggaagtcgtaacaagctagcccgttctaagggtccaataaagtctanattaacctacaagaaaaagtgcacaccggatgctcaacagttcnagcaaactgggaaaggaaagcctgcctgntccccaaggcatacccatgancnttcaaacaatacgggcggggtgaatacaaatgccgaataaanccncaaanaagttctgnatgngcccctttggaatgatgaanggatgcccccaaaaaantaaactaaccgtcccanccttggatctccgncctccngaccttaaaattccttggatgnagggaaaataaaaaaaaccggngggnaggatttcgcatnccaaggtaannccaactncaactcncaaatntggaaaactaacnaaatngacttgcttncgatgcccccaccccgaantctggaaaaaaaccgtctctgtcaaa

SEQ ID NO: 81153 - DNA, 595 bp, Triticum aestivum
  unsure (1)..(595): unsure at all n locations
  Clone ID: PAT_TA_81153
gggacancaacgtggccaggtttgcncaggactgggcggcgcaacgcnccggngattgccggctccagcactccggcgggccgttcggcnanaacatcttctggggttccgggcagtcttggacggccgccgactcngtgaagctgtgggtggacgaaaancaganctancatcttgacagcatcacntgcgacgccggnaangtgtgcggncactacacgcatgtgagtgtggcgcaagtcgacccgcatcggctgcgcncgcgtggtctgcgccgggaaccggggcgtcttcatcacctgcaactacaacccccgggcaacttcaacngtgagcncccgttcgngttcctcanccntgncgccgaagccaagtagtacgtgcgtgtgaatgtgatcatacatgcatacntacgtgcattgtntagttgtgtatggttgaatattaaacttccacatctggtacntncgtacgttnataacancattccnggcacatgtaaccatgcaggtctgtncaccgtgtaaatgtaancntatagttcacntccatcaannntcttaaaaaaanaggggggcccggtancaaatcgccn

SEQ ID NO: 81154 - DNA, 595 bp, Triticum aestivum
  unsure (1)..(595): unsure at all n locations
  Clone ID: PAT_TA_81154
cgccacagttggcccctcacatctccttcattggattaccattcaaggtcggtcggccgatcagtagcttaatttgcgtactattggaactggtatcctatagcttaaatgtttgatgcggatctcaatgtgtctgtctagttgatcctttttccagtgttccggctccagagcaactgggtggcgggagcactgtcaggaaggatcgagctcccgtcaccggaggagatgatgttggatgtcatggcattttactccgacatggaagcccgcggatggcccaaaagattcacacataacctaggagtgggaagcatggacgtttgagtatcangactgggttggcggagcagtgcgggctggagaagatggaaacgagtgngagganggtgatatacgttgcggcgagagcgaaggtgttgggtccggccgggagaactaccgtgacgaatgggacgacgaccaactggtgggccaagcacacatcaactcatcgacggctacttaagggttagctccgtcggctctgtcccttcggggacatgcataaaagattagatgaactgtcgagaatactanaactaaagaaagggtt

SEQ ID NO: 81155 - DNA, 451 bp, Triticum aestivum
  unsure (1)..(451): unsure at all n locations
  Clone ID: PAT_TA_81155
ctcaacatcgtccagctcaacctccccatcaacctcagcgtcaatcgggatctgcggccntcagccncctccgnagtatcannggnaacccagaagtcanggtcaacaacgatggggagggcagcgggagtgcttgagaaccatgangagnggcaggcggctangccgagcatggnctcaaancntatgtgcaggacaagacncccgagatcatggccaggaatcaacaaggttcntcaccaggcccgaanntgaagcactttnncctgtcaagtgngntcnctattagtaantgttggnggtcaanttgnaagaccttatttcaancattcagtaatgntggtcncgtcataaantcagaagggtgtcatcaaagtgcctcntattgaanagaancangntgaangtttgaanggctngcnanaaaanaaggaaaaanggcttncagtcg

SEQ ID NO: 81156 - DNA, 559 bp, Triticum aestivum
  unsure (1)..(559): unsure at all n locations
  Clone ID: PAT_TA_81156
caccaacgacaagggcaggctgagcaaggacgacattgacaanatggtccagcgacncaaanaacnacaagtctgaggacgatgaccacaagaacaaggttgacnccaagaactccctggagaactacgcctacaacatgangaacaccatccangacgacaagatcgcctccaagctgcncgctgacgacaagaacacnatcgatngacgcngtcgacncngcgatccactggnttgacgccaaccagctttgtgncggtgacgaagttcgaggacaatatnatntgatctgnanggcctctgcaaccncatcanctccaanatgtncnacggngctggtgctgacatgccggnangcatggaccaggactcaccgnctgccagcagangtgctggcccnaaaatnnacgaggtccactaagttagtcnctttcatatgcgccatntggattcactcctggggggncaatcatatcnccngggccggaaagttttgncgnaacttngggctggtagcacatttcctaacaatgccnaggngcangtnctggcccattg

SEQ ID NO: 81157 - DNA, 332 bp, Triticum aestivum
  unsure (1)..(332): unsure at all n locations
  Clone ID: PAT_TA_81157
ctcgggggtcgacgtctgcgacgacgcccacccccagtgccccaagggctgctcggcctgccgcgtggtgacgcccagccctcacaagacgttccggtgcgccgacatgaagagcaccgtcgacggcacctgcggcgggccatgcaaaaagcactgatccgttcanggctttcangctcagacgangtgtgccgcctaaaataaactcaagatgaagatgagaatcatgggtgcctaatgcttgtgtgtggtccctgctataacggccaacaatatgttntaaatggtancctccnttccttgggccatgtggtttcccccccccaaaaaag

SEQ ID NO: 81158 - DNA, 593 bp, Triticum aestivum
  unsure (1)..(593): unsure at all n locations
  Clone ID: PAT_TA_81158
ggctggcaaggaaatttcggcaacgaaggggggattccaatttatcaaactcaacttttgcttctcggcccaaaccgctaactgggctctggcgccggcgacacaaggattccaatcaaagattctggggattctgaagtcaaaagcaacaatcgtgcaaaggaccttaaggcccgaaggtcccctggtcctccaacgaaagcaagattgctcctaactngcaacttgcctttaaactggaaccccgggatggnagcactccccnaaagcctgggtnanaccgaatgggaactatcccgnatctaanaagtntcccgggggttaaanctaccccaancnaaattaaggttacctggttttaaaggggctccngttccggggnaaaacggtgtnggaacctccntttttgnacngcctntaagngtnaanaccnccttgggaattccggctaatttacaaccgtgtcttaaccccaatcaatgatcccangganatgcacctttgtgggtttggntgtnnaaaaatngccccggaaacanggacaanttgccgctttaattnagggatttcaaanatggttcaaaaaaaaaaaa

SEQ ID NO: 81159 - DNA, 458 bp, Triticum aestivum
  unsure (1)..(458): unsure at all n locations
  Clone ID: PAT_TA_81159
gaggacccggcgctgtaccagttccacaagcgcggctgcctcgacctcatctcgctccccaaggacttcaaccacttctcctccgtccacatgtacgacgtcgtcatcaagaacagggaatccttcccgcgtcgtccacgcctaagacggcctcctcccgtcaancaatctccccatntcctcccaacaattcaagctatactcctcctccaacccgtttgacttgattccncatgcagggttggttgtggtaaagtgatccgggggtaananatgatgggttgtgcctgatttggttgggaagtgtatgtggantgggatttnaacnagggaacgtttcngcaaantatntccntgtggggccaatanatgaanagtttcccttgnggggtgaaangtancctnccggggtgtgaaaatcccggttgnggnaataagnnccgntgaaaaaaaaaaaa

SEQ ID NO: 81160 - DNA, 495 bp, Triticum aestivum
  unsure (1)..(495): unsure at all n locations
  Clone ID: PAT_TA_81160
gtctcctcgcctcgccgtctcgccccacgccgccgccgcanagatgccgttcaagaggttcgtcgagatcgggcgcgttgccctggtgaactacggcaaggactacggccgcctcntcgtcatcgtcnacgtcgtcgaccagaaccgggcacttgtggatgctcctgatatggtcaggtgccagatgaacttcaagcgtctttcnctgancganatcaanattgacatcaagcgtatccctaagaacgcaactttgatcaaggccatggangaagcanatgtgaaaaccanatgggagaacanctcatggggtaagaacttgttgtccanaagatannacatccctnaatgacttggacaggtcaaggcatgtnggctaaattaacaaggtggtgctatcangcaatacttgccacctcaagaaggagttctgcttagaanatcnnaatggatgnangttgattttttgtccaattggtcgcccagttcatgttc

SEQ ID NO: 81161 - DNA, 517 bp, Triticum aestivum
  unsure (1)..(517): unsure at all n locations
  Clone ID: PAT_TA_81161
ctcccgtcccgtcccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactgggaagcacagtgacatcaactcaaaggacgacaagactctgctcctttggcgagaaccatttacctcttcggcgtcaggaaccctgaggaatcccgtggggtgaggctggtgccgattactttgtggatcaaccggtgtcttcactgacaaggacaaggccgctgctcacttnaagggtggtgccaagaagnggcatctctgccccaagcaaagatccccaagtttgtggttgggtgtcaacgaggacattcactcagacttaaattgtccaatgc

SEQ ID NO: 81162 - DNA, 681 bp, Triticum aestivum
  unsure (1)..(681): unsure at all n locations
  Clone ID: PAT_TA_81162
ggggcgtcgtggtgaagaagttggtaaatggaggcaacacacgcctacattttgcaacacacgtcttttcagtaagtcggaaggcttgttattacccatgaataaaacgtaatcacctactacaaatatggtatggatgattgaatttttatggtagagaaaaaaatgattgaattttacgcatgtatgctattccttctgattgctttaccatgagtgggacatgctatcggccagctcatgcattaataattgggagtgggcattgaacatatcattaantctccatcttaagagggaaaatgatgactggatgaatgggactggaatgaaggcatttancctccgttcnatttcanttgttgatgcaaatccaaaaatccatcatccgggtatgggattaacacacttctatgagggtgtccatccataaatgtgggtggaagaagacaatgttancccgttaattccaatgtaagcgtgtatccgaacaccattcaaataatttggataaccaattgccncaatgcattggtctgttcatcaaaaacagtcgntccgaactaatgaacgnaacccgcaanaattgcattanttancanttcatggcatgtcatancggaattccnattnccttagcaaaagtgcanaaccnattaaatttcgnntnctttccnaaat

SEQ ID NO: 81163 - DNA, 330 bp, Triticum aestivum
  unsure (1)..(330): unsure at all n locations
  Clone ID: PAT_TA_81163
gagcccaagaggccctcagacaagcccctccgtcttcccctccaggacgtttacaagattggtggcattggaactgtgcctgttggccgtgttgagactggtgtcatcaagcctggtatggttgttacctttggtcccagtggtctgacaactgaggtcaagtctgttgagatgcaccacgagtctctcctgggaggcgcttccctgggtgacaacgtgggcttcnaacgtcaaagaatgttgccgtngaaggatnctgaagcgtgggttttgttgcatccaactcccaaaggatgaccctgccaaaggaggaaccaattcacctcccca

SEQ ID NO: 81164 - DNA, 311 bp, Triticum aestivum
  unsure (1)..(311): unsure at all n locations
  Clone ID: PAT_TA_81164
gtcccacgaaggcacgctccatggcaggctgaacccgggcgggtctcgcacgctgagccgtttcgacaatgtcggtgcagatgtccggctcanggcccggttcgccgatcttgccaatgaaaacgtgnatgccgccgaacgggacccngtacccntactcaagagccggnctcngggcccaagcctgcgtcgtctangtanagcttnccgcgacgactcttaatcatcnngnccacagngtatccctngagtcattcaaagctttcctcaaagaatcngannccatcgtncgataacccaacggggggcgc

SEQ ID NO: 81165 - DNA, 294 bp, Triticum aestivum
  unsure (1)..(294): unsure at all n locations
  Clone ID: PAT_TA_81165
gggacgaccacgtaagtagaatcaacaccctccaccatcattagtagctcgatcgtgttaagcttgatgatgattatggttacgagccgcgaccagcttactaatctcatcgacacaatctgataatttggcagtggatcttctgggtgggcccgttcatcggcgcggcgctggcggccatctaccacgtggtgggtgatccggncatccccttcaaaganccgcgactatccaccanccaacatcccgaatggacttatcgctgtcatctcngccattcattatgttgtggtg

SEQ ID NO: 81166 - DNA, 708 bp, Triticum aestivum
  unsure (1)..(708): unsure at all n locations
  Clone ID: PAT_TA_81166
gaatctctgcccgatcgaatctccagggtgataacagggatggctaccggtagtgatgctggaaagtccgctgaggcagtgttggagtggcctaagcaggacaaaaagaggatgctgcatgctgtttaccgtgtgggagatctcgaccgcacaattaagtgttacacaagaatgctttggggatgaagctgctgaggaaaagagatgtcccccgaaagagaattacaccaatgcctttcccttgggatatgggcctgangatactaatttgcacttngactgacttacaatatggtgtttacaagtacgacatttggagcnggcttttgncattttgccaccccaaatgaggatgtgttcaactgtcctgagacaattnatcancnatggttgtaaatnacccgtgaacctgncctgtcaaggaaggccacgtgattcctttgcacaaacccaatggtacatttngacttaccaaagggnccgaccctaactcccntcaattatnctctgttggngacctgtcggcnacatgtcataaaaggcctggataacctcgagaaaaggtgtcccataagtccatgcanaggcttctagagaaaacccnttcgatncnaactagggncgaaaaaggatganccagtcatgacgnantaanccaaattcgtcaaangngaattaggcgccnnggaaaaacccttntcagggggn

SEQ ID NO: 81167 - DNA, 381 bp, Triticum aestivum
  unsure (1)..(381): unsure at all n locations
  Clone ID: PAT_TA_81167
tggtcgtcctcggcgtggcgcctgagaacaaggcgggacagttcgaggtggccgccgggcagtccggcgagggctgcagctgcggcgacaactgcaagtgcaacccctgcaactgttaagctgcatgcactcctacgtagtacgtgtgatgggtgtgaagagtatacttgaataacgagcgtctgattctgatggatccnacaaattgtcctntgtgtgtgggtttaacttgctccctccnccttcaangctctgcccttgctnncccggggtgtaggtgttatcatgtntccccggaatgctnnaacaacccncactagggatggagtggggnanatttaaaatgaaaatttcccnaataacacccccaaaaaaaaaaaa

SEQ ID NO: 81168 - DNA, 413 bp, Triticum aestivum
  unsure (1)..(413): unsure at all n locations
  Clone ID: PAT_TA_81168
ttagggttttaactcgcatccattctcaaggttagcaggagaccggccatggcgccgtcgcagcccaagtcagggctcttcgtgggcatcaacaagggccacgtcgtcaccaagcgcgagctgccgccacgcccgtccgaccggaaggggaaaggtaccaagagggtgctgtttgtccggaacttgattagggaggttgctggtttgctccccaatgagaagcgtatcactgacttcttaaggttgggaaaggacaagcgtgcactccaagncncccaaagaggaacttggtacccacaaagagacaaagaagaagagggaggaaattcaanntcccccaaggaaataggccgggngggnggnggtnctgcggcaaaaaaaatanttgccatttnggngattcatttacccaa

SEQ ID NO: 81169 - DNA, 345 bp, Triticum aestivum
  unsure (1)..(345): unsure at all n locations
  Clone ID: PAT_TA_81169
acccgcaagaccatggccgccatccgcaccgccatctcccacgtccagaacctcatcaccggcgtcaccaagggcttccgctacaagatgcgcttcgtctacgctcacttccccatcaacgcctccatcaccgccgccaaccgcggcatcgagatcaggaacttcctccggagaaaagaaggtaaggaaattgacatgcttgatggtgtgacatcctgcggtctgagaagncaaggacnaatnctcctggatggcaatgacattgactcntcnctcgctcngctgcctgattaaccagaatgccacgtngaagacaaggcatcaggatttcttggccggatctaa

SEQ ID NO: 81170 - DNA, 675 bp, Triticum aestivum
  unsure (1)..(675): unsure at all n locations
  Clone ID: PAT_TA_81170
ctaagttcaagctctgcaaggtcaggtctgtccagttcggccagaagggcatcccctacctgaacacctatgatggccgcaccatccgctacccagacccactcatcaaggccaatgacaccatcaagctcgacctggagaccaacaagattgttgacttcatcaatttgacgtcggcaatgtggtccatggttactgggtgggcgcaacactgggcgtgttgggtgtgattcaaagaacagggaagaagcataaggaacttccgaaccatccactttgaggatgcgcaaggcaccattttccacccttcctggcacttttcacnaccggcaaggacaacctgggttacctcccccaaagncaagggatcnactcaccaccatttnagagcanaggaaccggatccgctcccaactgctgccaagcctattctgagcttttcctttgctataccatttctcaaggtatagactattctggnacgngtttaatttctgatgttgtgattcaacctgtnctgcaatgtantgtttactatagncattcaacaaaaaatctgataaaaatcaacaaccacngnaacctnacccggaatttntgntaaccaananaccctttaactttgcaccnccctgcaaattaacccgnggcnccatttaaagccgnaataanggt

SEQ ID NO: 81171 - DNA, 664 bp, Triticum aestivum
  unsure (1)..(664): unsure at all n locations
  Clone ID: PAT_TA_81171
gcatcgcctcgcgcccgcancccaagaangtaagctcaagaggctgtcctganaagctcaaatngctcccaaagttgctgttgncaanaagggcgatgccaaggcccacagctgccaaggttgccaangctgtnangtcngggtcaatcanaaagaccgcanngaanatccncacnnctgtnacatttcaccgccccaagaccctgtccaatgccagggaccccatttancccaggatcagcacccctgtgcaggaacangttanaccagtaccanatacncanagtacccgcttacactgagtctgcgatgaagaagattgntcgacaacannaccttgtcttcatccgncgacctgaaaggcagacagcaagnatcaagctgccgttaaanagatgtncgacatccaagcnanagaaggtaacaccctgattagcctgatggaaaaagaagcgtacgtgnactgcacaaactatnatctcgtgacatgncaanagtcggacattantccngggacgtctgnatagcnctgttcnnggntctagttaatgagnttgtgntgtactacacggggcatggncattgcacananccggcattnagattagcancantncttggtatcaantagcttngttgcaaaaatgtaattaccttaggatag

SEQ ID NO: 81172 - DNA, 669 bp, Triticum aestivum
  unsure (1)..(669): unsure at all n locations
  Clone ID: PAT_TA_81172
ggcgccttcatctttgtttgtttcttatattggagatgccccgttctaatggtaatagatgatatttctgtggttagatgtcagggcatgttcagaatccttttttgggtgtaaataccatatggggttccttggcaatcgttcaggattttgctattcctgtanttgtttgtctggactctggagaggcatgtacatatgcagattgcctgggattaaagataaccgacattgatagaatactctgtgtatatctgggtaacagtaaagtcacaacaatgttagtcatattatacattcatttcaagaangttaatttatganacgggaccaaagggcctcaagcggttaacaccactcactggaaagtggnatggntttctgaanttaattgtgcaaatttgatgtgcctaaatggtaaccgtgaatgtacttnaatgnnaaattcacangtaaaanantgcatgctttggtgttaaaaaaanacaaaanaaccgaggggggcnggacnatcnccnaangggtcttacgcccacggcctcttaaacncgacggaaaaccgnntacactaacctgacaatccttccagtggnnaaanaagccccatnctcaatgcacnagnatgacccctcggataccggtnggancaggcgacttacnagccccttg

SEQ ID NO: 81173 - DNA, 686 bp, Triticum aestivum
  unsure (1)..(686): unsure at all n locations
  Clone ID: PAT_TA_81173
gctttataacatattgcgacgtagctgaaaagtgacagctagggactcaagatccagctacacctattatggaaggtatgatttattttcataattacttaaatttctatattatctttattggtatagctgtttgttgattattagctttaattgttttaaattttaatgaaacagtaaacaaaacccctatgaaatttaatcatcatagccttttagaaatgtttggaaccattgttccactcttggtattaagtttaatccctatccttcattttcattaattaatatcctttaagatgatttaataatncttcacttacngtaaaattggttggncaccaatggatattgaagntaagnatttccagataataattttaagagctgcacatgatacattaaacaccctacaacttgaatcnccaagaaacttaaattttgatccatatatagtagaagatacgcattaagggaagcattcgtttataaaattgataacagcttgataacaacagccccatatagatataagaactnacagagttacatactgacgtcatcatttgnaaaagancctgccngnaataagcacctntantatacggangntatcaggcagnnaaatttnggaaccggttagcataagtacacaccttaattacntaccacctgtcaagtgtaat

SEQ ID NO: 81174 - DNA, 170 bp, Triticum aestivum
  unsure (1)..(170): unsure at all n locations
  Clone ID: PAT_TA_81174
anttgcantagcaccgaccgatcganctccntcctggntagctataancagcaagaagcancnctcnctcggtgtgctcgngcgacatggncggcaaaaatgcgctggcnctggcgctcatggtcgtccncgtctnggngacggcacaggcggtntncgacatggacaac

SEQ ID NO: 81175 - DNA, 651 bp, Triticum aestivum
  unsure (1)..(651): unsure at all n locations
  Clone ID: PAT_TA_81175
ccgcgccctcgtcgtgtcgccggcgccgtcggccaccgagccgccccctccccaaacatgttgcgagcgcgccgacgtccttgcggcgcaggcctcggccgccgtctctggccccggccgttgccggccgtcggcacagtagcgtctccgccgcagcaacttaattagtatgctcgcgacgtgcatacgacacacacacgtcacacgtatatagccgctctttgtcaatagatcttggncaagcaggtagtacgtactacgtacgtacaaaatgcaactgtacagtgtgcnagatggcgcactcacttgattgtgttgggaacatttcatccatcctggaaatacttcaaaacaacttcctttttcnacgatacttcaaaacaatcctttttttccaaatgggatgctggattncaaacncacagttgggtggactgccnctttnnggacaatatnattaacagctaaacaaagacggaatcaaaantgaaaggaaatacanaactgggtgtgtagtctggatcanaacccctagggaanangntaggaaantacgcncacaaaccaatttagtaccntgaaaaccagtggcnaggccgcaaacttttaggtntttnaaaaanncantacccacccananccctntatttg

SEQ ID NO: 81176 - DNA, 432 bp, Triticum aestivum
  unsure (1)..(432): unsure at all n locations
  Clone ID: PAT_TA_81176
gtattgttcaacctcagttagaaatgtcaacacaatacttcctgggggcagcctttttatccagatgaaaactatctgcaagaatagctgaatacgggctcccgatttctttggacgttgttgttgccatcttgcttcaagatgtcaaatacatttgggacgtgctgctgctgcatgggtccctgtaatacttggggatgcaaacgaantactggggtgcagattccacagatncccatacaggttgcttccgatnccttctcatcctaagcccaattggtgtccnagaacanactttttggtacatcccatgcaacaaacatcccgcaagtgggacaaccagcgtcctgttaacggctatccaancccgttactgcaatgttaaaccctggtaagatagtttaaaataaacccagaggattatgaaaaaaa

SEQ ID NO: 81177 - DNA, 155 bp, Triticum aestivum
  unsure (1)..(155): unsure at all n locations
  Clone ID: PAT_TA_81177
gagagagagaganagananagagaganaaatatagacnaanatacgcattnancccatcncaatgtaagtttgagtgagcatggcaatcatctcttntgacaatccganntccaaaccatacaanaagtggtaattctcacacattacaaatatt

SEQ ID NO: 81178 - DNA, 394 bp, Triticum aestivum
  unsure (1)..(394): unsure at all n locations
  Clone ID: PAT_TA_81178
ctttctactactccagcccagtcaaacttctctcgacctcgaagcatcagccgccgcaccatggcccccaaggcagccgagaagaagccggtggagaagacccccgcgggcaagaagcccaaggcggagaanaaggtgncggngtccatgganggcggcgacagngnngggaaagaagaaggccaagaanagcgtggagacctacaagatctacatcttcaangtgctcaagcatgtgcacccgagacatcggcatctcctcnaaggccatgtccatcatgaactccttcatcaacgacatcttcnagaactcccnngcgatccgccaactcgcgcggtacaacaagaacccacatcacgtcncggggagattcagactccgtnnncctttctc

SEQ ID NO: 81179 - DNA, 632 bp, Triticum aestivum
  unsure (1)..(632): unsure at all n locations
  Clone ID: PAT_TA_81179
cgcatctacaccgacatcatgatgcttgagaaccaaatcccctgggtggtggtcaaaactatcttggacttcatgccagagccctccctctgggagaagttcgtcactgcgatgagggccggcatgacaaaccaaatgtattctaaggaagtccctcccatcgatctagatcctacctataaaccgccgcatctccccgcccttatccggttctacatccgtggggaacaacgacaacatcaaagtcgatcgccccaccgctccgggcggagacaacccatgtcattatccatcagcgtcgccgacttgccagcgtcggtatcacaatcgtacccgagacagaaagtcanggttagtgcacatgacctccaaaaagaaaggtagtgacaagggctctgccggaaaaatttggttcctatccgggatntcgggtgcaaccctgttccnaaacgangcaatgcaactgggccncaanatggggctncnatntgaagaccaaanttcaaggganatgtaaagaganatcggtgttggccaatcactctccatntnctggacnagaggaaattttaccgngaaaaaggtccagggggggnccccnggaggcnntttccggantgaaaaancccgaa

SEQ ID NO: 81180 - DNA, 446 bp, Triticum aestivum
  unsure (1)..(446): unsure at all n locations
  Clone ID: PAT_TA_81180
gatttattgaagtttatacaattttctggaattataaatcatttccaaatttatttaattccagaaatactttactgcatcagcatgacgtcggcatgacgtcagcaagtcaacangggccggtcagggtcaaacctgacgtgtggggtccacacgtcagtgacacaggggctaatcccgcgttgactcgagctttgacccgctacggggcccactgtcagtgtctgttagtctaactaattttaagttaacactaatcctaacccatttaacaagccggccccacctgtcatgggacacacgggaaggtccccttcngggtcaagtggcaaccccaccggcggttgacccggcgangcaccgcngtgggcnacctccggtttgcttccccggcgacaaatggccggccnantcacccccgggactggggtcccccgatcaaggag

SEQ ID NO: 81181 - DNA, 267 bp, Triticum aestivum
  unsure (1)..(267): unsure at all n locations
  Clone ID: PAT_TA_81181
cgcaagcgaagaagaagaanatgtccaagaagtccaaggtcaaccagctcaagtggtatcgcctcaaggccaaaaagaagatgaagtcgcccaaccccgaagtcaggataagatacaagctcgaaaaggccaagaggaaanaagaatggctgattgagaaactcangaagtacgaggccccgagggctccggagccggttcatgaccctgagattctgaccgaagaggagaattctatctgaaacggactggggagaagaaaaagaa

SEQ ID NO: 81182 - DNA, 566 bp, Triticum aestivum
  unsure (1)..(566): unsure at all n locations
  Clone ID: PAT_TA_81182
ccaccagaccgaccgcacagttgaagtgagatctgcgctaagggttcatcagcaaccatgaagagcaccaagctcgcggcgatcctgatcctccaggccgtcctggtcatggggatcctctcacacgtgaacgccgactatttccccaagtgctgcaacaactgcaggtccttctcgggggtcgacgtctgcgacgacgcccaccccaagtgccccaagggctgctcggcctgccgcgtgggtgacccgaccctcacaaacntccggtgcgcccgacatgaaganaccgtcgatggcacctgccggcggncatgcaagaanactgatccnttcaaggttcaagtcaaacaagtgtgccgcctaaaataactcaagatgagatgacatcatggngcctagctgtgtgtgggcctgctatacggcaacatattatacgcntctccntctgggcatgtgtttctcncncaanaaggtggtggngctgtctgtcactatcncgtaataacnattgatgatgtctgtcactaccgcgnaataacaattgatgatggctgaaaaaaaaaaaa

SEQ ID NO: 81183 - DNA, 166 bp, Triticum aestivum
  unsure (1)..(166): unsure at all n locations
  Clone ID: PAT_TA_81183
nncaantccagnctctagnngaatcncccatgacctngtccaantccgatgcgatctcgcccctcctcctccgtcgaccatggactagcaagttcttcttccccttcnaactgtggnatcaacangtgacgntagnacatgtatcgagcancganaatactcatga

SEQ ID NO: 81184 - DNA, 154 bp, Triticum aestivum
  unsure (1)..(154): unsure at all n locations
  Clone ID: PAT_TA_81184
ngaagggntgcctttatgtcgagagggttgcngtatggtgacnnggtaangctcatgtcnacgcacncggatgcttctaatggattttctcatgctgtgaactcanccacctcaantctanaccctgcaaaangtgctcgtcaanggaaanttg

SEQ ID NO: 81185 - DNA, 480 bp, Triticum aestivum
  unsure (1)..(480): unsure at all n locations
  Clone ID: PAT_TA_81185
cttctcttccncctcncgcancgcctcctcgaatccaagagatcaagtcgntgttgntgngacactccccctccagccgccntcatgcagaacgaagtgggtnacatggcngacctctacgtccccaggaagtgctcngacaccaacaggatcatcacnggcaangaccacncctctgtccatntcaacattggtcacattgatgagaatggcctctatgatggccgcatcaccaactttgctctctctgggttccgtccgtgctcaagggngatgctgnatggtccntgganaagntgttgcagnanatgaaaagctnagatcaaccaatctanatgttgctaacanttttaacctnggacttgatcttcccatgtctacntaatcctnggnagnctgagtnggtcaaattggcgccaagnaanctncacttatgcacttggcctgattatgttaacnngttttgattaaccgtgtnaa

SEQ ID NO: 81186 - DNA, 677 bp, Triticum aestivum
  unsure (1)..(677): unsure at all n locations
  Clone ID: PAT_TA_81186
ctgagttgatcataagacgcaatgacaaagccacattttagtttatgcaacgtcgaggatgactttgttttcaagaaggggaggatgatgaggacatggctaccatatttacacccacagcccctgctgctatacctaatgggtcaactactagagcttgcgcatggcagttgaattatcaggtactttcatttcttggtcatgtttctaatgttcatgagaatgtgatgctgcctaacttagatacatttgtattgcttacagttgaagcgcggagcatgggacaagaagaatgaacactgttgcatgatcaactttgtgatgaaggtgtgtgggaaagggaacatgaactgtgcttttggtgggagattcctgtactttgaatcaccatgatgacataaaagaagatggacaaaatatacaagatgggctttcataaattcatcatacttatatggggttcgcaccttattgtggccaagccatataattccaaatacagtcatagaantttagagccatatatagcaaacaccagagngtttagccactncaangaaaaaatcctccatcncaaaataagcctagggacctaacggggttatantagtncccacgacttggatcntggcancaacancctttaccntttnactcaaatcaatcgtgtttaaaaa

SEQ ID NO: 81187 - DNA, 626 bp, Triticum aestivum
  unsure (1)..(626): unsure at all n locations
  Clone ID: PAT_TA_81187
cctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggctccacctccaagactggggaagcatggcacgcaaagtgtcactttgttgccattgacatctttaaatgggaaagaacttngaggatatcgtccttcaacccaacaactgtgactcccccatgttgaccgccaagatancaactgattgacataactggatgatggtatncagccttctaactggagatgggaacacttagggataccgganttccaacngatgagtccngcttggcaaatnaaaacggattgctgatggaagactgnccgtccgtgattccgcaagggtgaaganaatntgcntgtnaaggaacngtggggaantanaactgtctggtgccactgnanacttgaacanncntcggtgttaaaaatntggacagaaacgttgtaaaatttgtcaattgggtttaacangccagg

SEQ ID NO: 81188 - DNA, 478 bp, Triticum aestivum
  unsure (1)..(478): unsure at all n locations
  Clone ID: PAT_TA_81188
gaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggattggagatggcggccgagaacggcggctgcggctgcacccaagtgcaatgcggcaccagctgcggctgctcctgctgcagctgctagattcatcatcgatcatgcatgcacctnccgtgcgtgcatcatcgatngtatcgttctactactaccataccatgttaccgcaactgattcgaaggctttattncncacctgactgcatcacatcaagtgccatccatgatgttaaaagcccctaaataaactcccttgattaaaaaaaaaaaa

SEQ ID NO: 81189 - DNA, 293 bp, Triticum aestivum
  unsure (1)..(293): unsure at all n locations
  Clone ID: PAT_TA_81189
gcaagacgggcggtggtgactcccctcccatctctcccccgggcaatcaaatttgattgnntccaatcntccgctanacangttgntgttaaccnttaaatttncagcacatggntggatgttttctctgttgaangagttgtatgtacattgtgnggctgggtactacatggcgactcngtanataaggggnttaacgggganaaacacaaatttgggggggggggaaaaaanggggggnanaggggcaaaaatttcccnngggngggggntncccccttaaaaaaaaaaaa

SEQ ID NO: 81190 - DNA, 515 bp, Triticum aestivum
  unsure (1)..(515): unsure at all n locations
  Clone ID: PAT_TA_81190
ccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaactgcatgcactcgtacgtacgtacgtgtgatggtgtgagagtatacttgaataacgagcgtctgatctgatggatccaacaaggtgcgtgtgcgtgtgattgcttgctcgctctccgcctagctctgcccatggtgtcctgtgtgtagtgtgtgccattcncctgtattgctcaactactccacnaggatggagtgatgaatattaagaatgaaagattactaaaaaaaaaaaa

SEQ ID NO: 81191 - DNA, 550 bp, Triticum aestivum
  unsure (1)..(550): unsure at all n locations
  Clone ID: PAT_TA_81191
gtggaaggactcttgatgatgagatgacacctaggcagggtttgcaactactgatacagaccaatattttgcaacattggccagatgatattgaactggcgcacttcagtgcattcctcattaacccaaatataaacataaggaaacaagatgtcctccgatcatccattccctagtcacagcccccacgttagggaagagcaagtataaaagatatatgaaaaagnattttttttaccggatgaccaaatagatgggttggataaacatacctccttacaggggtggnaacccaatgttcaaaacccnccccttanagcgatcccgggacatcaaatntnctncgggggggtngggttttgcncaaacattttttggaccctgcactttgccaaatnnccatactcattncaccattagatgtttaaaagngncctccctgnanaagnctcaaggacttccgcaaggatcttacggatanagggcnagttaagagaattatcttggccnaaccaataggantnttcgaggccgcctaagagaattttca

SEQ ID NO: 81192 - DNA, 482 bp, Triticum aestivum
  unsure (1)..(482): unsure at all n locations
  Clone ID: PAT_TA_81192
tccgccgaagcagaaaaagcatcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcagatttcatctgcaccacctctgaacaaagtgcaaggagcatgctgaggcgaanatcccgaagaggactcctccangctcccccacctcaaagcanggatatctgnccaaccagatgggagagagagataaaagagagagagaantgtccatatccacctnatatatcatgttcccncatgactgattgttgacctaacttggncctaatccggtgtgctgtncccaactctttggtgtttcccactactatttatcctcctcctacaacctgttgtgctacaatacttanctgtgtggtttccct

SEQ ID NO: 81193 - DNA, 317 bp, Triticum aestivum
  unsure (1)..(317): unsure at all n locations
  Clone ID: PAT_TA_81193
gaataatgggtgctgctgtttctggaagcaatgtaagaaaatgttggaagttctgcagagtttactgtcctcactggatgctcactggtagttgttgaaatatgtattgtatagggtgttatagcatgagcgtgagttcgtatcctgatccggttaagttaggcttgatctcctctgtacaggctgtagtaaacgtccgagatcaaagcccataacgactgggtccgtaactcctgtaactccctgccttggaactttttataacgtgcatgcacccttgctggatagcatacacttccnaccttaaaaaaaaaaaa

SEQ ID NO: 81194 - DNA, 211 bp, Triticum aestivum
  Clone ID: PAT_TA_81194
ctcgtgccgcttagggtcactcctgtccaggttcagaataatgtacataaggtctgtttgggtgacaaatatagttcttggaagttttgtagtttgacccttgggagtttaatccattaggaccaaacaatggtttcgtcggtaggggtgtcagactgatcactactgtactttgttagactgtttgccaggttagtccttggatgacttg

SEQ ID NO: 81195 - DNA, 162 bp, Triticum aestivum
  unsure (1)..(162): unsure at all n locations
  Clone ID: PAT_TA_81195
gtncttgcttcttnncacacagcttangcctgnacgttcactcacgttcntancgngctcccgatgtcattctgaggccggncanngtgatcatgaggattgngatttggtctcttgggttgcanncttgcgatcaatgtncactggttaagtnctatttcc

SEQ ID NO: 81196 - DNA, 586 bp, Triticum aestivum
  unsure (1)..(586): unsure at all n locations
  Clone ID: PAT_TA_81196
ccacaccttcgcacaaagctccacctcctccccacaccttcgcacaaagctccacctcctccccacaccgtcgaagcacccatggcgcctaaggcggagaagaagccggcgctggagaagaccccggcggggaagaagcccgcggcggagaagagacccgcggccgggaagacggcgtccaaggagggcggcgagaaagaaaggggaagaagaaggccaagaagagcgtggagacgtacaagatctacatcttcaaggtgctcaagcaggtgcaccccggacatcgggcatctcctccaaaggccatgtccatcatgaatccttcatcaaacgacatcttccgagaactcgcccggcgatcccgccaagctggccgctacaacaagaacccaccatcactcaaagggagntcaaactccgtccgcctgtcctccccgggcgantcgccaanagcctctccgaagnacaagnctcacaattcactctccnagntctctcgttcaataactgatggcgcgtctgttgtattacatnggatgtaatcccgtagatgtgngctgttggtganaatangtgtgcgtcgaat

SEQ ID NO: 81197 - DNA, 695 bp, Triticum aestivum
  unsure (1)..(695): unsure at all n locations
  Clone ID: PAT_TA_81197
gttgtggtcttgtggaacaagaacctaatattgttgtttttatgttggnacaaatgttttctcgctgactttaacatgatttagctttgcttgcaagagactttaaaatgattagatagttatcgtcttgtcgcttttgattatatttgttctggtaacggttgaatttacatattcgcaccactttgttgtacttaaaaaaagttcanccctcagactggaagaactacatcctattaatacattcatacgttttctgctatttaatcatgttattgacatactggatttaacactgatgctaatactcacaangtcatatttattaccaatatacagatctgngcttgtcattttgaagtatgtaagtaggattgcataaatgcacacatcaacatctctatcaatcangtcgctaactgttagttccgtgttaaccaatttccttggggtccaacacaatatcatccgggttggtgtttggtgccatctgtaatcacctagcaataaacatgcagtggtcatgccncctgnaacaaatacaaaacnggtnttaaccgcttaacctacggcaanaaaggaccgtcccacaatcnanttantcaaagnccttatngttccccnccttatccaaattaactccggtaangtcanaantccaattgttgncggnattataagggcatttccagagg

SEQ ID NO: 81198 - DNA, 373 bp, Triticum aestivum
  unsure (1)..(373): unsure at all n locations
  Clone ID: PAT_TA_81198
ggtttgcnttgttgaaaaggtttgtcnactcatanangangtttcngtgtnaaagaccattagctacgataagtgctcccattttcatcngangtgggcttgtataatctttacgagagcatctttttctttgcccctaaccgtgtatggntggcatggaagtttcnaccctgtcngaacannttggtcatggcantgcatctgcttgctgatgtgtgcacctccatgacaattattccttctgatcatgtttggntntangggcacnattgcccagcatanaanacnagtgtanatccctacaanacaaagctcaagcctgatggctttacggnaaattattcctcangaggggaaaaaccgnctaantcgc

SEQ ID NO: 81199 - DNA, 667 bp, Triticum aestivum
  unsure (1)..(667): unsure at all n locations
  Clone ID: PAT_TA_81199
gtctcatcttcgctgggaagcagctggaggatggccgtaccctcgctgactacaacatccagaaggagtccaccctccaccttgtcctgcgtctgcgtggtggcatgcagatcttcgtgaagaccctcactggaaagactatcacccttgaggttgagagctctgacaccatcgacaatgtcaaggccaagatccaagacaaggagggcattcccccggaccagcagcgcctgatctttgctgggcaagcagctggaggatggtcgcaccctccgccgactacaacatccaagaaggatccacccttcacctggtgctccgcctccgtggtggcagtaattgcctctcactcngacctgctgctgctgctgtacctgtgtctcctgtgggtgcgcctttgttcaagtgcttccctttgtgtgaatcctactgtgtcnggtttaatggacatcatctgtggttggggcaaacattcaggacatctgaccttaantangataatcaacttgaagtaaaaaaanggggccgtaccaatcgccaaatgatctataccgcccaaggcgtctttaactctacngaaaccgggtnncaactaaccctganaatcccttccactggnatacaaaggcnacgttnctcaaatgcacgatnaanggacccntcggan

SEQ ID NO: 81200 - DNA, 469 bp, Triticum aestivum
  unsure (1)..(469): unsure at all n locations
  Clone ID: PAT_TA_81200
cctcgccgccgaggtcctggagctggccggcaacgcggccaaggacaacaagaagacccgcatcgtgccgcggcacctgctgctggccgtccgcaacgaccaggagctcggcaggctgctcgccggcgtcaccatcgcccacggcggcgttgatccccaacatcaaccccgtgctgctccccaagaatccgccgccgccgcccgagaaggaggcaccaatcgcccaaagaagaagccgcgccaatccccccaagaagaanccgccnccgccaaaggatacctggctactaccccnagacgttcctttcctattccagtcttttggtaactggttcttgtattacgctgnctggattncaactngaatatctgtatgtaatgcctttnacaatntccatnacaagntngatggatgtnccgtgattacttccnggaatggtaaagaaaatnatcttaaccttataaaaaa

SEQ ID NO: 81201 - DNA, 694 bp, Triticum aestivum
  unsure (1)..(694): unsure at all n locations
  Clone ID: PAT_TA_81201
tcgagttttttttttttttttttagaaaaaaggaaaaagaaatttatttcaattccaattgtgtttgaaacagaggaatcattgtatcatggaacacaaatcaccgcaaccagcgtagaaatagtaaaattgtggttcccatctgcgcaggtgtcatagtgcccaaagaattcttgtgccaagggccagcgttggtttactagtcatgattcaccttgcgagactgaaatgcttggcttatcaacttccactccttattgctatcagcattggatcacaacccatggagatttgcaccaacaaaatatgtccaagaagtagaatgggactgagnnagaattcatgccgtccnaagtangcggtaatgtantaaaccaacattgcgtaatgtggcccatagatacaatgaactgttnaatgtactgtagacttcctggaacaatacatagacacaagaatgataaaggcttgttnaaaacccaagatcnatnccgtggtgtggttcccgatgannncggatcacttgcgtccctcanatcacaaaaattggattcctggaggaattgggnaaacaaaatctcnnntagggggcacccttttgcncaaattgnaaggcggcttggaacccggttcaattggaangggnaaccatttcntnaaaggntcttngggcccnttgggaantngaancggc

SEQ ID NO: 81202 - DNA, 663 bp, Triticum aestivum
  unsure (1)..(663): unsure at all n locations
  Clone ID: PAT_TA_81202
ggaaagangaccagcaacatcctccaagcantagtaccctccaagcggcacaaccttcgaagcagagaaagagaaagaagagcggcatcaccctccaagcaaagaaaggaaaagaagcaaggaaagggaaaggagcaatttcgtgcgtccttgcaaaggttgtgttcagcaggataatggaagcagttgggtangccagtaatgtgttaaatttcacacaatcatttccattgttgatgaccgggaagagcatacgatacgagcacaggataagagcaacacagatgtgtgtaaatccaacagttcttaattactgtatatganaggaaaggatgatgcatttttaatancaacatggcanctcctgtgtcaataactatgtggtcaacttgtagatgtgtnaacatgaatgggtcngtgaacatgaattaagantaataatgttatccanaaacacacatggnaagatcatgacatataaaggcatncagtaacaacattantggttatactaattatnatcgcanaccgcgtaaccaacgatatgcatanancaaacanacctgattaaactttcaaaacaggaacttctgataaacttatacgtaaatggaatttagatagaggantattaaaaatntcngccgnaggntgcgnaaaacg

SEQ ID NO: 81203 - DNA, 402 bp, Triticum aestivum
  unsure (1)..(402): unsure at all n locations
  Clone ID: PAT_TA_81203
gcagcccatacagcagcagaacagcagctgctgctcataagctcagcaaggcaccattcatacacctcatgacatccggttgtgagttgttggaggctggaaaattcaccatcaaaggctggagaaggcggtgaattggatatactgaacacagaacttgtatacaatagaacttgtgttactacttactactgtttaatatacccgtcacagtttgagcttgttatgcaatctcactagtcattacttcgtcagtgttttaggcgcattttatgggtccttangtgggcaaaaatgtatgaaaatgtganttgtcaacatcctgttatctttcaagaaaggntcatatgttgccggagaatatggttaatcaacttgtcatcacaccctgtacattctccc

SEQ ID NO: 81204 - DNA, 463 bp, Triticum aestivum
  unsure (1)..(463): unsure at all n locations
  Clone ID: PAT_TA_81204
aacagggtaagcaagtagaaaacggctagctagttattaggtgcgtcaatatatacaacactaccaaacagctccaaagtattcccaatacttcaaaataatgtggtatgtcaaaactgtggtatcttacacctacatgctaaaatgttgtagttttcaatactttggttttttcaaatactttactatcaaaacacagcctaagggaaaccgaccaaacgatactcctcccggacgagagccggcccggcgttccggacgttatatgttgttgagcatacctgattggagnnacccccttggtataatatatacagtattaagacncctcctttttcctttttttccaaaggttaaccgcggngtccccgatcctcntncggtgtcccgttacangggncnatgatntganaggtgatgaccctccaaataantnccaagatttcnccccaaaaaaaaaaaa

SEQ ID NO: 81205 - DNA, 510 bp, Triticum aestivum
  unsure (1)..(510): unsure at all n locations
  Clone ID: PAT_TA_81205
cggccccctttgattttattgcgtgaaattggtgctgaattcgagatcagatgcaatatccttctcgagacccagatttgatcgagcagcacgctttttttttccggcagtttcgcaagattcgcctgccagcaagtgggctcaccaacaacccatttgtaaatgggtgggatagctgggaacatgtatacagccttgctaattcatgtgccctgccagtcctacgttctcttaagaaatgcgatgcactcattttggttgacctgcttggaggggttcctttcaaaatccggancactggctggacaaaatttgtnntgcaatggcttaangactgcatatctccaaagtgaanccctgcattaagtgcaatggaacctttggtnatgcaacgaccaaaggtgcatatcctggnaagatagttgcatttccaagcactctgcatttgtcaattcnactggcaacgcgtactccccaagaagacgtaactcaattgttaaaaaaaaaaaa

SEQ ID NO: 81206 - DNA, 445 bp, Triticum aestivum
  unsure (1)..(445): unsure at all n locations
  Clone ID: PAT_TA_81206
ggcgaacgagcantgctgcccgctcctgngcgggctcgccgacctcgacgccgctgtgtgcctctgcaccgccatcagggccaacattctcggcatcaagctgaacgtgcctatcgacttgaccctcctcctcaaccagtgcggcaagaagtgcccggccaacttcacctgncccatctgatccatccatccatggntgaatattgtacatgcataatccttctactccgtaaccagttgcatgtcanacgcncgcncatactagtttttcccggttacagttcanagtcaagctttggcagggtccctccctcctgcatgcatgcttgataacttgtgatgtnaaagncatggcccccgtaagttaccaaatgcagattncgtatttgtaaaagntatacatacttncacgtanctgggataaaattttgttnnaaganggaaa

SEQ ID NO: 81207 - DNA, 642 bp, Triticum aestivum
  unsure (1)..(642): unsure at all n locations
  Clone ID: PAT_TA_81207
tacacattctttgcaaatttgcaactagatatagcctacgaggttttgtgcgcaatgggcatggctgacaagaggtcggctgcaaggaaggccgggctaatcaccaaggcgctggaccggtgctggaccacaccggcgagaaacagcaagccagtggagggctgcttctcggtgtatgtttggcgccgggaagcagcggttcctggtgcggacagagtgccttgaacaccccgctgttcccgagcgctgttnggaggaggccgaggaagtgtttggggtacgcngatcaaggcccctcgacttccctgcaacgccgagctttgccaaggtgctgcacaatntaaggaggagaacaaattgtggaagaaggagtctccttgccaagggaatccctaccggtgctccgnacaacccgtcttcacaatcgacatccctacatacaattggagatgcnattnatgacncnaattccggttgacatcccatnngataacacacacatatcnggcatgtaatanttcctctctcttttcaatttgtagnaanccggatttaagttgtncaccnatttnacatcgtaanttntcaanccatnaacgtancctngntcatggcncatnccncacagngnccaatattaaa

SEQ ID NO: 81208 - DNA, 678 bp, Triticum aestivum
  unsure (1)..(678): unsure at all n locations
  Clone ID: PAT_TA_81208
atgatccctctactgaatctcgagtgacagtgacaccacaaccaagactggtggtttcgagcagtggtcgcttttcattggagtcacagtcggattttagctcaaatagattcgaattactatcgctggaagaggacggcgatgatttaccgtctgcttctgactcatctgggcaggcatggtggtgataacaatgatgaacgagatagtggtgaaggtgctgttgtccgctccgtcaacatagatttgggaaatttggacaattgggaggttgattgatttgggaggcagcagcagataattatccttggaagatggaagaaantgaaacagangtaagaagaaaagaatatcccaaaaagaaatgctaaagcctngatgccggaccgttaagaaacattcagggatagctttacaagaaatataacaatgacgagtcttgccggggaatcttttgtgtttggatgaaantaagagattttccattattggaaggaacatgactcctagacactcaacttacactaacaggtggtcacngtcaatcttgccnaagtgatcagacaaggaaacgttagtcttcgcanccttgntccgagcaaggcatctttgtgaaacaggtccgtgctnggatcacngcganttntntgggcngtgtcatncattgggaaacanacc

SEQ ID NO: 81209 - DNA, 566 bp, Triticum aestivum
  unsure (1)..(566): unsure at all n locations
  Clone ID: PAT_TA_81209
caccttcccanccaaaacatcaccgcacatctccccggcgaagcagcagcaaccagcggcatccatggcccccaaggcggagaagaagccggtggcggagaaggccgataagacgacggcggcgaanaagaccaaggccgagaagcggccgccggcgtccaaggagggcggcgagaagaangggaagaagaaggccaataagagcgtggagacgtacaagatctacatcttcaaggtgctgaagcangtgcacccggacatcggcatctcctccaatgccatgtccatcatgaactccttcatcaacgacatcttcgagaagctgggccggcgagtcnggcaagctcncccgctacanaagaacccaccatcactccaaggaaatccagacctcntccgctcgtcctccccggcgactcnccaagcagcctctcnnanggaacaaggcctcactanttactccgcctaatatctgctcagtcttctnggcnatgatggaaangtcatnacttgtgaatgtntggngctcttgtngtccggggtcgntnatttnattcantccggtg

SEQ ID NO: 81210 - DNA, 217 bp, Triticum aestivum
  Clone ID: PAT_TA_81210
cagggaactaccgaaccttcctcctctcgctcgtcggccgggaccgctaaggcgctccagtgcatgctcaatcgatcccccacatggatggtggcgccaagactgccagtgatcgatcaataggcattggggcacaataatctgaaaaggagcaaaataagattgtattattcctgtggaatcaacacaattgttctatgttcacaaaaaaaaaaaa

SEQ ID NO: 81211 - DNA, 472 bp, Triticum aestivum
  unsure (1)..(472): unsure at all n locations
  Clone ID: PAT_TA_81211
gaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccaagtgcaagtgcggcaccagctgcggtgctccctgctgcagtgctagntcattgttcatcgtnatgcatgcaccgcgcgtgcacatcgntcatacgtctactactacataccatttaccgctactgatnnagggcttatctatcacctgactgcatcacatcagtgccatccatctgttgtaaacagccccctaaataaanctcctggtttaactaaaaaaaaaaaa

SEQ ID NO: 81212 - DNA, 621 bp, Triticum aestivum
  unsure (1)..(621): unsure at all n locations
  Clone ID: PAT_TA_81212
gcatattaaccaaggtgcataacaggttcaaacatacaaggttcttacaacacaacaggttgtaaaacaaacaccacaaagcaaatgttcaaacagacagataacagataaagccactcgggcagatcatangattgcagcagcatgccttggggaaagcaccangaggcangctctaagtactcatcgccctccgtcaccgtcctcaccctcggtcgaactcagcaccaacttcttccgtatccttctcccaagggcagcaagtnctccacgggctccagagaatctccctcctccatgccctcacccaacgtaccaantggacgaaggaccttggcgtacancaagtcaacttnttggnccatgcgggaaaaactcnnacaacactggggggtttgngatnatgcacananctccggacttgggangncacccccnggacacacaagtggtggtattgatacacactttaanccatggggacaatcaacaaacgggtatgcctggnctgatggnggcanacacgttanatcntggcaaaatncacgtacttaggcacagcatttcttcatgggggggccattgcatnaggggaggcaaggcctntggatccgaaaaaat

SEQ ID NO: 81213 - DNA, 594 bp, Triticum aestivum
  unsure (1)..(594): unsure at all n locations
  Clone ID: PAT_TA_81213
attttgttccgatggttgctgcaacttgcaacgccgaatttggctcactcgctgcatgcatccacgtactctgtcgtactacgtgcactccgtaataatccatccatggaaaacgagacctcaccggctctcttaaccaaccggcacgggcacgtgccttgggagccggagccggctcctctgccgtactgcaccttgccgttggcccactgacgcgtggggccggccttgggagccacagttgggcagggtctcccaactttaaacaacgcgactgggggaaancttgttctcctcaatttccgccgttcgaccccgtgggatcatctctcctctgcctgccgcgaccggtgaaggggaagtatttccnatgccacggttaaatattaggtatggtctccccaaggaaacctcnggacggaaacacctccttttcgancatanttaagnccgtnctctaatccgttatgggacgntaaacaaatcgggtaattcgcaactctcgancggcagtaaattgtctctgctaccaagggaaattgggtcaattctcnnnatcaaatcatacacggccggnccnnaaggccttagaaa

SEQ ID NO: 81214 - DNA, 697 bp, Triticum aestivum
  unsure (1)..(697): unsure at all n locations
  Clone ID: PAT_TA_81214
ccaaggcccatggtggtttctctgtctttgctggtgttggagaacgtacacgtgagggtaatgacttgtacagggaaatgattgagagtggtgtcattaagctcgacgacaagcagagtgagagcaagtgtgctcttgtgtatgggcaaatgaatgagccccctggtgctcgtgctcgtgttggactgactggtttgactgtcgctgagcatttccgtgatgccgaaggacaggatgtgcttctcttcattgataacattttccgtttcactcaggcaaactctgangtgtctgctctgcttggacgtattccatctgctgtggggataccaaccaacccttgctaccgaccctgggaaggctgcaaggagcggattaccaccacaaaaaaggttccaatacatccgtgcaactatttatgtgccantgatgacttgacagtnccggccctgctacactttgcccatcttgatgctacacgtgcttcacnaagattctaactccgtattanctgcgtcatctttggatcanatcaaaagtgtccncattctgggaggtcananacactgctntgggtaaaagtctcaaataaagaantcanatatancatttggaangtnccataggcaaattaaacccctgnagnaattacgtctacacttcatnggatttcaggcccnaaattgctaanggntna

SEQ ID NO: 81215 - DNA, 315 bp, Triticum aestivum
  Clone ID: PAT_TA_81215
ggcaagtggatcctcgcgtaagccttctgccacccctcgctccgttccttgcttcgtttattaatctgctcattatgtgattgtaatttgcgtggtgcgtagttccattcctgctggtttagctagggtcggtggaactcatccgatggattctaaaccacatggatcaaagctgataagttcatatatatagaaaaagggggaaataatttggtgtgttttagattgtctatgtctgtcctaattggaaatttggacacatagtttgcaagtatacagtccacctatattgcaatcgcacttaaaaaaaaaaaa

SEQ ID NO: 81216 - DNA, 417 bp, Triticum aestivum
  unsure (1)..(417): unsure at all n locations
  Clone ID: PAT_TA_81216
tcgagttttttttttttttttttttttttttttttttttgatctaaacgcncttatntttctttacgcaanttgtacgtacatcanacctcncaaaacgaaaatctaacgcanacctttatttgttgaagtggnttggaacggtacaaagatnaataanatgacagcactgagattacatgtccacagaggtaanacngcagtanccgnnagcaagcatntgctcgtatcacctgaanagttgncacgtacttcaatattcttcgggaaganganggcttctgcattncgtaccgtggggtggcnggattaaaggantacacgttggagtgccgtagncaaantctgaangattgccggnngtctttntgncattttcnttttngaanttgaaggaantngaaanggncccagggaa

SEQ ID NO: 81217 - DNA, 603 bp, Triticum aestivum
  unsure (1)..(603): unsure at all n locations
  Clone ID: PAT_TA_81217
accgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtgggtgtcgacgagcccccgaaatgtggcgctgcgccggatatgaaatccaccgtcnacggcacctgcngtgggaccctgcaagaattactgatcgggttcaatgccggcatgatatttccgcctaaaataaaataaaactcaangcgagatgagcagcgtcatcgtgcctangcgtgtgtgtgtggccaacatgcttatacaattatnctctcttcgtcgctgtgtttcccctccaaaggggggccggtaccaatccgcctatntgatcntataccgcgctcacggcctcgttanacgtctgacgggaaacctgcgtaccactaacgctncagaatccccttccactgngtatacaaaggcccacgtt

SEQ ID NO: 81218 - DNA, 494 bp, Triticum aestivum
  unsure (1)..(494): unsure at all n locations
  Clone ID: PAT_TA_81218
cttgtacgaagtcttctttagacccatgtagagtttgacaacgtcccactcgtaagctacggtggggtgtcgagcctcgtcgccaacttcgctataggcaccccatgggcgtcttggcagcttcttaggacgccccaccggcagccgctcccacatccaaatggagaaggcccagacaaagccacccatattggacttgtctcccgtcctctgcgttgcatcgtcaagctgcaaaaaatcaaatgagggcagatataacaaaatgtcatagacatactttccgtaggtaggcaattagatactctcctatcgaacggtatagtaggcgaanagatgcggtcccccaactgtacctgcatccaatcngctaggaagaacagatacgacaatttggnaagttcccggtgcgtctgggaaaacatntccgtganaaaatacacgggtagcctcccgtacaatcaaatctctnacaactcttcgggantcttcggggg

SEQ ID NO: 81219 - DNA, 706 bp, Triticum aestivum
  unsure (1)..(706): unsure at all n locations
  Clone ID: PAT_TA_81219
cagcgatccaaagcctcaacaacagcaaagcagcgctcctcagcttgcggtgaagcaggaatttttcatggaggagaatcagagttcgacacagatgaaagctgcgagccacgacgaactgcagttatttactgaagagaaacctgtcaccctttgtaggtctcagagtcacatgctattcaagtgaacacaaaccaatggcaaacatgtcaaggcatgcaagaagccaagcctgatctctcaaagataaaancatgtatggcgaggaaagatgcatattcccggttcaacctagttgggggttttgaaaactaaaaagaagaancccaaagcggtccngatttcctccgggaattttatgacctccaantacttggatgatgancccgagtgggtccttttgacatgtngatgcaaaccttccgggagtgtaccatgtgtacaancancaaatgctaaaacattagtctccngtgaacctacatcaaccggatccgtgggtcctcgggtaacctgaacgctctcacattgaaacaacanccttctcaagtttngttaggacagacaccttgaatanttgagtcgtgacgtggcatcatacanagctngngtacngcacctgccgtaacganatnaccttganttacagnaatcactggaaccttacgattcactgtaatgganangatttcaaganctccctggc

SEQ ID NO: 81220 - DNA, 683 bp, Triticum aestivum
  unsure (1)..(683): unsure at all n locations
  Clone ID: PAT_TA_81220
ttttgtcatagacatatgtaatagtagcacaacaatagtaataaagtttttttatagttgggacagtcagtttttgtaggtgcagtttcatgcaacatcatttgcacaacagtagttatacggttggcgcatcaggcctgcacacctaaacaacagttacttatttgttcattcacttttcatgtgtttacggcaaccagttaatcctgttttttttgttcttttcctttgtcctccgtatttttttcctgaacaaccctgacatcattaactatgatgggtctttggtgagcctaagggagttggctgattcaatgtgggcctaccaaatgggctatccaaacggtgttgtcnaanctgcacttatccanatcagggaaaccttacctaaggactcnaagaagtcacatgccactcaagggtgctgtaagtngaatgagaacgttgtcctgttcacacacatccgtcccttttttaaatgtgttccnaagaccacnttcaatgcagcacggttcagcangatatcatgcgccgagaaatcaaattgnaagcaattgctnacgtgagaaangcanttttgcggcacaaacttgngtttcactcctctganactctggtttagggantntgcaaccaagnttttgctctttcgntgtaaagtagganccccttnccagggcgnn

SEQ ID NO: 81221 - DNA, 472 bp, Triticum aestivum
  unsure (1)..(472): unsure at all n locations
  Clone ID: PAT_TA_81221
gcgtcaagaagccccaccgcttccgccccggcaccgtcgcgctccgcgagatccgcaagtaccagaagagcacggagctgctcatccgcaagctccccttccagcgcctcgtccgtgagatcgcccaggacttcaagaccgacctccgcttccagtcctccgccgtctccgccctgcaggaggccgccgaggcctacctgggtgggcctcttcgaggacaccaacctctgcgccatccacgccaagcgcgtcaccatcatgcccaaggacatccagctcgcccgccgcatccgtggagagagggcctaggctgcagtctgcaatccatgcgtcgtctgttaaattcctgttaacctgattcgtcggtggaatgtgtgtgttgctaacagtagggtttaagacntgcctgtttgttcttgtcaaggtggatgtggtatgccnaagtgatggnacgtcctgttgccaaaaaaaa

SEQ ID NO: 81222 - DNA, 654 bp, Triticum aestivum
  unsure (1)..(654): unsure at all n locations
  Clone ID: PAT_TA_81222
ctgagattcgtactanccagggaaatcaagtatgaggggtatgcangagtattatnanaacattgaagataaattaaaagaacttcgagggtcatatacattatgcttgcgctgagccactaattgttacgaattatcttgttgccttgttgttgttttctttcttttttgtatcaattgcatgtgcacaanatgcatgcttctgtgccganatatactgcctgacgtgtgtattatcngtggttatcatcctcagcttgtgtggtgtgttttggttcctaaaatgcattaactcctgttgtgccaaacgacggctaacaaagaatcccgactgggancactcgcctcatgccagaggaaggctacacagtcaatgtacctcccngggagcnctggcgaanaatcacttaccacatggggaaagcaagatnttccctgaccatcatgctaattttggcctgcattaatgatgganagtgtagttatncaantcctgagtanacattatcccgtgcttgagcctaattgaaatgaatatngccagatttgcgccnggtaaaattaacgtcatactgnaagaattgtgcagtacgcaacagacgatnaccggtttgttgtttagcacncgattgtnagtcgcacatttccctaaaa

SEQ ID NO: 81223 - DNA, 202 bp, Triticum aestivum
  unsure (1)..(202): unsure at all n locations
  Clone ID: PAT_TA_81223
gaacagcaggatccttcagatggtgtttggagaggtgcgggtcttgattctcgctgggcaccaccgtggtcgagccctggggtggatgaccccagttcctctagtgcagtgagatccgtggggcttagtgggagtcanatgatgatcaagcanttcgcctcctgtaactgatnattatngggcaatgcagattccaacctgg

SEQ ID NO: 81224 - DNA, 521 bp, Triticum aestivum
  unsure (1)..(521): unsure at all n locations
  Clone ID: PAT_TA_81224
ggccggtgggcggtggcggcagccggcaggtgcgccaccccgaggccccgacccatccctctctctgccggaaccttcagatccgcataaaacctcgttccccatttggtttgtgccacgtgacaggatctgtgccgcgatggcgacgtcgaacacggcgcggatggaggacggcggcggcnacctgcggatcaccatcaagaagtggaatatcatctancctgtctacctcaactccaanaagacggtcgccgagggccgccgcatcgccgctgccanngcctgcncggnnccacctgcatcganatcgctgactgcgtncgcacctcaagatccccacgcatcaanttggataagggtancctcgggattcttccaggtgggnangnccaggttgaaccttaanaaantgacggctcccccntaancctgccnttaaaacaactaccaactgggtgatccantcgtaganctattccancatcangaagganaanaancagagcnagcgcaatccnggg

SEQ ID NO: 81225 - DNA, 593 bp, Triticum aestivum
  unsure (1)..(593): unsure at all n locations
  Clone ID: PAT_TA_81225
ccaaatctcctcagcctcccgcgcatctcctccgacatggcccgcaccaagcagacggcgaggaagtccaccggcggcaaggcgccgaggaagcagctggccaccaaggccgcccgcaagtccgccccggccacaggcggcgtcaagaagccccaccgcttccgccccggcaccgtcgccctccgcgagatccgcaagtaccagaagagcaccgagctgctcatccgcaagctccccttccagcgcctcgtccgcgagatcgcccaggacttcaagaccgacctccgcttcnagtcctccgccgtctccgccctgcaggaggccgccgaggcctacctggtgggcctcttcnaggacacnaacctctgcgccatccacgccaagcgcgtcacatcatgccaaggaatcagctcgcccgccgnatccgtggagaagggctaagtctgttcgtcgtcgtcngtnatcgncncttacctgatgtgtcancggggaaatgtggtgcnagttttgtcntgtctggccatgngtgtgccgtncgantcncatcntgcggnnacntactaatgaaatgtgcancgtctaaaaaaaaaaaa

SEQ ID NO: 81226 - DNA, 668 bp, Triticum aestivum
  unsure (1)..(668): unsure at all n locations
  Clone ID: PAT_TA_81226
gggaaagcccggcaccgtattccaccgcccgccagacacgcatgacgtgaattggtccctgccaggaaccagagagttatttgcctaatctccacctttccggccatcgcaagcacgccaaagtgtgtacggctggaagggacggaaaggaacaaggacaaaagctaagtacatgcaataatttcctcttgatgattcctaaatttttgcactcgcttatcccttggctttagtaagtgttcgtaccatgaaatccttcgtgtgacggtaccttggctatttctttgtctgcacgctcgttctgtccagagcctaactcacanaatgagcggctgcgtcgagagctactaaggaaaaacttgccgggaagcatccatgccaagatgagtgttaagggctgggacccttacgacaatcgcagcaatatgataccggnaagcaaccaanncatacataaggacaatcatatgatacaacttataanccganagggataaacgagcatttaagattancaangatacantccacacangcataantatanggtacttaacacaatganactcagtttgttaaggtattagagacacaaggttacantctcgacaactntaancatggaccaaggnctggggcagggtttttccttgancgaaanggnccna

SEQ ID NO: 81227 - DNA, 468 bp, Triticum aestivum
  unsure (1)..(468): unsure at all n locations
  Clone ID: PAT_TA_81227
tgcagtttcgtcgccagagctccccaccaccagcaggatccccacgacatcgccatggatggctgcagtctgagctcgcatccgtcaccatggatccctgcctcgccggatccgaggtggatccatccatccccgccgtttcccgcgaccttcctggccggatcccgccgccgcgctgccgttcctcgccccgcgccgttgacctgctgccccaacgccctgctcgcctcctctgcttcattcgagcagggaggacgacgagcgctcgacccaaccccgttgaccgcgtccctgttcgtctggaacgccaagcagcccagctgcctagcgcctccccaaggcccagcctgcgccccgcggcctgccttcacctcctcaccgacgggctgaagcccatgttccggtaatgttgcgattgtgaggattcgttcgactactcccgttcgtcnttgtcatggatcgttcttc

SEQ ID NO: 81228 - DNA, 309 bp, Triticum aestivum
  Clone ID: PAT_TA_81228
ggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactaaa

SEQ ID NO: 81229 - DNA, 657 bp, Triticum aestivum
  unsure (1)..(657): unsure at all n locations
  Clone ID: PAT_TA_81229
cgcaccccaacccaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccaattctacaaggtcgacgacgccaccggcaagtgacaagctcaggaaggagtgcccaacccgactgcgggcgggaacttatggcaacactcnacgcatactgcggaagtgggctcactactcacaacanaagntnaagttctgcaatgccgctcttactacaacagatcgaccatanatgntccttgtcttaacgaacttntctagttcgaanatcacgcanggtancatntgttaaaaatcacagagaccaaaaatcnnnccctcgag

SEQ ID NO: 81230 - DNA, 518 bp, Triticum aestivum
  unsure (1)..(518): unsure at all n locations
  Clone ID: PAT_TA_81230
ggatgatcctgcccctaaaaggttatttctggcacgaggcaagctccaaaaactcctggtggaatttgtacctcctaaactaatactccagaagctcgtagaactcttcttgaagggaattcagactggcgtgaagagggaagtctactattggcatgcctactatgacaagaggttgcctgttggtgcaagtgctctgcttaaattggaagaattcgttgccaagttcatgagcatccaccggaagagcatgtcgcatgagcccaagattcctgaggtgccgcagtgaaacctggcanagcatgtcctcgtgcggttcggccgtgtcgaaatcccgtttgtggtggtggtttttctgttttatataattcaccttacgtgatcaactgtcatggncatgtttttctggtccatgtatatactatatggtcacatatatgctactactgagtacacaatattcagcnaataatgtcnaacggtaaacatccgtnttgggaaatcttgttgcaaanaan

SEQ ID NO: 81231 - DNA, 260 bp, Triticum aestivum
  Clone ID: PAT_TA_81231
ggaaagttttcttaccgagaagaccatggtcagaaactgacctcttgaatgagagggaaaggatgctgacaacatgtggcccttgtttgtttaattgtacatatacctttgcattattgcctaaactctttctacagtgttgttggattattgtttgtgcagcatgaaagaggaccgtttgagtttgtatttatgcaaatgaataagtaaataactttcagttaaaacaatgacaattcgttatttaaaaaaaggggggg

SEQ ID NO: 81232 - DNA, 656 bp, Triticum aestivum
  unsure (1)..(656): unsure at all n locations
  Clone ID: PAT_TA_81232
ggataatttcgaatggatanacgcggcgactgccagactggnggaaataaagaccctccaagcaagcaatccaatcctggctgcaccaaatgcangcgaacccatgttgctatanatatcggnaacacatcanntggtgagcgcngtgcncgtcgncgaacganaacangacggacacaantttccgctccaaaagctggtanactacgtatccancgtcctcacacnatgcaaatcccggtaccctcactancanaagatancatatgcagtcntcatggcatctcaaaaattgcgacactactttcaggagtgctcgatcacggtggcttccnaagtgcccctcaatgatatntcaaggtccgggatgcaacggaccggattgccaaatgggccattgagctcctgccattctacatcacgtacaaancacgtcgancatcaaatccaagtactggntgactcgtcccgnatggcaaagccgaatcctanaganacgngcaattcaactggtgatcatttgacnntcanatgttgtanggtcanngcggntctattagtcccancggnnactcatagtccaattttcaagcncaaaagcaccgatacaggntgngcangctcgttgcctaatgnaaaaccgagnncgganaccn

SEQ ID NO: 81233 - DNA, 178 bp, Triticum aestivum
  Clone ID: PAT_TA_81233
aaatgccccacggtgttgtatgttgctctcatcatcagatatttgctggcttagctatttctagcctcattctacttcattcatgtcacttgaataatctaattcatggcaattgtacctgtccctatacctagatggcttaaaatctgaaggtttattacagtttaaaaaaaaaaaa

SEQ ID NO: 81234 - DNA, 589 bp, Triticum aestivum
  unsure (1)..(589): unsure at all n locations
  Clone ID: PAT_TA_81234
gctaaacaaaactctagcttctcggtcctgacctcaaggctggctggctggacgttgatcagcgaatatgatctcagcactccccgtgctctgctatggggtcacagctagtgcgttgcaatcccaatcgatccaccaaataacatcctctacaagtcctgcaccagctttcttcaaactatcaagggacccctcatccttgacagtttgtagcccacaaatacaggcaataagaatccaatcactgcggggcaaccaaaatttgaaggccattgagatgagtgaagggaatagatggggctcagggatgaagctgggatgtcatgggcatgacaattggatgcttcatatcgtgtccactgcatacgaacaacctgctgcctttcatctctaagatcctcgggtattcatcattgctgcttcaactgttnggnaactccctcaagatactgaaaatttgaagcatggaagtgttaangacnagtgtggatcctttaacttaagttgtcggtaacaattgcttgganatgtatcataagactcctttcactangggantactttcgtaaccagcantattggtcatcat

SEQ ID NO: 81235 - DNA, 280 bp, Triticum aestivum
  Clone ID: PAT_TA_81235
ggcggtggcacccggtggcagctctgaccgcaacctggacgagttcgtgcagtttgtgcgcgccggcgccacggagaagtgagaggcgctgactgtgaagtgtgaagggaggtgatgttgcagggtcccagatgtgacgacgcgatgcgaaggagaaacgtttcgaaactggaagcaaaaaacggtcgaaagtttgtgcttctacttggtttggtttatgctttgggtccaccagccataataatatactttgcttgaggattctaccaaaaaaaaaaaa

SEQ ID NO: 81236 - DNA, 346 bp, Triticum aestivum
  Clone ID: PAT_TA_81236
gagaacctggacatcgtggactgggagctgagcgaggaggagaggcagcgcatcagcaagatcccccagcggaagatcaaccagggccgtcgctacgtctccgagcacgggccctacaagtccttcgaggagctatgggacggcgagatatgatatgagtaaacgttacgtcggcgccccgctaggcggctgccttgcgtgacggagcaacgagctccccgtcgtgacagtgagcggctgctttgtgtggttttatgtcgtgccatctgtgcaacaaaaagtgatgcttagtgtcacagtatgtgtgaaataaattaaaaaggattttctggttaaaaaaaaaaaa

SEQ ID NO: 81237 - DNA, 242 bp, Triticum aestivum
  Clone ID: PAT_TA_81237
gcaaggtcccaccagttcatcttcagccgaggagatgggtctcactcgcattatggcgacttgcgcctggtgtctgactctcggtcctgtaacatatttgtccgacgaatacctgtaggttgtagtgtagaattatcaattatgcagtgtggatggtgaaccggtgatattgtgtttcaggcggtgaaccttgttagttaggagaattgagatagtagcagtgtggtgctaaaaaaaaaaaa

SEQ ID NO: 81238 - DNA, 195 bp, Triticum aestivum
  unsure (1)..(195): unsure at all n locations
  Clone ID: PAT_TA_81238
tgcaagcggagcacggnaatgatattgtacctccgtcnacccgtttgcttanctacattgcgcttcggtactccgagttcccacctganattatgacacattggngtgnangataacanattttgctagcgccatgtggttgttttccantatggttctgctgtgcttttcaacagttgctgatcatnanaccga

SEQ ID NO: 81239 - DNA, 636 bp, Triticum aestivum
  unsure (1)..(636): unsure at all n locations
  Clone ID: PAT_TA_81239
cactctcgtttctcgacgagtccgtgaaagctagcataatactcacaagtgcatagaatagcagtggcgcatctgtgccacacacacacacactgagaacattcaaacacacgccgggacaccatcgtagtgctagtagtagcagaacacgagtaatgcacaggcagagccatcagctatattatatatacacgacgacgggtgccgaacgcccagtctccggagcggcgtcgcctcatcacttgccgccggcagtggcgacgccgcgctgggagacggcctcgacgaggtagtgcacggccttgtcgtagctgacgaagcccatgaaccagaagtcgtgggaatccacggtgaacaacttggactnacttcccggnggggtctccctcancgtcaccgggtcaacgtcgcnatnttgcaaagggggattatancctgtatancncaagcnggctggcaaacggnccgcaaagaaaccggcgtcctgcaaagggacttnagttggcnagtaanctnccgggaacggcccttgctngaagnacaacgaagtctctnaaggcctngggtggcaaaantntgctgaanttccaaccncccgaagcttncccaggtanttccaccggtcnaagnnggggg

SEQ ID NO: 81240 - DNA, 644 bp, Triticum aestivum
  unsure (1)..(644): unsure at all n locations
  Clone ID: PAT_TA_81240
cggnaacggcgcggtggagttcggcgagctggcggccgccatcgcgccgctgctcaccacgcagacgcacctcgtcgaccaggcccagctcctggaggtgttccgcgccttcgaccgcgacggcaacggctacatctccgccgccgagctggcgcgctccatggcgcgcatcggccagccgctcaccttcgaggagctcacgcgcatgatgcgcgacgccgacgccgacggtgacggcgtcatcagcttcaacgagttcgccgccgtcatggccaagtccgcgctcgacttcctcggcgtcgcctgatgccctctgatggaccgatcgatcgatcggtctcgctcaccgcccgccgccgtaacccgtggcctgtcctcgcccgccgttgatacctgttctctctctctctcttttttttgttangnagatgctcatcngttaagtaggataactgacacaagatattanctcaaanaactcacnctgggttgtacatggtgactcgggaaanaaganaaaaaanccagggggggcggtacaattcccnaaggntcnttagnccnctnaaggcgtctttaantctacggaaaccgggtacactanncctganaacccttccacgggatannaagcgacatnctcn

SEQ ID NO: 81241 - DNA, 374 bp, Triticum aestivum
  unsure (1)..(374): unsure at all n locations
  Clone ID: PAT_TA_81241
ctcctagtctcctctccacactcccgctctcctgctactctgctccgtgatctggtctggtgagatcggggatcggaccgtcgactcgacaaacatggcggactggggccccgtggtggtgggcgtggtgctgttcgtgctgctctcgccgggcctgctctgcganctgccgggnacccaccgccacntcgacttcggcggnttccacaccaacggtaaggccatcttcgtccagaccctcnatcttcttcgccgccttcaccatcntcangctcgcgctccanattcacatctacagcggctatntagctangtcngancatatgttgcgtccgtctggactcgcggaggtctcanatnagaaaagaacccgg

SEQ ID NO: 81242 - DNA, 318 bp, Triticum aestivum
  unsure (1)..(318): unsure at all n locations
  Clone ID: PAT_TA_81242
gtttgtttccccgtcctgnagaagcgacgacgcaatagatcttcgtgcactgcagagtcntctcccccaagccgcaaaggaatcactccactccatcctcgntctttgaatcgatctgganattatgatctgttttcttgacggnacataaactgangtttttatcgttgttanatgcttgttgtattcgtttgtttagttcagactgcagaggttcancaacagcaggcttagggtgtggatctgatttgtcatggcttantaggatttaggcagattgaanaggactanantctatagatcatanngctcatttca

SEQ ID NO: 81243 - DNA, 507 bp, Triticum aestivum
  unsure (1)..(507): unsure at all n locations
  Clone ID: PAT_TA_81243
gccatgtgttagaagtcccattgaatcatcctgaaggagatcgtacaacatctatcagtaaagtgaacgcacttgctatgccttgtgaacaatgcaatcttccttgtcaaagggttagggagcctccttgttcacatccttgccctttgccatgtcatctgaacgattgtccttcttgtaaagtccttgttaaaagaccatgccattgtggtgctatggtgcatgcctttgcatttaagttgttataaaacacacattcaaaactgcggnggagcacggaggcgaangaggagcagcagcagcaggcggcgccgangagcggcatcncactcagtgcttgcaaccatggctangggattgacngaagcacntcaanagntcaatgcgcccaancattggntgctcgacaagctggggggngcttttgctccaaaccatcttctgganctcanaagtcaaggagtgcttctccgattccancannaggaacaggctcagtatgcctga

SEQ ID NO: 81244 - DNA, 290 bp, Triticum aestivum
  unsure (1)..(290): unsure at all n locations
  Clone ID: PAT_TA_81244
ggcaagtgaanattcttatggcaggaacgatgtttggtgctcgcttcgattatctgtgacacaatgtactccatccatccgtccagacttaaatgatgtatcatgtcattgtggtttagtgagagttgtataactacctgaggaaactcacgtgttactatatgctaagatgctgtgacggtgagctattcagtgctcacttgtgttccaaagattagcccgacttgtgtgtgccatgctgacatcttttctggtttcatactcagctttacgtaaagctttgctctgct

SEQ ID NO: 81245 - DNA, 643 bp, Triticum aestivum
  unsure (1)..(643): unsure at all n locations
  Clone ID: PAT_TA_81245
aacaaattcaattttctttttctgattaatctatttcaaaacgaacattctctgtttttttttggtttctgacatctatttcaaaacacattttaactacaatgcctaggtggaatatggacctgtttcctantcatatttcttgacgcttatttttttttttcgcaggccgagaaggacttgcagccttggattgctagagatgacgaacaaggtcagaagatgtggagagtcaaccancgtatagtgaagcttatagctgagcttatgaggaaccatgacagncctgaagcgttggagatacncgctagtgcctccgancttctacttcgtgctancgatggaatgctcgtcgatggtgaaacctgtactttgccacancttgagcttctggaagtgancgctcggggctgtccatcttaacatcgaatggggagatcaggttaccattgcaaangggtttcaaaccgctgagtcctctananccaccatcgcggcttccaccaaanncaacgtcgccatcanangtcgtcccgcaatccnagaanggttcgganccacagaaancanggaaaacangaggatcanaccgncaacgtccggccagananaanggacgctcaanggnaaantgaaccacccg

SEQ ID NO: 81246 - DNA, 635 bp, Triticum aestivum
  unsure (1)..(635): unsure at all n locations
  Clone ID: PAT_TA_81246
ggcaaactacggcaggagctgccagatgttccttctgatgctcgtttgatctttccacgttacaccttagatgaagctgagactgcatgtcactattatatgaggcaaaagatcattcggcgcgagaatttttcagaagagaaatggaaaaagatatactacttatcaaatggaaatggtgcagagatgagatggcttgctgccttcgtttgaggtagatatactgtccctgaagtttctgatacctggattgtactcagttttggtggtggtgtagaaaggttgccacctctgtttcagcattccgttacacaccacagttcattgttgtgtacttgtagtccgtctcttgacatctctagaagaaagtttggcgtcaacatcatttgtgctgagtanaacttgaggaataaggataagtatgtggctcanttacatgatagaancctaggctccttaattctcnncanatgcanatcnaaataggnncattgtnttggnaagtttcaatgttggcccncganncatatatatantgatccatcaccagaagctngcaaaagtgcngatgccccgtggtatttttantacgntcancnacaatnttggtgggaaatnntcttggaaaaaaaaan

SEQ ID NO: 81247 - DNA, 437 bp, Triticum aestivum
  unsure (1)..(437): unsure at all n locations
  Clone ID: PAT_TA_81247
attgatttctatgaagtacgtantttacagtgtggaacagattattccaacttcctttcggagcagagtaggagatggaggtgttgcacagcccaatctgactatcgagtattcttcagtgatagatgacctgatataccatgcatcttatacctatatgacacacctagggcccggacggacgacctcgtctgggtgtagcccgtgcgaaatgggggaccgcatgggcgcatggcatattgcgcatgtgaaaggagagcattgctgccagcttaccgcgacggctgtttccatatccgattanttacaagtacctaatatatctacttcgtaatatctagatgacacatttgcaacatgcgtcaaaattngctgaaacatttcgaatatgtantgtatataattatattattgcaataanccctccgntcgttttt

SEQ ID NO: 81248 - DNA, 619 bp, Triticum aestivum
  unsure (1)..(619): unsure at all n locations
  Clone ID: PAT_TA_81248
tctccgcgacagagccctcggggcggggataagagtgaagccaggaaaatctctcccagtccttatcctaaggtgcccatcgcacgggtttctgatctagatatagttgatagctcttcgagcaatggtgatactggtgccagtaagaaaaagactgaaaagagcagtttccgcccaattgccaaggagagcctgtcacttngaggactccaaaagagaagaataaaactccagaaggcatcaaaccaacgctctgccaaaaacgatattgacgaagaatcaaatgaaagtgtgaaacctcaaagggtgggcacatccttcatatggtttantttaatgtgatgagagactgaaaaaagaagaannctactcaaactccgggagaaatncatgcacaggaactggagaaaanacttngcaggcaaatcanggaaactgaaaactgaactcaaaagctgaaaaaatttaaattcnggnaacacaagccactttatanggacacnccccagggtgnttgaagatnccacaacaagacnttnacaatgtggcnccaaaaaanccnaggnggaagaggatnanccccantctnactcangatccattanggncccaatgggna

SEQ ID NO: 81249 - DNA, 551 bp, Triticum aestivum
  unsure (1)..(551): unsure at all n locations
  Clone ID: PAT_TA_81249
cttacccaaggccaatctaaacgttcccgaaagaagaagctggcgaccccaactgttcttgatactttgaaaaagaaaactaaaagggcatataacaaaaggaggaatgcaactgcaaacaccctgaacacatctgccactgcaactgacagcataactgatggcacaaatgttcagcagaatcctgtaaatgagggatggcagctagcgtcgactaatgctcccgaaacttctcttatggagtgggagaacattcatttgatttgtcacaatacaacaatgccccaancttccaactgggcctgaaaagcacagcaggctcaactccactgaattaggaacaatgcanccgtgatgccttcccaatagactaattcctgacatccttgtattttgggaaaaaactaggggtgaggttaagttgacttccatcctgcctaagacccnagancatgaccactgaataaaggtgaaaaggaaggatcatgtggggaatngnactacaaccanttccaatttatggaaggtncccaaaaacatcctttttctnc

SEQ ID NO: 81250 - DNA, 476 bp, Triticum aestivum
  unsure (1)..(476): unsure at all n locations
  Clone ID: PAT_TA_81250
ggattcccagtagccagctaagcaaccacatggctggcacacagcccaacaactcgacccgtctcgccgtcgtgcgaaccaaccagccaatccagcgcaaacggcacacaccggccgacctggaaggagatccaaacaccagagcgggcatccaccgacggacgcggcgaacagagccctcactcacccgcgcggacgccggagtcggcggccctcctgagccccatcttcttgacgatgaagctggcgccaatgaaggcgctcgacgacaccgcgaggaccaggcccttgggcgttgtccgacgaantgccccgccgcgcccggccgccgcggaaccggcgccgccatctccttccccctcgcgcccctggtccggntcactacaagacgctgtncaggnggctacnatccacgccgcaacggcgccgccgccgccagctcgnatgtggagtttaatggaggtangaanaaggcg

SEQ ID NO: 81251 - DNA, 461 bp, Triticum aestivum
  unsure (1)..(461): unsure at all n locations
  Clone ID: PAT_TA_81251
ctcangtggagctagccggtcgtgtccacggcgagcgctagcgagcgcagtgcgctggcgtccgaggcttctgcggcttcnactgactcgtaatcgttgaaacaaactgaacgcagtgctattagggatnagcgaggttgaggaagtccagctggaagttgctcgcctcggtgaaacgcgcggacccgaccanggcncctgccctggtgatgcggcagccgccggggcnggggccgagggtgacggtgcaaccctgcctgacnagctggccggtggacaccaangttnaaatccagacnagggacgtacanacgtcttcaaggancatgcgctcnnttcnaccgaccgcttccgcggactctcagnggnactnccttcaattgacacctgnnggacgagggccccttancgttgtngcaatgcnttgccccngtcaaaaanaggtctggtnccgtnaatga

SEQ ID NO: 81252 - DNA, 313 bp, Triticum aestivum
  unsure (1)..(313): unsure at all n locations
  Clone ID: PAT_TA_81252
ngtgctgccgtgcagagagtacttccatgctgctcctggccgtgccggccgtgctggccgggttcctcaaggcgttccgcctcgccttcctgctttggccgctcaacctcgcgctcccgctggcgcgcgacctgccgcgggcctgcatcacggtccgggccatcgcgtccttctacgccgccgggctgcggggctacgtcgccggcgcccgccgcggggtgcanctgctgcatgcgcggagacagctggggccagcagcaanagcagctcgccgnctcctcctcctcntcttcctcctcctcgngcgctcggt

SEQ ID NO: 81253 - DNA, 618 bp, Triticum aestivum
  unsure (1)..(618): unsure at all n locations
  Clone ID: PAT_TA_81253
aagaacctcaccgccgacgcccagctcgcgctcctgctgtaccacggcgtggcggaacactactccgcgcagtctctcaaggcgatcaatggggacgtaagcacgcttgcctccgacggatccaagaacaacaacgggtacaacctaacgatacgtgccgacggggacacagtgaaaatctcgtctgcatctgccagcgccgccacggtgaccaagacgctgctccgacaaggcgccgctctccgtctacctcatcgacgcggtgctcctgccaaggcagcagtctaacgacgacaagggacacactgcgcccgcccctgcgccggctcctcgcctgcacatgcactacactgcccttgcgccggnctcgccgtcgcctgcccctgtaccggcctcgccgtcnccgtncgccgtcgnctgcaatgcacccanaccccaattgcccctgtccggtgatgcactgccccaagngtcgccaacgcatcgcnaganaaataccnactcctngcaaangcggaggcaacgccnganttanaagacaccacnaggacacggatctgggaangggcggcctgnatctgtctcttctaaggttaaggttactaantntaccatggn

SEQ ID NO: 81254 - DNA, 184 bp, Triticum aestivum
  Clone ID: PAT_TA_81254
gcaacaattgctgccattcaaccaacatgctttgacaaacccaacagcgttctaccaacaacccatcattggtggtgccctcttttagattgcttatgagttatagttcaataataaagtttttttgctgatgtttgtggcttcccaaaaataagaaagtgcatttctagttaaaaaaaaaaaa

SEQ ID NO: 81255 - DNA, 169 bp, Triticum aestivum
  Clone ID: PAT_TA_81255
aaaaacagtatggaggtatatctaccaccacctgatgatttgatgaaccacagactgtcgtggttagctgtaaatgacagcgaatgtttatgtttctagtgacaatgtgaatatttggttttgcacggctgtgatatggaaagtttgtttcgaggttaaaaaaaaaaaa

SEQ ID NO: 81256 - DNA, 621 bp, Triticum aestivum
  unsure (1)..(621): unsure at all n locations
  Clone ID: PAT_TA_81256
acaatttccagtttgtgaacttcacggagattatgtcaaagagcatagcagctgacagaaaggaggcagaatttgcattgtcagcgctgatggaaatccctacacagtacaaagcaacacttgatctccaactcttaggccgccgccaaagaataactccaagaattgctctgccgccaccaacaaggactgcttattcacggactactagctttagccaacagtctggtgtttattccgcgatcaagtagctttgaccaacaaacaagtgtctaccagcaacgttctgagagcttgaaacagcagcaacctgcaaccccaaaagggacctgacacttacgtatcaaaaangctccgggaggacaagatctgtgccccatctgcatgtataaatccaaaggccttgcatttgnggtgtggcacanacttgctatgaatgcgggaaanattgggacgcgcctccggtgccacaacacataacacgagtnaggtctacgattntaaccatgggattgaaaagttangacancttganncacgggctcacattgtatccgaagganacnggccatattccaacaatngcaaggaccnccaaaaagtanattcccttaccttgtg

SEQ ID NO: 81257 - DNA, 631 bp, Triticum aestivum
  unsure (1)..(631): unsure at all n locations
  Clone ID: PAT_TA_81257
gtcgcatggaccaatcatgggcgtcctgtatctctcgactgtcaagattgcattcggtagcgacagccctgtgaaatatgtgactgaggacaacaaaactgagtcatccttttataaggttgttttaccccttcatcacctgagatcagttactcccacagcaagtcagcaaaaccctgcagagaggtacattcaggtccgtttcagtcgacaaccacgagttctggttcatgggtttccgtgaactatgatagcgctgtaaagaatcttcanggagtctgttcgagttgttcacggggcctagaggttgcccatcacttttcctcctatgtgggatgtagtatgcccgtggtaaatgtatttgtgcatggcacctgtnaattgtgtgtttgaaatggtacacatcattaaggcatgttgttcccccctaaattatataattggatataatgaaaaatatnganaaatacacttngtatcataataattaaataacactaangcactattaactaattgtatccaaangngttacctccactccacataccacttcatcacgaaacancacctacatgatcaattgtgangtaagtttggaaagtnaaccacactatagggtaggnccgng

SEQ ID NO: 81258 - DNA, 294 bp, Triticum aestivum
  unsure (1)..(294): unsure at all n locations
  Clone ID: PAT_TA_81258
gncttcttcgcgaangntgggctggattacgtttcntgctcccctttcagggttccgattgctatgctaactgcanctcaggtgcntgtctgaggctgcctcctctttgncaaccggattgcctgctgctggcggatgtggtgatcaacactattattacagagccatnctatgtgaanattactagtaccantgctcataaaagctacaatcccatctcccttttttttcnagtcatgtaaaacttccaaacagctccatggttcanaactcngttcttcaatacatcatcan

SEQ ID NO: 81259 - DNA, 299 bp, Triticum aestivum
  unsure (1)..(299): unsure at all n locations
  Clone ID: PAT_TA_81259
ggttgttcggtcgattatgtgtttatgttgattttgaatggattttaccaggtcaattcttatagaagcaagctcagaagctgaaaaaagctgaggcccaatatgccatagatgggagatctgttttctttttgttcccgggcaaatatgctttgctctaggttcagcttcttgtcttctatattccaaatttttttgtataataattctctttgggtttaaccatttactccgaagcttctgtttatatatatgcgagtctattcttgagcantttttttttcaaaaaaaaggggggg

SEQ ID NO: 81260 - DNA, 235 bp, Triticum aestivum
  Clone ID: PAT_TA_81260
caaagctcgaagcttgttccacatcataaatgtgatttgtgtttcctcatgatgtttgggaatgggatagggggttggcagctggtgagtttaggctgttttttcccagcctgttttgacactgattactgtatacttgaactgcggtttggaaatgctccagctgttaggttcagttgacgtcatttcttgctgtttgagcttttaaccgtcttcttttcttaaaaaaaaaaaa

SEQ ID NO: 81261 - DNA, 468 bp, Triticum aestivum
  unsure (1)..(468): unsure at all n locations
  Clone ID: PAT_TA_81261
gcctgccatgcaaagcctttcaggacaaaatattgtggctgcagaaaatatgggtcatttaactactggaatggctcctgcaactgcaaatgcagaaatggttaattcagatttgacttcccagaaccaaatgttgtcttctttaccgcaaacggatgacagattagctgatggaattgaatccaaatcaggagaagatgtttcacatgggaagagtgaggcttcggctgaagctatcggaccacaggatgcacagcttgggaccagtgcaactaaacgctcagcaacttngaaaacacaagaaaccatatgtcatcaatgatctcctccaatcaaatggatgccacacaagatgatgtccaccaccatctgctgcatcaagtacacctccatttgacaaccactgctcgcaatggataatcaaacatggggtgggtgtcctgcacaaangggacacactggcattcc

SEQ ID NO: 81262 - DNA, 602 bp, Triticum aestivum
  unsure (1)..(602): unsure at all n locations
  Clone ID: PAT_TA_81262
gaggtgctgaatcaaattgtctatgagctgccagaggaacacccattatcagagacaaagccactgcgtgaaatccttggacatactgttcctcaggtcgtggccggttgcatccttggaatcctcatggctgtcgttatgcttttggctctcgggaggtcttagtcaagtgttgttcaccctatatctcactggtgatggctacaaagcataaaaacatgatctccccatggttctgggctgtccaagtgttcgatagtacaaagttctaaccgaatttagatctggactgtangtttcaagttgtanctcgagttggttgctgtaaatctgaaagggcacttttaatccaaccacgggtaatggaactttgttatacaatcagcagcggtaagntcattttgcggtnnattatggccatacatccgtcccatttgcttaancccctttaattgaaaacgcgatcatttggnctccananagttgttttgcaactattaaaacaagtattgaatannataacnaaataanattgancatgtttagaaaaggaaacatttntgaggggnaccgtntgaccctgnttgnggaaaaaaaaaaaa

SEQ ID NO: 81263 - DNA, 601 bp, Triticum aestivum
  unsure (1)..(601): unsure at all n locations
  Clone ID: PAT_TA_81263
ctgacttgccattgtcccctgctcatgtgatagtaagtatttccagcttatctaaagattataaaagatcttacatttccagttaaaaattaaagatggctagagctcttggaaccctgagttatacctgctattagttcatatcgtctggtaagtagaatctatttcacttcagtagaagtacaaatcgtctgttgttttctattagcagtgatcagaaaatcttggcatgcattactttgtttcagtcccttcgcatttcttatcaatgggcagatttctcccaaaagaaaactgtgtcctgaaatttggctaatatgaaatantacagtatgcccaccagtacttggactttactgggctcaatgggccaggcaagaaggaaatccaaatgggtgtttccttggngttgaaccattataacaaacttaccctcattangttgnacccgcatttttgatccatngaagtaaaaggaatacanattgggccttcngngaatttttggncaatcttggcctggnggtttccatggcttagaaacatgnggaacgatttcaanagcccaacaaantcccngaacattctgaattgganagac

SEQ ID NO: 81264 - DNA, 519 bp, Triticum aestivum
  unsure (1)..(519): unsure at all n locations
  Clone ID: PAT_TA_81264
ggatgctcaaaatcaccaccatggatgatttagttaagaattcaatgaacattctggaaccatcgcctgtggatgctactgggaacaatcgtgaagatgtattgtcatcattgtctcctgttgatctttttttattgccgggacaagcttttgatagaactggtcgaagactggggcgtggtggagggtactatgacacattcttgctgaagtaccaagaacttgcaaaagagaaagggtggaaccagcctctcttagttgctctttcgtactcggtgcaaattatggacgagggcatcatcccagtcaattcaactgatgttccnattgatgctccnggtctcatcgtccggtgttattccaataattgctgcnngcttcagaggatgcaatnaattgattggccnngtnccatgctttcanaacaagcacttcttcngatccctggntgcacgagcaaatacaccgcntttaagggaatgtccnttttcccctcgtgctcccccctgtacactttac

SEQ ID NO: 81265 - DNA, 362 bp, Triticum aestivum
  Clone ID: PAT_TA_81265
ggctactgcaggagctgtgggcggttagggtttgaaaccctagccgcccctcataataggcgttttggacccttgttgggcctcctgggccggccagccaggctgggccggtgcctggtccgcctggcatgtcgcttgggctgttttccagggtccagaatagtctattttaccatttttaaattttaaatttaagtataagtctctgttttatatgtaatttcagttcaaaattatcttaggcatctagattcgttatttagattgctaaagatatatgtaactgtacatatttgtccattttattatggaaatacagacttgttaatgaattatattttatttatatttataattcaaag

SEQ ID NO: 81266 - DNA, 639 bp, Triticum aestivum
  unsure (1)..(639): unsure at all n locations
  Clone ID: PAT_TA_81266
gctttccctatgggaaaaattgatcaaacacgtatgtggaaggtgggtgaaagggtccgttcaaccaggccacaaggtgatcttggcccactgcatcccttcactgctggagtgtatgttgcactaatgatggctcagattgaggtccttaggaagaagggccactcttactcagagataattaatgagagcctgatcgagtccgtggactcgttgaacccgttcatgcatgctcgcggtgtggccttcatggtcgataactgctccacaactgctcgtttgggatctaagaagtgggcaccacgcttcgattacatcttgacccaacaagcgtttgtgactgttgacaagaaagcaccgatnaaccaagactccatcaacaactcaagtctgaccctgtccacggtgccatcgaatctgcgctcaactgagnccactgtgacactcaatgaccgctgatgctgattcntgcgtccaagactnnacatctcanaacttgtatggtccnatgtgacgcaatgntagttgtaagactaatagccgggctttgaccctaatgtccgtatgcctctnaggccaaaataanctggnggtggacgtgnnatncagataaataatccgtgtaaaaaagnacncatg

SEQ ID NO: 81267 - DNA, 345 bp, Triticum aestivum
  Clone ID: PAT_TA_81267
ggcaggtacgcggcggagatccgggaccccgtgaggaaggcgcgcgtgtggctcggcaccttcgacacgcccgagcaggccgctcgtgcctacgacgccgccgcgcgcaggctccgcgggccgcgcgccaccaccaactaccccggcgacgtcgtccgagaagcgccgtgcacggccccggctctggctgcgagcgcgagcggcagcaccgagtcgtcgtcgtcgtcgtcgtcaagggacgacggccacccgccaccgccgctgcctacggcgccgtcgtcgctccggcctgggcctcgggtcttcccgggcgacggtggccacccagccgtgcctttcctgcgg

SEQ ID NO: 81268 - DNA, 655 bp, Triticum aestivum
  unsure (1)..(655): unsure at all n locations
  Clone ID: PAT_TA_81268
cttgctcacccaataattcgatgatcccggctgatggcctcctctgaggccgttgcagcctttgtataaagtcagtaagtcccttcacaggaggtttaatgaaaatataatattaggggaaaaaaagaatgcatatataaggtacaagaagcattgaccgatttgttgtaatatctactcaccaccggttattctttaagccaggattctctctccttgtgaatttaaccaaaggaaagggcatttctttggcaattgtacattttgatgatggaagaagaagatgatccatgaactgagatctgcagtgtcnacctactaatggctcacaatttttgcaattgtgattaagaaattcaaggtgctgcttgacaaantcggtccgggcttcantttttggatccccttgnaaaaattgctgccnctttttatacancaaaanctgaaagccnaanaggtntttggcttgaattgcagcctaaanagtncatcactcataagaggcanaatgccttaaaggggggactcttgctgatcaatctggaaaanccaggacnatcaaacttaaagngcgggcaaacgcncgataaacnaatcttgtaanaatntctgganggaacnngaggaaaaanggggggtttggncttctccccaa

SEQ ID NO: 81269 - DNA, 601 bp, Triticum aestivum
  unsure (1)..(601): unsure at all n locations
  Clone ID: PAT_TA_81269
cgggcgcggcggcgcgagcggtgcatgtcgcagagctgcttccccatggctgtgctgcgtcacggtttggtttcttgtgcggagaaagctttcctttatgcggcgtctgggtcggcgacgacgtcgtcgttctcttttttcttttgcttcggtgtttcgtgcacaacatcaccgcggacataactgacggccatctgttgtagctctggacactggagatgccgagagggtcacggggtagacgtgctgcagagcgtgttgttgcatgcagatacagtgcgagggagctgtgggctgtggcggaggtagcggccgcggttgctctctgttgaagnaagacaggaatctgggatgcccatgcgctccggggttttgcttttggcggaaaggcntggacgtggttacaacccgtgggccgtggnttcctttcgtggcccgctcctgtctanggccaatctccggcgctntttgggagaaaataaaccaacctttntgggccaanaangtatcnacatcttccnanaatcccaccntaaaaaacaatcnccaactttaangtcccnatttacctttacacanttagtttngcannaaattnttg

SEQ ID NO: 81270 - DNA, 649 bp, Triticum aestivum
  unsure (1)..(649): unsure at all n locations
  Clone ID: PAT_TA_81270
atcagttgaaaacattggcctccttgggctgacaaaagttggaagtaggagggtgatccagatatcaactgggtttatgatattcttctccatatttgggaaatttggggccttctttgcatcgatcccactgccgatctttgcagcaatttactgcatcttgttcggcattgtagctgctgtgggagtctcgttcatgcagtttgccaacaagaactcgatgaggaacatctatatcatcggactctcgttgttccttggcatctcggtccctcaatacttcaacggatacacttcttcagctgggcggcacggacctgcccggacaaatgctgggatggttcaacgacattataaacaccgtgtttgcttccgggccgacggtggcgctaantgtcgctccgtcctggacacacgctggagtcaangggctacaaggcgaccgggggtcnntgggtcaagcgttcctgcccgccataaggatatcggncccanaacaggantcananttccaacangtcatgagcatccaaacgattcgggcnancaaagacgcgtaccncactgtcagtaanccggatctgtaccaaccgnaattcggngtcaggggaatggaaaanntaggaatctgttnccttgaaaaagtaaa

SEQ ID NO: 81271 - DNA, 348 bp, Triticum aestivum
  unsure (1)..(348): unsure at all n locations
  Clone ID: PAT_TA_81271
aaactaacggtaattgctggtggatttttggcagacagaatataccgatagaagttttgcttgtctaattgttgatggtggctagtaggagcatatactattcctgtacatcctgtttaacttgtcgctgctagacgatttcgcaaatgtagtatgtagtggtagatggatccgataaattttctgtaattttgacgaggtaatcaggcaatcgtctcgagattgttgttgtatgggcgacagtattttttcattgtttgtacaatccttttaaaaatcatcgtctggccttgagcctttatgccatatgggtatatgttgattcccctttttcaaaaaaaancaaan

SEQ ID NO: 81272 - DNA, 530 bp, Triticum aestivum
  unsure (1)..(530): unsure at all n locations
  Clone ID: PAT_TA_81272
gccactctccctactccctccctctctctctatctccctctctctagctccccatgcagcagcagcccctcctcccttggagctggcgaccagccctcccaagctccactctcaccttggcaagctctcccatggcgtctccccctcctctacggcagtaagatgaccgagagatgatgatcgagccagtgatgtggtgccaaccacaagacgcagttggtggacgacctgaagaatggacttaaccaagtgggatactcgccgagcgagtaccctccccaagcaaacactacttaagtgttaaattaaaggtactccttaaggatgattggttgatggtgtgacttaacctccatccctgcaaccgggatagatggtccagtgggttactgcttccgcangagaagacaaggaggatancgtggcannttcgcaagttactcggtttcccgttagtattccgcngattaaattaaggtatattctgaacncgataatgtacccaanggactctaattgnggatangctt

SEQ ID NO: 81273 - DNA, 328 bp, Triticum aestivum
  Clone ID: PAT_TA_81273
gttttgtattcatagatgcttaggtccaactatatcaacgacatcaacaactaaactttttagtcccaagcaagttgggtctaactgtatcactgatcttaaaggtttcacaaagatgaccaattacatgccatttatgagatgacataatagcttgagatggatgcatgaactatatatggcatgacaggagaggaacagagaaagcgaatgttgtctgaagtctaagcttgaacatcagatgtgactgctcttttgttcagctacagtgttcaattgggattgttttacttcatttgttttaaaaaaatttactaaaaaaaaaaaa

SEQ ID NO: 81274 - DNA, 378 bp, Triticum aestivum
  unsure (1)..(378): unsure at all n locations
  Clone ID: PAT_TA_81274
ctccgtgcttccaagaaatccatcgcccaggagctagaagccgctcggttggctgccaaggttgctgaagaaacttccattactctgagagcccagcgcgacagagccatggataaggccattcgggcagggcaaatcttgatgaggagacccggcgtggttgttcccgaaagatataaaggctgacgtgaatgctgctcctgattccttngagtcgcccttcctccgtcgattgctccctgaagaaagatatcacgaaataagagaaatattttgccgtgcttttgagcgtgcggttagcatggtccggacattttgtttagaggacaccggttaacacttngaatgatattgttgttcccccttaaaaaaaaaaaa

SEQ ID NO: 81275 - DNA, 654 bp, Triticum aestivum
  unsure (1)..(654): unsure at all n locations
  Clone ID: PAT_TA_81275
gagacttgatgtcctcgcagtttgtccaatagatctcctcgccgcctcacccgtctcctcctccgcagcttccccgcgatcccgaccatggagggcgacggtaccaaccttgatgcggcgatagagtcgctcctgaatgtcgagaagcagatgaggctggccggagatgtcgccggcactcgggaaggccgtcatcgacatcgtcgagctctgctacaaggccggcgcgtggaagacgctaaacgaccagatcgttctcctatctaagaggagaggccagcttaagcaggctattactgctatggttcaaaaagcatggagtacattgatttgacaccaggcattgacacaagcatcgagctaataaaaacactgagcagtgtctctgctggcaaatctagttgagatagagagacaagattgataaaagnttgcaaaaattaaagaggacanggacaattacaagntgctgattgatcaanaattgcgttgaacattggtctatggaaagacgggaaatngcttaatctnaacagnccgntatcctgatnggaagattgtaganaaaattnncaggaaatcgncaagtttgccattnccaaggaaaaanacaaggaggaatnttaagtnccgaantctcctcaatnanctana

SEQ ID NO: 81276 - DNA, 662 bp, Triticum aestivum
  unsure (1)..(662): unsure at all n locations
  Clone ID: PAT_TA_81276
gcacggcgggctttagtgccgtgctgggcctctattttagtctatagtcacgataaggcccggcccggaagtaattcgtgctggcccggcccgacactttgaagcccgaagcacgacgggctcgtgccgggccagcacggcacggcccatcttgcagcactaatgtcgataatgtttgggagttcgctcgctcgatcgactcgatgatcgtgtgcgtgagggcccangtgtgaattgtgatgatgatgccctgcactgccactgcatccgctgggaaccaaacagcggcagacatcaacagcaatcgcggcgccgcgccgcgtcgattcggcgcccancgacggaccaccgagatggggataataaggaatacctancgcgggcgctgccaatatctcgcgggttcaattgcggttcaaggtctcttggttctgaaatgtgaatacaatggangactanctggacatatagattcatatatatgcaactncatggtgagaactctccactgggtatcaccaatacttncactcgccagggntaccaaccacaattcagaaacggattacctatgatacatggctggggcattancccaaactaatcaatactcactaaaantaaaatcggtgcaatagtcgtaatggcagaaaaaancaana

SEQ ID NO: 81277 - DNA, 256 bp, Triticum aestivum
  Clone ID: PAT_TA_81277
tgggactgaatgaatgtctgttaggttatgcattgtaaatctttgagatggctgtcatttttctctgctttctttttcatcttagtgtgtaagaaagtccattgatttcgtggacggaatatgttaatctgtggattactgaaatccatccacatccagtctttctcaaaacagaattcatgtacacgaaatgtctagatgcatttttgtttttttattcaagagggacggaacatcatattttaaaaaaaaaaaa

SEQ ID NO: 81278 - DNA, 629 bp, Triticum aestivum
  unsure (1)..(629): unsure at all n locations
  Clone ID: PAT_TA_81278
gagaaacttctctcttgggtagtacctgatagctgacactcttctgtcttgtgagaagcactgcttgagaccagcaaatgattccttttgcctggtttctaaaggaacctgatagggtgaaagactgcaatgttcctagagcttgattttcaatacagatgtcgatagcctctccaagagtcattctaaaacccactctaaatcatcatccgaagagtcatttgcataaatttgactccaactccaacagtttttctatatcctgggatatttttcattaaactctctattcacaataattagttaggatatggagagtcttggggatgtgtcaacgtaagctaggatattcagcttcattacgcagcctggttgaggatattcgacgtacttggtcagtctgaactgtangcgcttctgctctcaaaatcaaaatcctgtttaaccctttgcccagccggtgtacaagtaataccacgctgcaaaaggcnaaatggntttgaattgtcaataanaaaatcttttgtgtgggcctggacaannaaaaaaanaaaaacncagggggccggnccattnccaaatgagnctataccgnccaaggcgcttaagtcttacggaaaccggtacca

SEQ ID NO: 81279 - DNA, 458 bp, Triticum aestivum
  unsure (1)..(458): unsure at all n locations
  Clone ID: PAT_TA_81279
acgcggagtacgcggtggcaaggaacgccgccctgggcggggccgggctggcggagaccggggtgcacgggtggcgccgcccgttcgtgacgcacttcacggggtgtcagccgtgcagtgggcagcgcaacgagcactactccggggacagctgcgaccagggcatgcgccgcgcgctcaacttcgccgacgaccaggtgctgagggcgtacggtttccggcacgccagttcgctcagtgacgacgtgcagccactgccgttcgattaccctgcaaaggcagtgactagctgatcgacgtgaatttccggttgttattatactgtctatccgtcccttgcatgcatctcgcgtacaaacagctttgcatgctggttgctcctttctggactcaagtggtgtaatcnctggttccgttacagtttaacgaatcatgctataatcaanaaaaaaaaaaaa

SEQ ID NO: 81280 - DNA, 507 bp, Triticum aestivum
  unsure (1)..(507): unsure at all n locations
  Clone ID: PAT_TA_81280
ggatgttccaaccattttgggcaatttgtccatcatatcacctttctatgccccagtgttcaaacttaaaaatccgagggtgattgtctttataaagaaacttttggtaaaaggtccccaagttgcacaacattttgaaagtcaaatattaagtgcaatggataatttcattgtaagttcacccgaggatgtcatatttatccttttaaatttctttaaaggatcaaagaagcaaatatttctttgtagcactgatggaaatcatctggattcagtggagaaaacttgcaagttctttgaatcaaaattttctttgtggatagagttattagatgatacagccggcactggtaatcgatctagtaaccaggtcagtgagaaggaagcgctatactgtggggatctttttctgctaccctaacatgaaaggtgtcatcaagatatttgtcactgctgaggaantaatcccggcactgaagtgaattttgccgaaatncccngtacata

SEQ ID NO: 81281 - DNA, 450 bp, Triticum aestivum
  unsure (1)..(450): unsure at all n locations
  Clone ID: PAT_TA_81281
gcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaataatggatgtgtgaattcncactaattaagtaatgcataaataaacgtatcaaatgtcgccccttcttgcacaaaaa

SEQ ID NO: 81282 - DNA, 264 bp, Triticum aestivum
  Clone ID: PAT_TA_81282
gtttcttgctcccctttcagggtcccgatcgctaggctagctgcagctcaggtgcttgtctgaggggctgcctcctcgttggcagcctgctgttggtgcatctggtgattaataatactactatgacagagccatatgctctgtgaagagtattagtagcagcgctcataaaagctacagttccatctattttctcagctatgtaaaacttccaaactgttcatgcttaaaactgagggttttcgtggtgtgaaaaaaaaaaaa

SEQ ID NO: 81283 - DNA, 543 bp, Triticum aestivum
  unsure (1)..(543): unsure at all n locations
  Clone ID: PAT_TA_81283
actgagagcgacaaagctagctctctccagggatcggattcggatcaccatgccgtccaccgtgaactccgcgtccctcgaccagaaccttgagctcgccaagcaatgctcgcgagaggccgccctcgcagggttcaaggcagcagctgtcgcgaccgtcgcctctgcagttcccaccctggttagcgtcaggatgctgccatgggccaaggccaacatcaaccccgctggccaggccctcatcgtctccacagttgctggcatggcgtacttcatcgcggcggacaagaagatcctctcgctggcgaggcagcactcgtacgagaacgcgccggagcacctcaaggacacctccttcangggcacggccgtcgcacccaggttcttcaggcttgagcganagacatcaaactaccgcctanctagctggaccactattctcagnggccgccgatcattctcaagtatataactactgcaacatatatatagttacagctagtattnggaccggnntcgtcatgatgnctcganaatgtatgg

SEQ ID NO: 81284 - DNA, 477 bp, Triticum aestivum
  unsure (1)..(477): unsure at all n locations
  Clone ID: PAT_TA_81284
ctggaatgttctcaaatggaagttagggtgtaagaactatttttcctgtgatacctgcatagaagtattctaacattgatttcttgatcttgcagagtgaagctctggctttttgtggcatatgtcgtttcttttgtctgtttagctggatccgtgggtttattggtgcaagatgcactgacgaacaagggcccttctgtctggactggtgttgctggcgttctgcaatgtgttcttgtgttgataagcggcctggtgtattggacatgccactcagaagattaagggcgtaatgtcatgagcagacttgcaaggttggtcacagttgtgttaaggaaattattctggcaacatatgattttgtgtgatggaaatgacggacactgttcactgctgaatgggatgacagatgttcaccgtgcatatctgactttggaaaatganttctaacaccggtgcagtgttancccaaaaaaa

SEQ ID NO: 81285 - DNA, 363 bp, Triticum aestivum
  unsure (1)..(363): unsure at all n locations
  Clone ID: PAT_TA_81285
aaacaacatatcgacaaagattacaaacaccacaattgcaaggcctcatccaggagcaaaatcccccaatcgatctctgtggtcttcacatcagcgaggcaatacacgtcctgaactacgagctcaacaaccgaagaaagatcgtgagatcaaccggtcgccgactccaggttatgataatatcaagcgcccgcaccccagcaaggctgactgccgccgtcgagcagtatctcatggaacacggccttctgtacacgcangtgcaaccaggcctgctccgcatcctgctctagtaatggaactggtcgtcctaactgttgttcacaactgggttnagatgaaaaagaagggaaaaaaaaaaaa

SEQ ID NO: 81286 - DNA, 648 bp, Triticum aestivum
  unsure (1)..(648): unsure at all n locations
  Clone ID: PAT_TA_81286
gatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaatattgcctgagacgggaccaacaggaanggatgccctcccgcgaattgaaagctttcagaataaacccgatgcttggcttccgtgggtgcagcttgggaaatcgtacctgaattgacaaagatcaagcccgggcaattttgaagcgcatacatgacaacaaggtgtcaagtgtccaagaataatggtcctcctgttggacacacaggaatgggcanaantaccctancgcaattcnaaaatgtcncatgtggcagntacggtnaantggacatgatgaatccaggnaccggggtataanacgacagcgatctcctcgacacacnacaatacttggaaangatattgaattntctcactcn

SEQ ID NO: 81287 - DNA, 565 bp, Triticum aestivum
  unsure (1)..(565): unsure at all n locations
  Clone ID: PAT_TA_81287
aggaatggagcagacatggagttcctctctatggccttgcaggttgcttctcaagctgtctattctctacacaagacttccactagagaacatatcaagaaggcagccttgcgtggcttcaatgccatcagtgcggaggttctatgcgagctgcgttacaatctaccgcggacgtacaagttgcacaagaaaaaagagattgacattgcagtcgatctgtggcgctttgttcctaacgcccaacgccgcagctagcgcgctcgctaatgnggccgaggggcacaggtgatggagtggaactgaacatgaatggaaaatgatcaaatggatgtgtccaaaaggctggacttgatcgaagagatcccaggcgtcacgcttggtgtgctaangtctccttggtgccgtaaggatactcanaatttgggcnaactgtgtaaaatttgtcaatttgtgggcacagatatgccccagtatgtgcacaanaatgcttgtaggtattgncccaatgnctgtcaacctacagantaaatattaaattaattgggganaaaaananaanaacatg

SEQ ID NO: 81288 - DNA, 667 bp, Triticum aestivum
  unsure (1)..(667): unsure at all n locations
  Clone ID: PAT_TA_81288
tgtcgctgtacttgatgctacctttatcatctggatattttcatccctctctagaactttggagaagctgcagctgcggagaagcatggcaaaacttgaattatatagaaagtttacaaattctctggctgtgtcagtgcttatctcaatcgcttggattggctacgagctatatttcaatgcaactgacccgttgagtgaactttggcaacgggcttggatcatcccctccttttggaatgtcctttcctatgccctcctcggcatcatatgcatcctttggtctccatctcgcaatccaacagggtttgcatattcagaggatgcangtgagggagctgatgaggaanggctctctccaagtaagcantgcggtgaaaagaaccggagatatggtaaacatgcatatcttcccggaggataacgtgcatgataagttttggcctgaatgcagctgtactcctgcanaatgcnagtgaaatacntttcctccggatcacactaactgacactctnaagatgcgtagatcanattcagggggactgtgttnagantgncaaganagttactnnatgtgcaccaatnaaaaggcggaaatacncacgaacaaaaaggttgcctgaacctggaggactacctagnatgatgtcatcannctaanccatc

SEQ ID NO: 81289 - DNA, 324 bp, Triticum aestivum
  unsure (1)..(324): unsure at all n locations
  Clone ID: PAT_TA_81289
ggcatactcgaccctcgcaagaggaaagcagagaagaaacggcgcaaggcgaacaggttcagtgtgctgaacgacatggacgcggactacgatttcaaggtggattaccagatggaggacgccgcggatggtgaagacgaagacgctggggatgaagccaaggaggataatgagccgatgactggcgtcgacgattcgtgaaattttggccccttcgtcgtgtatgaggtgatggctangctcagcgggggttgcaaaattgacccaccaagttttgtgctcagtttgcttgtttaatgaaaagattatactaaaaaaaaaaaa

SEQ ID NO: 81290 - DNA, 501 bp, Triticum aestivum
  unsure (1)..(501): unsure at all n locations
  Clone ID: PAT_TA_81290
gcaagacgatcgtgctggggctggggagggacagcgacgaggtgtgcctgccgtcgctggagctgctgttcgggaggtgcgtcatggggtcgctcttcggcgggctgaagcccaagacccacatccccgtcctcgccaagaaatgcatggacaaggagctgcagctggacgcgctggtcacgcatgagcttggactgcaggacatcaacaaggccttcgacctgctcctgcaggggaaaagtctgcgctgcatcctctggatggacaangacaatacggnaaaggnacaagggcggnccggaccaatccttcctgtctctgaataaatttgccctgttttttcagcgaggcgttgctgaaagctggtgttancggcgaccaagactatctgttcctgaaaccctgtgtatcagtannttcgttgtctgaactgattaatcctatatcatagattagactctccaacaaccgctntccctgagaaatgatcacanccttttt

SEQ ID NO: 81291 - DNA, 640 bp, Triticum aestivum
  unsure (1)..(640): unsure at all n locations
  Clone ID: PAT_TA_81291
cttccggtaagtagctacgcatggccttttgttattgtcttcaggaatcgagtttgaatatagccatgctttttcttgtttgctgtgatttgtctgaaactatgtgatctttccattacaattaatttggttgaagcagcttcctgcattagaagaatcaagatttttaccttgttttttttggtgcaataggaaccaagtagattctgaaactttcgacaaagggatgagtgcttgcactactactattttgtatcagccatctgtcacatgcagtccttgttttcttccattgtcttgctgttgagttatccgtcttcaacctgataactcatacagatctttggttaaagtaaatttatggggctgaacagaatgcatttatggcatgtttcctcctcatgtagctttgtagaatcattaagtgtcgctgcctttcttgaacatatgtaccggtgctttggnaaggtaactgtatgccctaactgttctcntcattttgcataagtaggcacacacatcaantaccgatcaatcatgcacactgtttgccacaaacgttgatgnatggtcgttgaaatacaaaataccatcntggttgggtnatgcanaaacattncaagtncgacantaacagntn

SEQ ID NO: 81292 - DNA, 659 bp, Triticum aestivum
  unsure (1)..(659): unsure at all n locations
  Clone ID: PAT_TA_81292
attcactatgtgttgtaggtatccactaactttgttggactaaagagcccagaccaatcgacccattttcgtggaggtcatcatccttctttgttgagccatctgggtgaccttgcaaattggataagtgccaaagaatacctactgcatatgaattttgagcctttatcaggagctgaataagaactttgttcatagaatcacactgtttatctatagacacccacaatagaatacctactgctcattatggagaaaacattcttgtgatacccctcacatggcaagccacaattgtgctaagtgtgaagatataacaatttcttgaaggggtgttaacataaatatgtttgttgaattccacaatcacttaagcatcattttactgttagttgaattgcatcccccataattttacaagtgtgctaactgctagcatatcatacctgatagatttgtangaactgnaagcctgtttaanaagatttcancaaattggntgacatcacactcaaaatcnccancttgtaactnaaaaatgtnaaaagnggacaaaggatcagtcaactgtaattttaaaanagtaattgggnantttnaactnncattattcagccccggttgtcaaatcaagntgcngattncaattgaaaaaaaan

SEQ ID NO: 81293 - DNA, 580 bp, Triticum aestivum
  unsure (1)..(580): unsure at all n locations
  Clone ID: PAT_TA_81293
agctttaaagggagctcaggccgctgttcaatacatggctgaatatgttgccaagaaagccacaaggtcacaaccgatgaagacaaagaagacctgggctcagttctgctttttctcccggcctaacaaaagaaagcacgaccgaatagacaccgcgtcgtgattcactgtgagactgatgaacattaagctgctgtttcctcaactctacacttctgaagagaactatcgggtgcatcgccttcgatcgctaccattgtgttgtatgggtcaacaagatgtgatgcccagaagcttttccttggacaatgctgcagcctgcagcttctaacctgtagaaccaagatggtcaggtttcaccgaacctactcactcttgtttcaccaggccanctcaactccgaatgaccgctggaagatccagtcttacttcgcttaagaatctaaaatggttantcnccggccttttcgtanatcagacactgagaagagaacggaagttccgaantcggttgccctgagtgnactttnatattaccgtaaanaatcntcngggaaanagactggtatacnaggttctt

SEQ ID NO: 81294 - DNA, 274 bp, Triticum aestivum
  unsure (1)..(274): unsure at all n locations
  Clone ID: PAT_TA_81294
ggcgcacccactgaagcctgttattcactgaggtccgagtatgtctttgggtaatatgtggactggatggatgggtcactgttgaatgcaggatgtagcatcatcatggtgaggggactgagtaatatggacatgtatcttgcgtattgtgcaatgaatgtgttggctgttgggtcgcttgcctacgcattctgtaagattgcagttaccattangaactgaactcaactcgactgaattaatatcatttggctctactcgtaaaaaaaaaaaa

SEQ ID NO: 81295 - DNA, 656 bp, Triticum aestivum
  unsure (1)..(656): unsure at all n locations
  Clone ID: PAT_TA_81295
tttatcctgacaacgtgcctgcctatgactccttcctcactacgcttgtttcaagtgactcctccacggcgctaccggaagcaatggagtacctaaatgtcttgagcaggcacggctgttcgccaggagagaagttcttccgtgctgctcttgctgcacaccttgatgcacgacaattgcgcggagccatgaatctctgggatgactttgttgggcgtcgaggactcgtcccagatatggaaatgtacaacacaatgatcaagctgcagggcagtctcgggcatgctgagctgatagtgggttatctcgacgacatgatctccaatggagtcttccctgatancaacacatacaatgtggtcctccaacntttgttgaagggaaagaancaccgagaggcanccgcaatattancgagatggcaagaacaatgttggcaaacaaggaaatggtcactncactccatgttttggtaccactatggaaacnggataaatccgggctcatggggaaaaggctgcaccttaaagatgtngaaatctnttcaaactaaggtaaagtactagnatcaaantcagaaaanatgtcggnacantatnacaattcaacnaacagccgaaggtanagggantagtacgctaaagaggaatatnttc

SEQ ID NO: 81296 - DNA, 594 bp, Triticum aestivum
  unsure (1)..(594): unsure at all n locations
  Clone ID: PAT_TA_81296
ctttgcttcctgatcaatgtgcacgttgaataaaaaatagcgttgacggtcgatctatcttgtagctgtccttttgtttcctgagttacatccttctgaattgcaagcgtctcctccagtgctgtcgcttcccgctttctcatctcatgtagaaaccaatgttctaggtctttaatcctttgaagagctgatcgcagatctctttcagggcttcttcttcttcctctgttagtttcttcggactaatacttgctngaaaattcagccagatttttcaatttagttccactagctaatggncaaactcgaaatggncngacccttcctcagaacgttcaaanagcaggagctacatccgagctgcccttttaagcagcgatcaacgtattgtgaacattangatacntcacatacaacanctaccgagcatgcttgtgtacntccagatcaanacatantatcacaacatgattgatgaacaaaatgcaacgaacacanacggaggnttctcaaaccaagacnnnccgttaagggtcaacangtgacacggagccccggtgcaccggacccccggaaggctcgnngagggggggg

SEQ ID NO: 81297 - DNA, 497 bp, Triticum aestivum
  unsure (1)..(497): unsure at all n locations
  Clone ID: PAT_TA_81297
gcgcgccctactagacgcggtggtctggtgcctcgcgcgacctctccctccagccggcgcgcctctccctgctgtttccccaacttcttcttccctttgctgctcctccacctctcctcgtcccccaaactgcttgctgcttctccttctatgaacccttgctgctgctgccgcttcttcttgcgccctttgctgctgctgctcctcttcttgcgtccctgctgatcctctccttcccctcactgctgctcctccttctctccaaaaactgctgctgtccctctcctcacatccctgctgctgcatcttcttcctcctttgaaccctactatggtgctgtccctctccccaacgaactgctgcgtcctctctccttgctgcccctattcttctcctgaataaaatggtgcggtnnctctcctanttctgcaatttcgnaaacgcaagnaacttgnggaaaatcaatttggnctnagangctaaagtaaatcaattta

SEQ ID NO: 81298 - DNA, 561 bp, Triticum aestivum
  unsure (1)..(561): unsure at all n locations
  Clone ID: PAT_TA_81298
gccacccgtgcccctcgccggcgggcaattgccccgtgaacgcggtgaagctggcggtgtgcgcggacgtgctggacgggctgatccacgtggtgctggggcagtcgccgcccaagcagccgtgctgctccatcatctccggcctggtggacctggacgccgccgcctgcgtctgcctcgccatcaacgccaacgtcctgggcatcaacctcgacgtcgacgtcgacctcacgctccctgctcaactactgcgactgcaaggtgcccaagggcttccctttgcgactgattgaccgtnaacggatggcaattacttcttcctgcatgcgtacgttcaangctgcaatgcatgcaaagcatatcattncactacccattgtccttggtgtttggtttttgataaacttacacccattcaatggggcattncactatccncatgtcatgttaagggcaataagntttctccttgcncgnccanattaactgtcattccaacgtgttgccttgtgtataaaacacattcctttaataaaacacatttntaanaaaaaaaaaaaa

SEQ ID NO: 81299 - DNA, 495 bp, Triticum aestivum
  unsure (1)..(495): unsure at all n locations
  Clone ID: PAT_TA_81299
cgaaaatcgcagactttggacttgcaaggctgctaggagaaggtcatactcacaccaagacagctagagctgtcggaacactaggttacatggcacccgagtatgcaatacacggccgcgtgtcgcccaagatcgatattttcagcttcggtgtcttggcctccgaaatccgtaactaggagacggaacagcattctgacgatcgccgatgaagttgaacttattagtgatgtgttgggaactgctgggacgaaagggacggtatccccagatgataaccccaccgctgggccaacacgccccgaagccaagcattacgatcatgcacatccggttgatgtnatccaattccgaccctgacgacaggccttacatacaccntcatttccatgtttaccaaggacaacacnggatttaanaacccggcaactgattcttcctttgggaaaaaanggtttcttcccccgganatacgttngattcacccngganagt

SEQ ID NO: 81300 - DNA, 620 bp, Triticum aestivum
  unsure (1)..(620): unsure at all n locations
  Clone ID: PAT_TA_81300
gaagaatggacgaatgtcttcaacccggcattttcatattatgcatactactgctatgctaacttgtacacactgaacaagctgcgtgagtcaaaggggatgaatactatcaaattccgtccacatgccggtgaggtaaaatatcttcaacattccagtgttcgactctgacattccggatttatgctttctctaattgggtatggcatgcaggctgggagacgttgatcacttgggcagcaacatttcttctttgtccacagtatatccacatgggaatccaatttaaggaatctccctgtgcttccaatatcctgtactaccttgggccagattggtcctggcaatgtcccctcctccagcaacaccccttgtttccttggataccatccggaccttttcccnagtttttcccaacgagactgaagtctccccgtccaaggtgatccatggcaatcatcctgacaaaagaccattggggggaagatacacatgctcctcnccatggantcatcctgggntcaagtgaatngcaaattcgggtacatcaggttcanagcctcaagnacatggttggaagacacacagaagcctaggatgtncaaganaantncacacag

SEQ ID NO: 81301 - DNA, 431 bp, Triticum aestivum
  unsure (1)..(431): unsure at all n locations
  Clone ID: PAT_TA_81301
ccccaacgacccacacgggttcttcacgcaggacccgtggtccgagaccaccggcgagctgatccggctcgtcagcgtgttcgttgtcgacagctgcgtcgccgtcgcggcgccaaagaccgcttgattcggtacgtacacacaggtgccgaggtgcttgttttgggtgtacaaagacatcgacagttgaggcgacacgaccaggaagtacatcaaagattcggtcgtctgcatcctcttccgattaaaactaaatgataccagttgcgttaacgtngagaatccggttacaatatatttccaatgatattgaattatgaaatataaacatttaaattgatatcnccgtgaatcaaattccnaattatggtattnaantattaaatttaattgaatgtaagtttgataatanatgttnaaaaaaaaacggg

SEQ ID NO: 81302 - DNA, 380 bp, Triticum aestivum
  unsure (1)..(380): unsure at all n locations
  Clone ID: PAT_TA_81302
aggggacggtcacggacgtgctggtgcacgactacgagcgggaggtggagagcctgtgcgcgcgggagttcctctgcgacgagaaccgcgtggaggggaccggcacgccgtcgctcggccactacgtcgtgcgcggcggcgccgccgccaaccgggaggccttctgcggggcgccaccgaccgcgaagaaggcgaactagtcggtcagggaaacggctttccagtttggtccttgtacttccgatnnagatgggttgggtctattgtgtgcgctttgggcatttttgatgcaccgtttgtaaatgtggcgtggctccattaagacaaaatgacacttngtgaacaactgaacaattattttttaagaggttcccggcatc

SEQ ID NO: 81303 - DNA, 575 bp, Triticum aestivum
  unsure (1)..(575): unsure at all n locations
  Clone ID: PAT_TA_81303
ggccgctgctgttgcggcggccgacgacatctcggagggcgacaccgatccgctctacagagcttgcttcgaagaatgtcaaagaactggcaccatgaaagaggattctattaaacattgtgttgtgctgaccgatgaccagcctagtggtacagcatggtacgcgcacgagccattgtacttgaagtggaaggagtggaactgcaacagcgaatactgataccattgtatgatggaaagagagcaggaaaagggaagagcttggactagggccggtcaagtatcatggcaaatggctctcaaacgtgcttctgtgtttcaagatacctctactccatgacctctttctgcactcctatctgctctgacctcctccgtgcattcaatgggatggtatggtttcctccttgctttcttacaactgcctccttatccangaanccagtgacatactacaatacaccggattatggacattaagtctcctgggcatgattntggtcngggtgcattatcnaaaggacgctctctcnnanaagggtcnacggagngnagaaaatcccnagtaggaggtt

SEQ ID NO: 81304 - DNA, 185 bp, Triticum aestivum
  Clone ID: PAT_TA_81304
ccgagatgtggctcccgatcgagaactacttcctggcggcgggcatggtccaggggctgattgattttttttaaatctactaggggtgtgtgattattttgggccccacctgtcggaaacgccctcaaccgcgccaaattacatgttcagtgcaatttgcaacacttttactgaaaaaaaaaaaa

SEQ ID NO: 81305 - DNA, 601 bp, Triticum aestivum
  unsure (1)..(601): unsure at all n locations
  Clone ID: PAT_TA_81305
ctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctccnaggatggccgcacccttgcggattacaacatccagaaggatccaccctccacttggtgctcangtccgtggtggcatgcagatatttgtgaagaccctcaccgggcaagacatcaccctggaggtggatcatctgacaccatcgacaacgtnaangcgaaatccaggacaaggagggattccccnggacancaccctcatctttgngggtancanctttaggatggcgcacttggnggacanaacattcagangatcaccttcactggggcccntcccgtgggggcataaccctgcanggntgtttgcccgggttaaaatccctctcgtgtctaagancggtcattt

SEQ ID NO: 81306 - DNA, 584 bp, Triticum aestivum
  unsure (1)..(584): unsure at all n locations
  Clone ID: PAT_TA_81306
gccaggcagagcatcaacgtcccatcaataaatccatgcatcaattatttaatgctaatatccatccatgttgctgttagcctcgtggctgcacgaccaggcacggctaggcgttcgaaatcggtcgcttgggtgcagtgtttgggagttcagccaggctaattaaagtgcaagggaacctagcccaggcgggtttctttttcacagcgtagcaaccaaacaagcatgcatgaaatccaaccacaaccccaagccacgcaaaagatgctcaacgacgcaagcaaactgggcttanactccccgggtcacacatacacacgtgtcgctcgcgctatacatataaccatcccaaatctccaccctttgtctccctcccaagtgacacgcaccccctaatacataccccaatccaacaatagtccnntttggttcatgggtaaantantgggtaattgggancaactacccaaaantcaaaaggaggtngttagntaatcacnnaccaccaaaaaantaccacaagatgctaatggnaatctccgggacacaataaacttttcccgccnccgaaanatctccattcc

SEQ ID NO: 81307 - DNA, 306 bp, Triticum aestivum
  unsure (1)..(306): unsure at all n locations
  Clone ID: PAT_TA_81307
acggcggccaccatgacaccgacgtcgtcgtcgagaagatcgacggcgacgtgaagacagaggcggcaccggcagtgcccgaaggaggagaagaaaggcttcttggaaaagatcaaggagaagctgcccggcggccacaagaagccggaggacgctgctgcggtgcccgtcacgcacgctgctccaagcaccaagtgcacgccgccggcgccggcccccgaggaggtgagcancctgncaaaaggagaagaaagggctgcctgggcaagatcatggacaactgcctggtanagnncaaggggaaag

SEQ ID NO: 81308 - DNA, 371 bp, Triticum aestivum
  unsure (1)..(371): unsure at all n locations
  Clone ID: PAT_TA_81308
ataagcccggcccggccggccgccggagcccgtcgtcactcgccggccaccattagcagcagtacctgaccaccatcctgtctgtcccacgaaaaatgctcctttttttcccgttcttcttcatcttcttcggtcctgttttctcagcgtcgtgatggtgagggatgattcgacgtacggtatctccccccacggttttttcttagtaggaattattaccactgcccgcattcttcctctgatgatgatctggattanccggttgatgtaatgcatgcatgcggacgcattgatcttatcatggaaagattggatgtgaaaaattaaggacggttttttctnaaaaaagagaanaaaaatcctaggggggg

SEQ ID NO: 81309 - DNA, 602 bp, Triticum aestivum
  unsure (1)..(602): unsure at all n locations
  Clone ID: PAT_TA_81309
ctggaagttcttcgtctctcgcgatagaaacagagtcttcgataactcccagactccccaccgcggcaccgccggtcccctctcctctctttgccgcccaaactccggccacgccgccccaactctggccgctccccttccctgccccgcatccctcgcatccatccaggctccaattctgacatctgacaccgattcaaccacgctaggatacagctgcacggtgacggcggagcaggaagtagcagcggcgaccaccgatggacgcgcaggaaactagcacaacaagagcgcacaagatactccgctcaaacacaccatgtcntgggtggcataccatggctgggagacgagacggangtccaagtgtacccacattatatanctcttgggagatttaatccccctaaaaaatgatacgttgtgtcaatgttgatacattcaagtccccgaggnacactactanaagaatttgcatttacatttttacacatccggtggganaaagttttanttaaggatatatntgttgcaactgcattaacattgnaatttgcaagattctcggaatacgntacattgcaanacgttgatatnattgn

SEQ ID NO: 81310 - DNA, 624 bp, Triticum aestivum
  unsure (1)..(624): unsure at all n locations
  Clone ID: PAT_TA_81310
cggccgcatcgggcgctacctcaagaagggccgctacgcgcagcgcgtcggctccggcgcccccgtctacctcgccgccgtcctcgagtacctcgccgccgaggtcctggagctcgccggcaacgcggccaaggacaacaagaagacgcgcatcatcccgcgccacctgctgctggccgtccgcaacgaccaaggagctgggcaggctgctcgccggcgtcaccatcgcccacggcggcgtcatccccaaacatcaatccntgctgtcccccaaagaagncgccggcgccgcccgagaagganccaacaaatccgccccaagaagaagncgccacaaancccccccnaagaagaaaccgcaccaccaagganaccntcccatccccatacctaccattatccatggacaaatganatatcctttgttngatttgtangtatgccngtancnccaatggccnnaaatgggtgggaatacatatacggaaatnanccttganctnggtatcccggtcaaaaacaaggtgtcgcattgggggggccgtacnatccccaaanantctataccccnaaggctcnttaagtctatggaaaccnggtacantancctgaaaaaccnttcag

SEQ ID NO: 81311 - DNA, 641 bp, Triticum aestivum
  unsure (1)..(641): unsure at all n locations
  Clone ID: PAT_TA_81311
ctgggctacagcctcaatggcaccatgacggcgaccattacttttgacaacaccacccggacgctggaggccaccctgcactttgattacgatccttctcttcctaccgctcggatcaagacgcagttacctgatcgcctcgatgacttgctcccgccggaggtgtcggtcgggttctctgcggccactagtaactacactgagctgcatcagatacactcttgggccttcaagctcaactatccgcacccaagagccaagagaaacacctacgtgggctaaagaggatccaaccaagagcaaggtgatgaggtgctcccgtnaagaaagactggccttccttcattattgggagganatcaatgcgatcgccttggggggaatgtggtccatcttgtcatggtgtaagtggagaanaaccgatcccttngggatgggaancntcntaaagaattannccacactgttcaatgcaacgacantctccngatgaannattcgggccggtggtccgtgtggaacatgggaccnaagacgacaaccgtacctgaanagtccaaggancagggtaataaggctctacgattgancacgcganagcagnactgcagancaagngggcgngaaaaaattnttttgnn

SEQ ID NO: 81312 - DNA, 623 bp, Triticum aestivum
  unsure (1)..(623): unsure at all n locations
  Clone ID: PAT_TA_81312
ctcaagcaggccaaggtcgccgagaaggactacgacgagaatgacctggcatacctccagaagaagaaagatgagcaaaaggccctgaaggagctgaaggccaaggcaggccaagaagggtgcgctgggaggatccggtctcaaagaagagtgggaagaaatgatctgcccacccattccgtaatacccaagaaaatggataatctatctatctacctatctgtgtccncnttccanctcctgngggttgttacagactaccttccatttgtgtttgancattgtgcatcctcgcaatacttcgcctgaacctanggatgtcacacctccttcctgcttancccngtgatacaatggtncnttactaatataatactttttttggtatgaanccctatgtgttcacanccttccattttcgttcnaanaaaanaccnncccaggggggccccgtaccattcncctaaatancctttacccntcaangcgtcntttaaactctgacgggaaacctggnttaccaattncccctgaacaaccccttcccantgngtatacaaaggcccacgntgccttcanattccacctaatgaatgaaccccntcggataccggggtttgngt

SEQ ID NO: 81313 - DNA, 402 bp, Triticum aestivum
  unsure (1)..(402): unsure at all n locations
  Clone ID: PAT_TA_81313
ggaagatgctttgtacgagaagctcaaggacgcgattatggaggccgggagcctcaggcacgaggcgtacgaagagactcaccggcggcagaaggccgaccgggacctggccgatgcgtccatgatggcgagggacgcagagagctcgtaccatggcgaggcgaggcgccggaaggagatggaggagaatctggccagggagcgcgcggccatggagcaggaaanggcgggaactcgacgtcattctcgcgaaagatacggaagtttgatgaccgcagcgccgaactcgactccagtttaccgactccaaggcgccttgatgagcgactccgatgtcagatgtccggatcctgctccgtnaaaactgaataaactgttgcttattaatgatttgggtgcgac

SEQ ID NO: 81314 - DNA, 521 bp, Triticum aestivum
  unsure (1)..(521): unsure at all n locations
  Clone ID: PAT_TA_81314
gtggagttgattttggccttggcattggctatggttctgaatcagggccacaagtacctgctccaagatctgccactgtaaacgtgttgaagacggggatgatgcaaaattttaagagtagctttgtctcggcgtcttcgagtgcgccaggcaacagtgcacctttgaggggtgcaccttttgtaaaacccgcacttcgtggttttgtttccggtggtaccataggaggggattcaggtgcagcgagaccagcaccaccggcgccctcatttgttcctgcgtccaggccagcaggaaacactaacgaaaacgggaacacaaaccctggaaactcngaaggtcaacggagggagaagaaagcggcatctgggtgggatcgctagtangctttgaactcccaaatgtacaaaatgcctccattttgtttggttactcaacggacatatgttgtaatgtagatacatgattgaatgataaaatgcgtcccanaccaactgaatgtcatccttaaaaaaaaaaaa

SEQ ID NO: 81315 - DNA, 453 bp, Triticum aestivum
  unsure (1)..(453): unsure at all n locations
  Clone ID: PAT_TA_81315
tggacatccaacgaccactactgctagaaccgtgtgttgactataagttgacaaagctttgcatacgcgtcaactctgtttttttaggggacgcgtcaacttagtaaggccagaagtgtgtggcagagaacttatagcccatttgagatttgtaagaatgtgtagcccattttcgaattctaatggaatttactacagcccatttacagtttgttaaaaggtacagcccanttcaaccaancattcanaacagaattcaataannatttcccacattttgatgggatccgaaatattttaacccgaaaattccnagtncagattaagtacattcaananaacttatatacgtaaaatccaagngaacattgcgctcgcacaaataatgaattaaantttcataaccaaaantaatatttacagaggtancacgtgttgggggatttttanagt

SEQ ID NO: 81316 - DNA, 603 bp, Triticum aestivum
  unsure (1)..(603): unsure at all n locations
  Clone ID: PAT_TA_81316
aatcttaggcactcatctctacgagtacctgtagaacgtgcattcgcatcactcaagcgaagatttaaagttcttgatgatgcaaatccattctttccctccgctactcaagtggatgttgtgatagcttgcgtcatcctccacaactgggttctttcccaaggcactgattgtttcattataccggagattaattggaaaccaaaactccctagtcctcagagagagcaagcccatgaccataggcacatggttgagttcagacaagcccttgctgacaaaatgtgggaagaccatcaaaactatcaccgcaatgatgccgacttcttgaacactccagcttactatcacgagatggcacaatctttggtgatggatggcttctgatgtatacactaagagtgtggatgagcttcttgctgtagatgtgaccgagaatgaaattgcaatggaggaaatgacactttggtgcaatgttgaaganttaactgcctttccaatccgaagggggaagatgtgatcctctacataacacaaaaggcaagtaacaagtncaacnatnattgtacacctganactncgaacntaaaaacgatggtataa

SEQ ID NO: 81317 - DNA, 654 bp, Triticum aestivum
  unsure (1)..(654): unsure at all n locations
  Clone ID: PAT_TA_81317
tcgagttttttttttttttttttttgctgggtactgcgagcaaatgaagcgtgtcattgcctcgaacgacggtttctgtaggagggtcacgatgttctttgattttgatgatttcaccacgacagaattagcggagatattgcttctgaagatgaatagcctgactgacacaagtttgctttacgggttcaggctgcaccggagctgcaccagaggtgccgttggagagctgattgccagggagaccactgaggagtggcttaaacagatgaacggaggtctggtagacacactgcttgtcaatgcacgtgaaaacttggatcttcgtcttgatttcagttgcaatgacgctgagaccatgatcacaatcacattggaagactggaagcaggcctaaggcagatatcaagacagagacatttgtggggacctacaatcaggaacatcctttcntgacaaaccaattacaggtcangatttgataaaaatgactgatccgcntcgggtacaagtccggttaccgtccantggagtnctgcctcgcanatacacggtancatgtatttttttgaaacaagtnttatcattgaatacagtcacgttaaaaaaaaanggggccgacaatcccaaanggnttngcccnangcncttang

SEQ ID NO: 81318 - DNA, 347 bp, Triticum aestivum
  Clone ID: PAT_TA_81318
gcttctttttattgtctaatatgttttatttgcactaatttggtaaatttattttatcttttggcttaatatgtcccaggtattgatatagtaatatttttttacttggttaatggccaaacatactgcttcagtatcttccggtaggtgcctcagaattatgcagttgatcataccatactgctacttgaataaaaatgtctatctttgtgttctacactgaagctatcatatgaagtttaattattttcagcgtccatcaccaaaactactttgtttgtagtgaaaggcttcatagaatttcatagatgttgcacatcatgaagattaacctgtagatgtagcat

SEQ ID NO: 81319 - DNA, 628 bp, Triticum aestivum
  unsure (1)..(628): unsure at all n locations
  Clone ID: PAT_TA_81319
aaataactcaccattaacccttttagtaaaaagagtataatctatttttccaatttcaaagcctttttcaataaggaacttggtcaagcatttataccacgctctaggagcttgtttaagaccataaagggctttgtgaagtttgtaaacatgatcgggtttcttaggattgacaaagccgggaggttgtttaacaaaaacttcctcctcaatttcaccgtttataaaagcacttttaatgtccatttggtgtaaagtgatatcatggtgattagcataggcaagtaagatgcggatggaatcaagtctagcaactggggcatatgtctcaccgtagtccataccttcgacttgagtgtagccttggggcgactagacgagctttgttgccgacgacttgacatcttcatcctgctgttgcgaacaccatttggtactgatgagttgtggtgtgtccggctctcgacaagtcaacntgattctccaagtgggtactctcaggntggattaccaattcgatttcatgntatnaacctcaaagtcaagcatggtnangataagttacaagttcccacantttancgangatcccgtggaacangacattgccatgangcctananctncg

SEQ ID NO: 81320 - DNA, 489 bp, Triticum aestivum
  unsure (1)..(489): unsure at all n locations
  Clone ID: PAT_TA_81320
ctgactacaacatccagaaggagtccaccctccacctggtgctccgtctcaggggtggtatgcagatcttcgttaagaccctcaccggcaagaccatcacgctcgaggtcgagtcatctgacaccattgacaatgtgaaggctaagatccaggacaagganggcatcccancggaccagcagcgcctcatctttgctggtaagcagctcgangacngccgcaccctcgctgactacancatccatantgagtccaccctnnanctggtgctccgtctccgtggtggcagtaaatgcctggccatggagctgcttatgtccggnggctcacaantcggttgccttcctgtgtcctccnattcgattgtcantgtgtcctcgtcaggcctgtgcttgttgctaccgtgctgtggtctaatgnnacgtactacgtttggtgngtcggtnaacttctgaccgcagcagattggtnancntaaatgaatgaata

SEQ ID NO: 81321 - DNA, 437 bp, Triticum aestivum
  unsure (1)..(437): unsure at all n locations
  Clone ID: PAT_TA_81321
cgctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctccgtgctccgcctccgcgggggcatcatcgagccctcgctcccaggccctcgcccgcaaagtacaaccaaggagaagatgatctgccgcaatngctacgccaaggctgcatccaaagggctttcaactgcccgccaagaagaagtgttggcacagcaaccagctgaagccccaagaagaaatttaagaactagactccgtnaaacgttattccgctttcattgtccgggataatcctgttnacataatttttccngggtnacatttgctgc

SEQ ID NO: 81322 - DNA, 659 bp, Triticum aestivum
  unsure (1)..(659): unsure at all n locations
  Clone ID: PAT_TA_81322
gccggccttactaatctatctgaactcaaggaagtcttgctcaagggtaccaatgatgaggcattcagaacacagtttgcaaacacccttgccaatcatccaaagagcccaaccgtgaagctggagggactaccgccatcgtcttgagagtcactgtatctatttgtttcctttttctttcacgtatcactagttagcaggatatccagccttaggttccgttattgctttagctgcaattttatgcagcgccaaaatcaagtgtgggtgggcaaaggatatagtggcaggaggactggctgctctggcagtgcccaattgttgtanatgactgaccacttgtggtggtggccggancctccccttgtgtnagcatttcccgaacnnaactttcatttcnggtgttaggaacggcggnccctgtnggtgccttttccacctgaaaactttcctgnnccctccttgtgcaaggtcnggggtgaaanccaatgttaattggcncggaacggncattaagcctnacctatccgggatgnnttaacncggatcacgtcggcaaggtagtttaattgtcnantcagttacttgtngctttaaggtnccccaattaatcgcttctntgaaanctaaaanggnaaccntttngtttaaagggcngn

SEQ ID NO: 81323 - DNA, 678 bp, Triticum aestivum
  unsure (1)..(678): unsure at all n locations
  Clone ID: PAT_TA_81323
attgagaggtccaccaaccttgactggtacaagggccctacccttcttgaggctcttgaccagatcaacgagcccaagaggccctcagacaagcccctccgtcttccccttcaggacgtttacaagattggtggcattggaactgtgcctgttggccgtgttgagactggtgtcatcaagcctggtatggttgttacctttggtcccactggtctgacaactggaggtcaagtccgttgagatgcaccacgagtctctccntggaggcgcttcctggtgacaacgtcngcttcaacgtcaagaacttgctgtnaaggatntngaagcgtggctttgttgcatccaatccaaggatgacctgccanngaancggcaactnaactcccaagtcatcatcatgaacaacctggtcaaattggaacggtaacccattttggntgcanactcccanattgccgtaaatttccaactggnaccaagttaaagggattgntaggactggagcccgccattcntaaaangganccggacgtaaatgatccncnanccaggttngancttgaacaacccntngcnttccgngntaaaaaaaaagttccntggntaaagnttgaaaaggccccttcaggttcaggcctaaaaaangtncggttncccattnnanagttagaantttng

SEQ ID NO: 81324 - DNA, 522 bp, Triticum aestivum
  unsure (1)..(522): unsure at all n locations
  Clone ID: PAT_TA_81324
gttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggttatcaatgacaggtttgngcattgttgagggtttgatgaccacattcatgccatgactgcaacccaagaagactgttgatggccttccaaccaaggactgggagaagtggaaaggtgccacttccacatcatccccaancanactgggtgccgcaaagctgtttggaagggctcccccagaccttaacngaattttactggatgcttccctnttcccnncgttgagttccgttgttgatcngacgttaactncnaaccacacctatattaataagtgctaccaagagtctnangaactccaggatttgggtacttgata

SEQ ID NO: 81325 - DNA, 544 bp, Triticum aestivum
  unsure (1)..(544): unsure at all n locations
  Clone ID: PAT_TA_81325
caccgcttccgccccggcaccgtcgcgctccgcgagatccgcaagtaccagaagagcacggagctgctcatccgcaagctccccttccagcgcctcgtccgtgagatcgcccaggacttcaagaccgacctccgcttccagtcctccgccgtctccgccctgcaggaggccgccgaggcctacctgggtgggcctcttccgaggacaccaacctctgcgccatccacgccaagcgcgtcaccatcatgccccaaggacatccaacttcgcccngccgcatcccgtnngagaaaaggcctaagctgcattctgcatccatgcntcctccgttaaattccctgttaacctgatttcntccggtggatntttttttttgctacattagtttcaaactgtcctgtgtgttccttgggatggtggatttngaagcccaaagtnatggacgtccttttgccattnacaagggaatgaatgttcccattanccgttttgatccgttccnacttgccattctngccgttttgccccgaaccnactngatttt

SEQ ID NO: 81326 - DNA, 505 bp, Triticum aestivum
  unsure (1)..(505): unsure at all n locations
  Clone ID: PAT_TA_81326
aggtgctcgaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgatgtcgacganatccgcgtcgacaangagaccatggacatgctggcgttcctcngcatggccgacctccccggcgttgagcgcgcccccnaggccacctctgccgctgccccctaccgccagccttcaaagggacnccgcngtggcaatcncgcctagttctccgcatcgtcgtcgtccgtaccctatcatctttacatgtttaatatnaatctgtnacttgtggnaatgatttttaactcagaacttaantcnaggtatttgtctncntagggtgacatgatngttatccaacntttactgantgatccatatatacgttgagcttg

SEQ ID NO: 81327 - DNA, 407 bp, Triticum aestivum
  unsure (1)..(407): unsure at all n locations
  Clone ID: PAT_TA_81327
ttttttttttgaaggcccggaaacaagtgtaacttgccaaaaagtcgaacgcagattaagcatggggtgttctcgcagtgtgtttcaagttgacattanggttttcctggtcattccggtgcgctagtgtgtgcantcgatggcatttgacaaaaagtagtagcncctantttctgcctgccgatcgctataccgnaagaaaacnanctgcgcctgcntctcttgccggttncgtccannaacgaccccaaccgtcggtctccaacttgctgaaatcgtccaactcctncaatgngagancaantactgcctaagctttcgcactccgngattngcggcccgttcttaanggngttcttaaacgggctgataacnaggccttcctgnggnttaacaaaaattccccc

SEQ ID NO: 81328 - DNA, 666 bp, Triticum aestivum
  unsure (1)..(666): unsure at all n locations
  Clone ID: PAT_TA_81328
ggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcacccttgggagtgaagcaagatgatctgctgctgcaacaagatgggacgccaccactccccaattactccaaaggcccctttatgaggaaattgtccaagaatctctccctacccngaagaagtccggtacaacccctgacaagtcccttccttcccatctcctgggttttnangggtgacaacatgattnaaggccaccaacctttancggnacaaggcctaccttcttngagtccttgaccanttnatgacccaagagcctcnaanaccctgctctccccttaagatttanaaattgngnattggacgtccnttngcctnttaaacggttcacaaccngtatggtgtacttggcccacggtctanacnaggtaatcgttaaagacatnatccccnangcctctggaaagtggtnactnaaactncgtaggtnnactggttntcccancagtnctcaggggganttccccatnt

SEQ ID NO: 81329 - DNA, 425 bp, Triticum aestivum
  unsure (1)..(425): unsure at all n locations
  Clone ID: PAT_TA_81329
gccaccggcggcgtgaagaagccccaccgcttccgccccggcaccgtcgcgctccgtgagatccgcaagtaccagaagagcacggagctgctcatccgcaagctccccttccagcgcctcgtccgggagatcgcccaggacttcaagaccgacctccgcttccagtcctccgccgtctccgccctgcaggaggccgccgaggcctacctcgtgggcctcttcgaggacaccaacctctgcgccatccacgccaagcgcgtcaccatcatgcccaaaggacatccactcgcccgccgcatcccgttggcgaaagggcctaagctgctgctgcaatccatatccatgcgtcgtgccaanttcctgttcatgggtgggaatttattncctcctgntaantccctgttagttgttcccggtcaaggtgg

SEQ ID NO: 81330 - DNA, 492 bp, Triticum aestivum
  unsure (1)..(492): unsure at all n locations
  Clone ID: PAT_TA_81330
cttttcggtggtgttcaccacgagcgaaacggcagccgtccggcagagccgcgtcgtgcgcaacgttggcggcgatgcccgggttacgtacagggccaaggtctctgccccggacggcgtgcgcgtcacggtgacccctcggacgctgcggttcagcgcgagacggagaacacagaatacgtgggtcacctttgccagcnggaccttggggaagggtcaccaagaatcacacgttcggnccatccgactgggagcgaccgcaagcactttggtgaccaccccatcgccatcaacctgggcccggcgaccaagttacgttgccgttnccggaatgttaatgttattgggccaatggtaagctttnaggaaacacnctttngatgggaaaaaaatctacggcagttccccnggcaaattatgttaagaatccatgggcagtccccctcctgtaccnctgatnacatttttttaaaccccngntcaaaanaaaaa

SEQ ID NO: 81331 - DNA, 379 bp, Triticum aestivum
  unsure (1)..(379): unsure at all n locations
  Clone ID: PAT_TA_81331
gccattgatcaacggcggtagctcaggtggcaagggactggatatgatggacgtctcttcggaagtgtacggctccgccggtacaacgacggcgttcgacctagagcttatggagtcgtgcgggttattttgcggcgccgctggcaatgacatggagcagctgcaatgggattgctaattgagctagctcattatcctcaccccctaattagatccttccgatnccatgttttaattgaggcttccgttcctaatttgtttttttgatgtgcattccctgtcctcctggatncnaaattcaaaccgtccaagtcnagaaagaaatcatgctaatttgatggtngatttcccatcaacaaatttnttttngaaaaaaaaa

SEQ ID NO: 81332 - DNA, 664 bp, Triticum aestivum
  unsure (1)..(664): unsure at all n locations
  Clone ID: PAT_TA_81332
agcgtgtgatcgagaggttcgagaaggaagccgctgaaatgaacaagaggtctttcaagtacgcctgggtgcttgacaagctcaaggccgagcgtgagaggggtatcaccatcgatattgccctctggaagttcgagaccaccaagtactactgcaccgtcattgatgcccctgggtcaccgtgacttcatcaagaacatgatcaccggtacctcccangctgactgtgctgttctcatcatcgactccaccactgggtggtttgaagctgggtatctcccaaggatggccaaacacgtnagcacctctccttgctttcactcctgggagttaagcaaatgattctgctgctgcaacaagatggacccaacatccccaattntccaaagcgcntttacgaaaaattntnaagagcncttccctacctgaagaagtcggtacaacccttaaaggtccctnctccccactcnggtccagggtacaacatgattgaaggccacaactntacngtanaaggccaacctgcttangcctnacaattaatgaccaagagcctaaanancctcgttccctcagacttaaaantgnggattgaatnccgttgcntttaaacgggtacaccngangtttccttgccatgcnaacnngcaatnttaatccaaat

SEQ ID NO: 81333 - DNA, 436 bp, Triticum aestivum
  unsure (1)..(436): unsure at all n locations
  Clone ID: PAT_TA_81333
agaaggagtccaccctccacttggtgctcaggctccgtggtggcatgcagatatttgtgaagaccctcactggcaagaccatcaccctggaggtggagtcgtctgacaccattgacaacgtgaaggcgaagatccaggacaaggagggcatccccccggattcagcagcgtctcatctttgccggtaagcagcttgaggatggccgcaccttggcggactacaacatccaagaagganccaccttcacttggtgctccntctcccgttgtggcaattaagtccctggcgatggctctgcttcgncctcctggtccgcaatccncncctttgtttccgtactgtacattgatgcagtgttaccntttgtaccttcaacttcngccnggtgtgcacacttttggggaactataataatnagcccaaaaaaaataaatt

SEQ ID NO: 81334 - DNA, 489 bp, Triticum aestivum
  unsure (1)..(489): unsure at all n locations
  Clone ID: PAT_TA_81334
ccgacaccgacgacgacgagtgaactgctgtaaacccccgccaattcttcagttcttctccgaccaccatcaccacctacatacctagtactagtgcgtcttaattagtggttagcaaccagcagcgaggtagctagcggtagcagagcatcaaccatctcagtgagcaagcagatactagttcagtcagttcaagaagacatggggaagcaagcatggatcggacatgcaaggtgttccggtgaaatgccggatgactccggggaccaaaccccgaccaataatggaccgccacgtcccatcaagctccggcaaggggttactaattaggcctgggctatcaacgacgggaactttggtggaattaaccaggtgtgttattccttcctgggcatggcatcacctaacaagngcatggcatttacgaccgcacaaatatagatttttgtaaaagaataccgggaacaacaaactnaaagacatccatgc

SEQ ID NO: 81335 - DNA, 276 bp, Triticum aestivum
  unsure (1)..(276): unsure at all n locations
  Clone ID: PAT_TA_81335
ccggcacctgcggtcgcagtcgttcgcgaggagcatgctccggctgtactgagacgtgacatctcgtttcactacctgaccagtagctcggcactccggtcgagtcgtttctttgcagcagcagcagtggtgattaaggcttagtagtagtatgattaacgtctgattaanggcaatggtatagtcataaatccttttattacatgcttgtgtangtttggatggaatggaacgaggtttaatctcatgtgatcacttgtttgaaaaaaanaaaaa

SEQ ID NO: 81336 - DNA, 376 bp, Triticum aestivum
  unsure (1)..(376): unsure at all n locations
  Clone ID: PAT_TA_81336
aancaccccntgcaanagggtaaaagganntaaactttgcatatgtattcagctaattgacttgtacatggntagctatagttcccccatcgtaaantttactgttgtanaaaaccttcaatgtttcgttntctccacaatgctagnaatanagcctgttttttctgccaattatatgcaanaatgtcccaaagcttgttccatcgatggactaancncatctgcantgnaaagcaagctttccgngatcagtacanancaactgatnccgttctcaacggacctggnaaatcagactacttttctanggaaaagacgaaacgttgaccntgaggttttacttcacngagctggagattctccatgntangtttca

SEQ ID NO: 81337 - DNA, 604 bp, Triticum aestivum
  unsure (1)..(604): unsure at all n locations
  Clone ID: PAT_TA_81337
cggcacccaaaaatatgattgctctgggcgtttgatgtgcatgttagcataacttggaatatcatgttgctatctttcaggtggtacactacgaaatcccaaactcgtcagagttatttgttcacagatctggacgaactgcacgagcagggaagaaaggcattgccattctaatgcacacatatgaacaaagtagaactgtaaaggtcatcngagcangatataggatgcaggttcacagaggtaaaccatggtttcatgtttagtactgatgtgaaaaattataactcattgggctgattcctttttgcgatgtgtagcttcccaaggtttcaactacagatgaactgcanacctgtttaatttnataagaacacccctctaaattaattgggaccanaanaattggggtccncctttaaccacaangnggtttgggaaacccatcccttggtttggggatttnacactttgggtacccnaacctgctggtgtcccaggatcggttaanaacctngnggttaaggatcccaaactctaactcaatggtttgaanccacggttgaatcnggnggnccactcaaggttggaggcactancccgg

SEQ ID NO: 81338 - DNA, 321 bp, Triticum aestivum
  unsure (1)..(321): unsure at all n locations
  Clone ID: PAT_TA_81338
ctgatcttcttctccaactgccgttgctcctcccctcgccccttctgctgctgctcttccctgcttctgcttcctatgccttgctgctgctcctaacttgctgctcgctgctgctgcttcttcatcctcaaatctgctgctacacttctctgaatttgaatcttgctgctgctgctgctctctctctctctctctctctctctctctctctctctctctctcgantgcgaactttagaagtgtaataatgttcagaattgtgtaatgtccanngttgttgtaaatatttcanactgngnataaanaagcntggtcntctca

SEQ ID NO: 81339 - DNA, 558 bp, Triticum aestivum
  unsure (1)..(558): unsure at all n locations
  Clone ID: PAT_TA_81339
tgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaacttcccactgatgatgttctgcttggccagttcaagactggatttgctgatggcaaggacctgatcctgtccgtgatgtccgccatgggtgaagaacaatntgcgctgtnaaangaaaccgtgggtggcaattaagcantgtgcctggtgcctacctgcnaacttggtaccaatgctccnggtgtttggaanacacatacatnggcncaaaatactgttgggtgaaacatttgttcaaattgggtttttaaaccgaagcncnagggctgcnatattgttacaaccaccacccatanaaacccttggatggacgatggtgcggactaaatcggttgc

SEQ ID NO: 81340 - DNA, 471 bp, Triticum aestivum
  unsure (1)..(471): unsure at all n locations
  Clone ID: PAT_TA_81340
gagatccgcaagtaccagaagagcaccgagctgctcatccgcaagctgcccttccancggctggtgagggagatcgcgcaggacttcaagaccgacctccgcttccagtcctccgccgtctccgccttgcaggaggccgccgaggcctacctcgtgggcctcttcgaggacaccaactctgcgccatccacgccaagcgcntcaccatccatgcccaaaggacaccantcncccnccgcaccgtggcgagagggcatangctgctggctgcaatccataccatgcccctttcaagatacttaattcctggttaggctgattcaaccggtgggaancccnnagttttcnaaaattcntcctgttaattcatgttcctcctcaangngggtggatgttgtatgcctaatctgatggactcctttttccatcaacaatgggaatgaaatttggtccattcccaaaaaaaaaaaa

SEQ ID NO: 81341 - DNA, 286 bp, Triticum aestivum
  unsure (1)..(286): unsure at all n locations
  Clone ID: PAT_TA_81341
angcattctaccaccagaccgaccgcacagttgangtgagatcngcgctaagggttcatcagcaaccangaagagcaccaagctcgcggtgatcctgatcctccaggccgtcctgntcatggggatcctctcacacgtnaacgccgactatttccccangtgctgcaacaactgaangtcctctcgggggtcgacgtctgcgacgacgcccaccccnantgncccaanggctgctntnnctgccgcgntggtgacgcnaagccctcacangacttccnggtgccnc

SEQ ID NO: 81342 - DNA, 577 bp, Triticum aestivum
  unsure (1)..(577): unsure at all n locations
  Clone ID: PAT_TA_81342
ggcaatcttgtcatcgcgaacaacgattccgtagtttggtccactcacaatgtcaataataggacacaaaccagcagcataaacaccaccactggtgctgccgttctcttgaacagtggaaaccttgcccttacagtcacagagagcccatcatcatctgacctaccgttgtggcagagctttgattacccaacagatatttttcttcctgggttccaagtttggccggaacaagtcaccggctttattccatcagagcatctccaaagaagagcctccatggatccgggtcctgggncaatacngcatngacntaaaaaaaccnangggntttncttaangcccgcaaccccttgggtantgttattggcattgggcacctcnaaaacatcatcgttgatncttataccaataccaattccattcnggattgggttccacggnccaaagtttgttaacacacatatttgataacaacaagaggatnctacactncattcaccggtgaacacnccanattgtccactaanacncnggcganaactatnttggcanaccacatctggaattttaacca

SEQ ID NO: 81343 - DNA, 609 bp, Triticum aestivum
  unsure (1)..(609): unsure at all n locations
  Clone ID: PAT_TA_81343
cctaccgagaagaagagagaaaaaaggttcgagtgcgttgcagagtgagaagagatggctccggtgaagctgtacggcgcgaccctgtcgtggaacgtcaccaggtgcgttggcggcgctggaggaggccggcgtccaattacgactcctccccatcaacttcggcaccggcgagcacaaganccccgaccacctcgccaagaacccttttngcanttccactttttccagatngtacttttacttcttccgatcacntctatttgcaantatgcgncccccaagacaagccaaacctgtttnaaggagggcacatcaagantcagcaatggggtnttttgccccaagttgagccatcattaaccgcgttctancccatttctttcattgcntaccaacctanccttnggagccacttaccaaagcattnacanacttttnaattaaaacttctgcattttcnaggcaccnacattcaatactnntggaacctatcttcggcttacagttcntactgnctgggggaactacatccgttnactacccttaagctgtgatactttgnaagcctctcaagncctcctanaaccattttattnggcctcncaa

SEQ ID NO: 81344 - DNA, 542 bp, Triticum aestivum
  unsure (1)..(542): unsure at all n locations
  Clone ID: PAT_TA_81344
cagatcttcgtcaagaccctcacggggaagaccatcaccctcgaggttgagagcagcgataccatcgacaatgtcaaggccaagatccaggacaaggaggggatcccgccggaccagcagcggctgatcttcgccggcaagcagttggaggacggccgcacccttgccgactacaacatccagaaggatcgaccctccatctcgtcctnagctccngcggaggcatccatcgaccacccctgcaagcgctttcccgccaattacaaccaaggagaagatattttgccgcaaatgtatcgcgccctgaaccctaaggctgtcaactggcccccaagaagagttttngccacacaaccanctnaggccccnaagaaganttttaagactagagtgccactatcatttcaatggccgttgatcatcccgtttccgntttaagcatacnccctttgcccttgacttatttattgcttcaccncctaccttggggggaaatngacatattggaatggnacaaccanattgccnttaaaaaaaaaaaa

SEQ ID NO: 81345 - DNA, 402 bp, Triticum aestivum
  unsure (1)..(402): unsure at all n locations
  Clone ID: PAT_TA_81345
aaaagtaggaccagagaacaaaatgaagcaagtcatcctgctgaatcaaaactatagtatatccatccacatatcctaactgtagtatatccctgcagcacactctgttatgggcataaataaacacatatgcatgtattcattatcaaaacacaaacaatatatatgataacaaaacagtaggcagtgatgttgtcaacatgtctagtcatcataaatctccttaccttttttcttatagtctccccagtgctatcaccaaaaaagaatcgctcccaatgaagtgcctccatacatccggggagcaagancacanacaatatatatatatatatatatatatatatatatatatatatattatatatatatntatatatatatatantggggngnattttc

SEQ ID NO: 81346 - DNA, 603 bp, Triticum aestivum
  unsure (1)..(603): unsure at all n locations
  Clone ID: PAT_TA_81346
gctaccaccgtccattaggactcgcgtcagatgaaatccgttgatgattgggtcgaggaacgatgcagctaagccgccgtggcggatgctggttgggtgatctcggtggtcgaaggtgatcgagaatgacaaccatggattgaatttccggggcgactgggctctaacgcatagatgccccgaagtgcacgcttgccctcccttttggggatgtgtgtagcgttatacatgttcaccttttgggcttnaagggggaaattcctttgatccccagtttccgggtgcccggggtccactcacctcctcntccgngatcncctccttgtttcngcgttgacttccggttgtttaaatacccnacacctccgttggatggtggncggtttcctggggtcatcancctggcaagactaccnattatccgccaactggatggacccncgcatttaanaggtctttcccggccgattngaccacnaaccggntaacgtattcaccgtttacccatnctccgtttgcctnttctcgacttccggctttttgcccgaggctttcttcgttttaaaaacacattccccanaaacagtanatattgggcangtt

SEQ ID NO: 81347 - DNA, 603 bp, Triticum aestivum
  unsure (1)..(603): unsure at all n locations
  Clone ID: PAT_TA_81347
cttccatattgtgtccatcagcggcggctagtatggcttctcgtatgtctcctcagtctcgtacgctgttgaatggggattgaggagtagtcgggtccaaggatcaagtgtagcaaggaatcattgatctgcacggtgtcggtgttcttggcgtccgtngcagttgatttggggcagaatgtcgtctcatgcacccggttggttcatcttgagtattaagatgctggcgacttgtcttccccaagtgtgcaagccnaaaacatcattggnatccccctcccaagtaaccccgnaacttcttgcatcctcccaaggtgtccaattttcccgaaattccnattccgacctcatcctggatacannanccatcaaatgcttgatttccccataacatgataccgctgagngttttgcccccgggcgattaanacgtagtgtactccccngcccattgatgncaccccaatactncangccaaacanaatgggcngaaggnaacagacncaccgtttcaagaacgnggaagatccttaaatttgtaattgtgaggatctgactgattgtaaacaaaaaagtcgatanactatngcaaaaaaaaaaaa

SEQ ID NO: 81348 - DNA, 457 bp, Triticum aestivum
  unsure (1)..(457): unsure at all n locations
  Clone ID: PAT_TA_81348
tcttcgccggcaagcagcttgaggacggtcgcacccttgctgactacaacatccagaaggagtccaccctccacctggtgctccgcctcaggggtggtatgcagatcttcgtcaagaccctcaccggcaagaccatcaccttggaggttgagtcatccgacaccattgacaacgtgaaggcgaagatccaggacaaggagggcatccccccggaccagcagcgcctcatctttgccggcaagcagcttgaggacggccgcaccctcgcttgactacaacatccagaangatccaccctccacctgggtgctccgtctcaagggtggtatgcagttctccgttnagacctcaccggcaagacatcacgctccgaggccaatcatctgacacattgacaatgtnnaaggcaaattcaagacaaggaggcatcccaccgacaacagngctcacttnctgg

SEQ ID NO: 81349 - DNA, 620 bp, Triticum aestivum
  unsure (1)..(620): unsure at all n locations
  Clone ID: PAT_TA_81349
accactacccgccccagcattacgcctctcccgtcagcaactggctcccagtggagcccgacagggagctgaccgacgacgagagggcctcgcgcgttgtcttcggccacatgctctccacgctgcccgttcggtccagggggtccaagattgccttcatgttcctcactccgggcaacttgccgttttgaaaaactatgggagaaatcctccgagggccatganggaagatatacatatatntcaccctccgagggagaancaagaacatntcatccgcttattaatgggccnaaatatacacaanngacaaggtacantggggtcaaattcaatggttgatgccgaaaagaggtttttngcgaatgctcctgcaagaattgacnaccacattttgtgttgctttcgganaactgctacctttgcacattttgacactgtatgacnaccngatggaacaacccattttatganccttcaagatccggacccacggaatttaatatcccaaaatatttaccgaggtaaaatccnctncagaagtnanatggtccaatcaacggaaatcatnatanaccggcatctncaanaaatnaactttttacnagatgaggngccat

SEQ ID NO: 81350 - DNA, 300 bp, Triticum aestivum
  unsure (1)..(300): unsure at all n locations
  Clone ID: PAT_TA_81350
aagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctggagaacaaggcaggcagttcgaggtggccccggcatcccggcnagggtgcantgcggcgacaactgcaatgcacccctgcaactttaactgcatcancctacgttcttacttacgt

SEQ ID NO: 81351 - DNA, 335 bp, Triticum aestivum
  unsure (1)..(335): unsure at all n locations
  Clone ID: PAT_TA_81351
ggggaccggcgctgccaactcggccaccagctccggcgacgacccagccggctgtcactttggcttatccgcgtccggaggcgccagcaagagagccgctgtgcagccagtnggcgggcggcgaccggcggcagcgccggatgatncaagaaccgggagtccgcggcgccgtcnccaaccccggaaacaggcctgcaccaacgagattgagcttggagctaacgcaacttcccccnggagaacangatctatcccacgccagcagcttcatcaacattttttttgcnaaaagngngcaagacccnttcccaaacttgcaacaaccggacacttat

SEQ ID NO: 81352 - DNA, 399 bp, Triticum aestivum
  unsure (1)..(399): unsure at all n locations
  Clone ID: PAT_TA_81352
ctccaagtttccctcggtaggcagcttccatctcatctccggcgatgtctgggcgcggcaagggcggcaaggggctcggcaagggcggcgccaagcgccaccggaaggtgctccgcgacaacatccagggcatcaccaagccggcatccggaggctggcgaaaggaaggggccgcgttgaagcgcatctccggggctcatctacgaagaaacccgcggcttcctcaaattcttcctccnanaacttatccgcaagccnttacctacaccgacaagcccggccgcaaaacgttaaccgccatggctcntctagccctnaangccaagncnaaccttctanggtttnggcgctacccnttactcccggctgacctcttttctgcttgtgctnttnancccc

SEQ ID NO: 81353 - DNA, 340 bp, Triticum aestivum
  unsure (1)..(340): unsure at all n locations
  Clone ID: PAT_TA_81353
ccccggagcagagggtctgaggcgagctccagtcaactttgccatgggtggatggaagaagtagtatagccattgcttcgttttttcttaattatgtaaactttatttttaaaagcttattattttcgggaagctgctgtgtggctgttggctgtcaagtccgacactccgacgccctgctgggattttgcctnggaatcaactgacgtngtggggccgcctaaccaagctgggcccgcatgtccatttacacttggnccacctccggccaatcctgaccgtcatactccggcaaccttttcccngtaaataaatttggaccgacgactgtntccnattt

SEQ ID NO: 81354 - DNA, 333 bp, Triticum aestivum
  unsure (1)..(333): unsure at all n locations
  Clone ID: PAT_TA_81354
ataaggtaccgggacagcctaacatcggcgagtggctacaatatggagatggcgtttttacaggtgtctctttcccttgccattgattcaatgtaattaaccttcggcggattgggaacactcaaaggaaaaagatgacaagtatgatttttgatgtaattttactttttgttgccctttcttgttggtttcaatttgccaaaataaataaatagcagtggcccaacatgttatttattttatttgccttgagtgtcccaagatacatacagtgcaatgagaagaaacatacccacataatgtgacnaaataaggaccattaaaaaaaaaaaa

SEQ ID NO: 81355 - DNA, 464 bp, Triticum aestivum
  unsure (1)..(464): unsure at all n locations
  Clone ID: PAT_TA_81355
gcggcgcgggacaacaagaagaaccggatcatcccgcggcacgtgctgctcgcgatccgcaacgacgaggagctcgggaagctgctggccggggtcaccatcgcctacggaggcgtcctgcccaacatcaaccctgtgctgctgcccaagaaggccgctgcggcggctaccaaggacccaaaggcgggcacgaccaatctcccaagaatccccccgccaaagaagcggccgacgcttaagcccggactccctatccggtncccttccacctctccctcctctccnttttccctgtccttggttnaaccttaccacctattgtcatcctcgtcctggcgtccttccgcatccacnttgccaggtncatgctgcttgtttgactngtttgcttgttccncanaggtgcatcacttttcnccgtacccgataaacgcttagtagtccttnatctggaaaggaaggag

SEQ ID NO: 81356 - DNA, 320 bp, Triticum aestivum
  unsure (1)..(320): unsure at all n locations
  Clone ID: PAT_TA_81356
cntcnaggtcnanccgtccgtccgtacntgctcngcttcctcttcttcttcgtcatcttcctctgctccntcggcggcggcnaggtaggtttcttgcgggtggcgcgcgcgcgtgcgcgtanccaagaagatcatcaaggctgaaggccaagggggttggtacatggtgggtaataattgtttanctccaggggtataggtgttaaaaaggaaaagaaatttaggtttggtacccctactaaattgtgttttgncccttttttnaattgtttggtaagnatttatcccacntttaattggcccattttaaaaaaaaaaaa

SEQ ID NO: 81357 - DNA, 402 bp, Triticum aestivum
  unsure (1)..(402): unsure at all n locations
  Clone ID: PAT_TA_81357
gcaaantgcaaagccaccagaggagaaancttggcncagctttgcacttgtgacttgtgacttgttganccatggagttnaagcacctgtgcctggtgaggttcaaggagggcgttggtggtggaaggacatccattgaggactccaccaaantcgcccgcggagctccacaccntcatctttttgggttngggaaaagnacttncttaaccaagagggccttaaccanggtttacccacatntttccccanagattttccaaagcccaagagactngaaattttannggcncaaaaaacctcnnttttcgcaccanttaaggngtgtccaaagaggtttcccgattcnccccttgntnnccaaaaacgggacancccnaggngcccccataaanccccccc

SEQ ID NO: 81358 - DNA, 402 bp, Triticum aestivum
  unsure (1)..(402): unsure at all n locations
  Clone ID: PAT_TA_81358
gtcnangtcccaaacctcctcgccgttcctgagctccgtcatcnacnaangccgctgatacagttcgacccnttgatgtcaatnganctctcgcgctacanatttgttganaatgcatgcatcttacngatggtgtcnatacaggcagttttttttttttggcattgtantgaactgtncagtggtggtatgtaggatgagtaaaanttgtatgtgtactcgtgtangtgaantcttgaatctttgggctccgttggacgcgcntacgatttncaataatttcggttggactttgacttttgggaccccaagaagntcctngctcnttcttgccaantgcttgctngcaaaaacattaagtngtccatccttganaattggcttttgcnattccctttaaga

SEQ ID NO: 81359 - DNA, 388 bp, Triticum aestivum
  unsure (1)..(388): unsure at all n locations
  Clone ID: PAT_TA_81359
tagacgaacgtatggagctgaatgttgtggagaaggagcttcaaatgctcagttcatttgatacttacgatgatgctgaaattgctgcaagtccagtacgggtacgccatgccaccgacaatgtagagttggatgatgatgctgaaaacaatctaaaaagcagcagtgaaaaagaatatttgaaagagagttanagcttgcatcctttccctgagactgatgattangangacacctaccagtttggagatgttgggccattgnatacagatgttcaagaaatctgctanacttatanctgagaaagaagatccagagttaantatgatcaggccgtcgccaaattnccatcannaatatnaagtattngaattgagaattggcaccg

SEQ ID NO: 81360 - DNA, 518 bp, Triticum aestivum
  unsure (1)..(518): unsure at all n locations
  Clone ID: PAT_TA_81360
ttttttttttttttgcacatgtcaaacnaacatcacattaacatttcttgtaacctctctacaaagtcacatggggcacaggcacacaangcctaaaaaagtccanttganaagacgctggaggcgcangtctctgagctggaggagaanaacaacaagttgganaancacattccgacctacnattgccaggaggacgtgccgcacnaagcanangcagcagagggccaaggtccaaataaccaaggcngcatccanacngggtgggtnaacctgacngtgatggtganngtggagtntcacgttgnggagctggtgtccacatccctgaatgcctccccttnntggacangtcaacttcatttcctncgacncgaactacnccccgnagtnttncccaggcaanaccanatcaactcnngtttttgacnacactggaacaancttttcacnagcatacaagnnttacacccacggttctcttcnccttccacngnttancaggaaagaagntttct

SEQ ID NO: 81361 - DNA, 382 bp, Triticum aestivum
  unsure (1)..(382): unsure at all n locations
  Clone ID: PAT_TA_81361
gcctggccaagtacccgaagaaggtgatccgcaaggactcggccaagaagacggccaanaagtcgcgcgtcaaggtgttcctcaagctcgtcaacttcacccacctcatgcccacccgctacaccctcgacgtcgacctcaaggaggtggcctccggggcgcccgactccctcacctccaaggacaagaaggtgggcgccgccaaggccgccaaggccaagctcgaggagaggttaaagaccggcaagaacagtgggttcttaacaaagctccgcttcnaggcctgcaggccgacngcgcaaggcgtttcccngccttacnactgaaccgtttanattttaactgcttgcncttggaacntcccngtttgggaattgcccat

SEQ ID NO: 81362 - DNA, 620 bp, Triticum aestivum
  unsure (1)..(620): unsure at all n locations
  Clone ID: PAT_TA_81362
agaacacttcgcaaatctaacaagtttaagggcaatagacatctcttccaacaatttgaagattgtactgagttccgattggcgtcctcccgttactctgaagtatgcatcatttggatcttgccagatgggtcctctgtttcaaccttggcttcagcagctgaaaaccactgggcttgacatttcaagcaacggtttgaaggacgagtttccctgattgggttttgggtctgcattttccacatgccacatcactggatatcctttaacaaccaaataatgggcagcttgccagcagttcgggtcgcatgggcttttaaagaaactcgttctcaattcaaaccggtttactgggcccaatacctgcattgccaaaataatacacatggttagacatctccaacaataaatttnagaaacatacatcaaaccttggacctcactactgaattatgtccgtgcatcaaancaaatgggnggntatatccaaaacnattgcaactnnatggtggngtaccggattgtcaanaaatttggaggngaatccaagtttgaatcaaacataaattttatccacatacatttnggaaatcacatttcnnaaaaaggcgaatntgntn

SEQ ID NO: 81363 - DNA, 529 bp, Triticum aestivum
  unsure (1)..(529): unsure at all n locations
  Clone ID: PAT_TA_81363
gagagagcgagcaaaccctaacctccgacgatggtgctgcagaacgacatcgacctcctgaacccgccggcggagctcgagaagctcaagcacaagaagaagcgcctcgtccagtcccccaactccttcttcatggacgttaagtgccagggctgcttcaacatcactactgtgttcagccactcccagactgtcgtggtgtgcccaggctgccaaacagtgctctgccagccaacgggtggcaaggccaggctaaccgagggttgctcccttccgccgcaagggcgactaaacctcccgaagtctatctgaaaaaccaaccgtttgttgaactttgatttttcaaggtgttaatcctgaaatttgcaatgtctggcaaattgaaccatccttggtaatgtgatancaactngagtatatatgatgacacgtactatgtccgtttggttgtgaattagactagtatactgcctggaataggtgcctgataatgtatcctccgaagtgctgcgtctggaaaaaaaaaaaa

SEQ ID NO: 81364 - DNA, 277 bp, Triticum aestivum
  unsure (1)..(277): unsure at all n locations
  Clone ID: PAT_TA_81364
cantactcgtgtactacgagttgctccagaagacctagagcaggacccaacatccanccatcttgaaggtaattttgcatctctctcattacgttcagctggttttgcttgcatcngtccatctaggcagcttgcccatgctcataaattataacttgttcctcatgtacccatgttagcattctaggtgctgccttttccaatatttttggctggcantcttcatctgcaacgagtggcggggatgnttatgatatgtnggttaaaatttgtaaca

SEQ ID NO: 81365 - DNA, 234 bp, Triticum aestivum
  unsure (1)..(234): unsure at all n locations
  Clone ID: PAT_TA_81365
tcganttttttttttttttttttttttttttttttttttttttttttttttntttttttttttttttttgccanctgnattggacccttgccancatacnagttgctgaaaccangtangcacaccnaaccacagcaacggtggctacaaaacacaacanaacggtcccactccaacgttgnatgagcanngacacccgattacnttccaaancagagancaanggcgtcacaa

SEQ ID NO: 81366 - DNA, 477 bp, Triticum aestivum
  unsure (1)..(477): unsure at all n locations
  Clone ID: PAT_TA_81366
cgcaaattgtcttcggcattgcaaggcgggttcctcctccaagtccttcatagaagattgtaaacaccaagagtagtgtccggctctgcaaaaataagcttccacgtattgccatagatagaataatattaacacaaatcaaatgtgctgacgtattctgcagtgcgtcatcacacctcagccaagtcctttacttgaatcgatttcacttttccacctcagcgtgttttgtgaggcagtttccttggcatgtcttgtcaaagcagagatcgtgtgcccccctttcacgggattctcatcantacgggacatgggtaacccaatcgtgcccgttagcatgtttccccgattaaaaggcgagtcccaaanggttacggggaaggnccctgnnatcaactcttataagnagatnaagggcctttttncncaagtccaanaanaggtcgcccgtcnctccagggggggccggtaccaatt

SEQ ID NO: 81367 - DNA, 281 bp, Triticum aestivum
  Clone ID: PAT_TA_81367
agactatcttttttataattttgaaaatatcacctgcttatgcttcatgacgtgtaacattttttttgaaagtgacgtgtaacattattgttagtcttgttttgccatgtagtacaaaatagtgtcttgttcgcttcactgttgtaactatatttttgccctagtcatgtgtacttacagaaacatttcaggatgaagtgacatcaacacaaagatctgcgagcagtgcggcatggccgttaccgaatgattatggattggaattggaatgtgctgatgtt

SEQ ID NO: 81368 - DNA, 618 bp, Triticum aestivum
  unsure (1)..(618): unsure at all n locations
  Clone ID: PAT_TA_81368
aaaaagagaaaaacaaagtgttgctccttggatggtgccatatgaaacggttccttatcgatgtgataattctgttactggaattttacttcacagtctggcaactaccacctatatggaacattcattcatgatgttcatggttccctctaacagtatcttatctgtgttttctcaagtcatcagccttcctatgtctctgatggatgatttcctcgtgcaggccgctaaanattccgagctccacaatacatcanagaagaaaaagaagttatcgctatgactcctgaatatccatgggaccatgganttaaaagaagntgccgtccanacttttgcacttcctaaaaactcttgctttatctgaacctcaatcaacactgtaaagtgtaaacctagcagtggatcaangggaccgtcanaagtgaacaaacactnacaccaagatncnaaactgatgtatttggtcctgttttnagggcaatgtagtnggtctggncnanggcccaaacatanngtgctggaacannagtatcgnacttatacgcgttgangcgtcnanttgtgaaaaataagcnnactntgaaaaaaaancgnggggccggaccatccccaagg

SEQ ID NO: 81369 - DNA, 449 bp, Triticum aestivum
  unsure (1)..(449): unsure at all n locations
  Clone ID: PAT_TA_81369
ttcacatgttgacaagcccgatatttatgaaggtacacctttgtgcttggtggtaaacttgtttcttattcacttatattcagcatttccttggtcattttgtaatgttattttcgtattttgctctgcattaagatttatgcaaagtctggtacttggcagaaaatactgctggtttgtccatgattttctgctgggttgattttgacattaanttaacaatgagtacttcaattatgatattccgaagtgcatgggagcaatatagattcgctattattcngttcgagctatgtggcagaaattagcttcatgcttctctgaacaaactaggcactatacaaggcgctggcgccatacctgctcggtatngacatgagaagatgcatgggctccgcttcttggcctcggtgacnttctcgnncccctccaacgctggtgttgtgctc

SEQ ID NO: 81370 - DNA, 314 bp, Triticum aestivum
  unsure (1)..(314): unsure at all n locations
  Clone ID: PAT_TA_81370
aagcctccgcctttgcgcgcgcatcctgctcagccagccatgaagtactctacgacttctactatcgtcgctgtatcatcgccgtcctttgttcgcagttctagttccatagtagtaagtaaggtgtttgctgtgtcgttcttcgccggcgccggcgccgccgctgttgtaatttttgctcccttcttgaaaggaagaggggagttggttctcttttggggctgcgactcgattaatcgattaattacagcttcatttcgatcgagcttgctatgctagatcctttcccgattcaanaaanaacaaanaaaaaa

SEQ ID NO: 81371 - DNA, 420 bp, Triticum aestivum
  unsure (1)..(420): unsure at all n locations
  Clone ID: PAT_TA_81371
gtcacgtccgccgatgcggccaccggcagcgcgcgcgcgctgtcgatacggacggcgtccgctcacgtggcagccacggcccagcacgccacaataccacatcgcaccatcgatctatcgatcagagcacgccaccaattattcgttcgcgcctctcgtcccgtccactccgccaccgcgacaccgatcggaacggcaacacgataggggcacgtcgccgtcagccggagcgcgacccacgccggactgggcgcgcgcgcgcatgcttccggcttattattcgtcgtcgttgtacgccgccgcaagcagccggcgaagagcnagcggggacagagacggacgtngccgcgcccgctgctgccgccggaacaacggcccgttcgtcgccatcctnggcantccaatccgtcgttggcatgt

SEQ ID NO: 81372 - DNA, 623 bp, Triticum aestivum
  unsure (1)..(623): unsure at all n locations
  Clone ID: PAT_TA_81372
ctgctgctggtgctgagtacgttgttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggttatcaatgacaggtttgggcatttgttgaagggttttgatgaccacattcaatgccatgactgcaaccccaagaagactgtttgatggcctttccaacaaagactgggagaagtggaaaaggctgccaactttnaacacattcccaagcacactggggccnccaaagctgtttggcaaggtctcccccaaagctttaacggaatttnacgggatggcttccgtgttcccacggtgagtttccngttgttgatnctgacntttaacttnccaaaccaanaacctatattaaattaaggtgctacaaggaggatctnagggaactcaanggcatttgggttactttnataagactnttcacgactcanggtgaaanagtcacattcatcaaggcggggn

SEQ ID NO: 81373 - DNA, 591 bp, Triticum aestivum
  unsure (1)..(591): unsure at all n locations
  Clone ID: PAT_TA_81373
gagtttttttttttttttttttttttttgatcgtcgaagagtatttatagattataccatggcacggtctataatacagacatttttatcaaaagtggagttactacagttagatccttccaccaaaggatcaagttagaacactgcagccctacaagaggtgctatatggagacataccaaacaacaccatcctctcctcgcaaaacggcatggccgaacagaaggcgggattatgcaaagaggcatccatccatcaaagggtagtcctgtcntttcgctgctgaagtggtcttgatcatcataccagttacttgtacccagatagtatcatcgcgtcnttgtagtgaaacaaatcaatgctactcaacccctacattctcnaaaggaacactccctngaagtggggtanccgggganatccccnggaanagaacaaaaccgccccncaaaatnagcttggccncctggcaaanaaccaagacctggtngctgtcnggcnaataanactttaggggaggaactccanacgggaaatcgnnnacaaacgttaaggcaaaaacgcacgatngaaaaaaccgatcacgtaatt

SEQ ID NO: 81374 - DNA, 401 bp, Triticum aestivum
  unsure (1)..(401): unsure at all n locations
  Clone ID: PAT_TA_81374
acgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgcaaggagcttggaattactgctctgcacattaagctcccgttctactgggtgggaaacaagacaaaaactccangtccctgggtgctcaagctgcgccttanagnccttgcacgtttctgggcaatgaagattgnccttatngaggattttacccccggnccccaactgacagaacccgccnggaag

SEQ ID NO: 81375 - DNA, 427 bp, Triticum aestivum
  unsure (1)..(427): unsure at all n locations
  Clone ID: PAT_TA_81375
agaagacccgcatcatcccgcgccaccttctcctcgccgtccgcaacgaccaggagctcggcaggctgctcgccggcgtgaccatcgcccacggcggcgtgatccccaacatcaactctgtgctgctccccaagaagtcccccgccgccgccgagaaggaggccaagtcgcccaagaagaagacggccaccaagtcccccaagaagaagtcgccgccaaggagtagcgccccatagcctagcctgcgccgaggaaccgtgtcgtgttgcctggtctcgaattgcaactgtagtgtantggcccttcatcatttcgatgagaaggccatatttaccgtgattctgtgggaatggcgaaagatcaaactttcaaccttaaaaaaaaannaaaaaaaaactccnanggggggccggtaccaatnccccta

SEQ ID NO: 81376 - DNA, 339 bp, Triticum aestivum
  unsure (1)..(339): unsure at all n locations
  Clone ID: PAT_TA_81376
tgcgcctccacttccatcgcctccccaagatcgcagatccgctccggtganaatccgtcgccatgtcttccagcgaggtcncctgcacccttgccgccctcatcctccacgatgacgggatccccatcacttccgagaanatcgcgacggtggtgaangctgccggaatcaangttgaggcctactggcccgcnctcttcgccaagctcctggagaagangagcgtcgatgacctcaacccttccgtcggattctggtgggagtggtngctccaactccgctngcngctgccccggttgcngttgggctnccnnccgcttaagaaantaanggataaaa

SEQ ID NO: 81377 - DNA, 249 bp, Triticum aestivum
  Clone ID: PAT_TA_81377
gtaggagttatgaaagtgtccctaagcaattgactacgttactagaccgataacaagttttatgtgggagaggcataagctaacatactttctcttcttggatcatatgcacttatgagtggaactctagcaagcgtccgcaactactaaagattaattaaggtaaaacccaaccatagcattaaagtatcaagtcccctcttatcccatacgcaacaatccccttactcgaagggggggcccgggtac

SEQ ID NO: 81378 - DNA, 610 bp, Triticum aestivum
  unsure (1)..(610): unsure at all n locations
  Clone ID: PAT_TA_81378
gtcataaacccaagtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactgggactcaaggaagggtccacggcttccacgtgcacctctttggtgacaccaacaacggtgcattcaactgggncaaacttnaaaccttgcnggcatgtncatggggaccagaagatgaaaccgccatgctggtgatcttgggaatgtgacaantgggagcngatggtgttgctaacacaagttactggactgcatatccccttacgggacaaattnattgttggccttntgttgcctccacggtgacctgatatcttggaaggtggcatnactaacaagacatggaacctggtccctnttcttcggacacggtccaagntaaagnactccacggcaactctaantttggaactttcaaagaattgaaccatcaatacaanatntntacttaagtgacatcnnatcaa

SEQ ID NO: 81379 - DNA, 491 bp, Triticum aestivum
  unsure (1)..(491): unsure at all n locations
  Clone ID: PAT_TA_81379
ccacatatnaacccgccaacacctccacctaaccctccacaccacatgggcatcatcgtggngttcgtctccctaagnggggctcctcctgcntgcaatgcctaagctgccttctgctttgcacaangaaaaaaggaangtagggaaggaccaggaaaagggaaangggcaaaaagggtaatttgaaaacctttcaaagccgaacccaaaggtcccaaaggntccnacaaaaaattccgggnccaaatgttccgggggccccctggggggggaatttccaaaggggncngttnaggggcctggaaccaagttttntacccnaaaggggaaccngttcnaaangtttcccaaaaaaagaggcgngggtttaaaannggggggaaaaatttcccaaagcaaaaggggnncccngttttcttgggcnnaaaagncaaagntntccanaggggncaaacacnaaaggnccccaccaagggnaaangggngaaaaa

SEQ ID NO: 81380 - DNA, 331 bp, Triticum aestivum
  unsure (1)..(331): unsure at all n locations
  Clone ID: PAT_TA_81380
ggcaaggccctcttcgtggacgtggacgccatcctcttcgagcacatcctctggctcgccggctgccacgaccgctccgccgtctcccttctccagcccgacctccaggacatcatcgacttctactcccaggacgcctgaacgaccatcatctcatcacattctttgttgttcagtctacccattcttttatttttcttcctcttcttttccagatgctagtgtgcataatgttcagatcatctgttagaagttacgaacaagntgnaaggnaantaaaganagnataancttagtagataanaaacttggttngtgcaaananggaaat

SEQ ID NO: 81381 - DNA, 461 bp, Triticum aestivum
  unsure (1)..(461): unsure at all n locations
  Clone ID: PAT_TA_81381
gccgcctcccctcccttcgttcttcttcttcgagttgggtagtttacctctacccaccagccatgggtaaggagaagactcacatcaacatcgtggtcattggccatgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaacccaaatcngnaataattgctctcctgggaaagttcgaagaacccaaccaaagttactactgcacccgtcattgatgcccctggtcaccggtgacttcatcaaaggaacatgatcaccggtacctcccaggctgactggctgttctcatcatcgactccacacgggtggttttgaggctggtan

SEQ ID NO: 81382 - DNA, 539 bp, Triticum aestivum
  unsure (1)..(539): unsure at all n locations
  Clone ID: PAT_TA_81382
atgggtctcccnggntgcaggtttttttttttttcaagcaacagtatatccaatanaataagctataagaaaaaatacataatatccaaatttgcacnattgcctaatgttgagatccaactacaaatggcattatttggtatagggattaaaagatatcaaccctgatgtatttttcaagctcttctgctattgcttgacagagcataagttcctctccagctttgatcctgcagagtccatccgcaatcatttatttgagcctcagttacccagaggngtaggatatgtgcatggctaccaagctattcaaaggntaaagccctaangaagctggttctttggaaatattntcccctggantttttccggtatnggaaaaatccntnggggtggataagaaaaccaagattcctgnntcaaaagnaaggtccaacctgggggaatcatccttcaacacaattcctgannaagtctggttgttggtcattaagcaaantggagccaattggctgcntttagaatnccccaataccagg

SEQ ID NO: 81383 - DNA, 441 bp, Triticum aestivum
  unsure (1)..(441): unsure at all n locations
  Clone ID: PAT_TA_81383
gtttgacaaaaccaataatgacacttattgaaccatgtgatacatgtggtatgcaatctaaatctaaataatttaaataaagaaaacaatgacacttgttaaaaagtgattgacagaaaagtgttacatcttctccatcgggcaatcccgccatggagccagctaaccaccatgcattctactaggtactcctacccaacgttagttgttgactctccagcataccttcctgatctctgcgccttggtcggctttggtcttggaaccccccaaaattttttcccccaaaaattctccaatgggctcctcctcgaaacttcctctcccaacgcccctgcctttttcgccgttttctgtcacctgctttaattggtttcgggccgagtttancacggcgtccgaggggaagagggctttnggnnaatcacatnggggggggga

SEQ ID NO: 81384 - DNA, 462 bp, Triticum aestivum
  unsure (1)..(462): unsure at all n locations
  Clone ID: PAT_TA_81384
ctgaaatgttggagcaacaacatagtgataaggctcacatagaagtcagttgtgccgacaaaatgagtgaagtgctctatgatgataacaataccttgaagaagaatacaatctgtggtgggaaggttgctatagagtgccacttggccttattacataataaaagttcagaagctaggagtaacgccatttcatctccaatgcagaagaggccctttgcgtgccagtgccatgtagatggttgcaccatgagctatgacagtaagaacaatttggcccaaaggccaattttttaaggggaaagtcccatgagccaagaaggaaaaacggtttcgcacggagattcagtgggtgcagcgaggagttttcttcaaagaataaaaggaagattcaggagggatctaaggcnaagttgagctttccaccaataggattaattgtgtcagcacctcccctgtcggg

SEQ ID NO: 81385 - DNA, 468 bp, Triticum aestivum
  unsure (1)..(468): unsure at all n locations
  Clone ID: PAT_TA_81385
gttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaanggagggaagctggcctggaattcccaaacctttccctggtactttggcaacatggggggcctggaaaagaggtccaagtgctaatcgcactgttatgctaaaatccaatgctgtcctcaagtatttttgctcctanctaagggttgtcaagtcgactctccaatgttggtgtcaagtaacgtcaatgttgagttcctgaaa

SEQ ID NO: 81386 - DNA, 452 bp, Triticum aestivum
  unsure (1)..(452): unsure at all n locations
  Clone ID: PAT_TA_81386
gagggtgcggcggcggcggctcgaagcccaggttgggaggtatgagacgagaaaaggggagaggggatcgcangtatggatggacacatgggttagggttttcccgtttttttcgtgtccgacaagtattgtggggtatcccaccaatgtccaatttagtttaattttttggatttagaaaagaaaaaacaggggatacgtatgggatacatttcggcgggtatccaagacaaattcttgtaatctgggcgtatctaacccccntggaattacccattcaagntttccctgactgggaattccggggntaaaccgttaccgtcaattacaagattaaatgcactggctgnaattatantaaatttanctaacnaatatatttgncngaattgaacgggnnnggagatcgnagaacttnggggggnggcagattagcattggngggggggggn

SEQ ID NO: 81387 - DNA, 462 bp, Triticum aestivum
  unsure (1)..(462): unsure at all n locations
  Clone ID: PAT_TA_81387
ccaaggttgagcttgcttcattatatggtggatatagtgaccagcttgctgttgtagcagcatttgattgttggacgtgtgccaaagagaaaggacaagaagctttgttttgttcaaagtactttgtagcttcaaacaccatgaatatgttgtctagtatgaggaaacagcttcacagtgaactagctcaaagaggatttcttcctgctgatacatctgcctgcagcttgaatgctaaagttccaggtatcattaagtgctgtccttgtggctggcggcctttaacccccaaatgggtagggaacgattgctccctccctccggccaaaaaatgctaagaagggcagttgtggaaacagcaagtgggtgccaaagttcgactacacccgcgattcttccaactttaacttgtcatttaataaacctctgggaaccactaangtatttgatgaaacacccaag

SEQ ID NO: 81388 - DNA, 409 bp, Triticum aestivum
  unsure (1)..(409): unsure at all n locations
  Clone ID: PAT_TA_81388
agagattctaagtgccatcccatgtactagtagcaaagagaagaaaatgatccaacaatatacatgtcacttgtggactagagcacatgacgcaccttgtattcaactccctcacagtcggtctgcactcttgcagtgtccacctttgtcacctaaacaagctatatacgagaggaaccaaacagcagcacatcacaccgaggaagctcgcgtactctgctcgcatgagcaacatgcccctgtacatgttacgcacccacagtggttaacccggttantaatataccgccctctaaaccaccctaacggccagcccagctgctgctgctgagttactgctngccaatgcctggtggtggcgnctagtgccatcgtcttcanaganggcagcatgcattgcgctcgtggg

SEQ ID NO: 81389 - DNA, 461 bp, Triticum aestivum
  unsure (1)..(461): unsure at all n locations
  Clone ID: PAT_TA_81389
ccaagatccaggacaaggagggcattcccccggaccagcagcgtctcatctttgctggcaagcagcttgaggatggccgcacccttgcggattacaacatccagaaggagtccaccctccaccttgtcctccgccttcgtggaggcatgcaaatctttgtcaagaccctcactggcaagactatcaccttggaggtggagtcatctgacaccatcgacaacgtgaaggccaagatccaaggacaaggagggcatccccccgggaccaagcaagccggcccntccaatccttttggctggggtaagcaagcttngaagggaatgggccggcaccttggcaagaactacaacattcagaaggagtcaacccttcacttggtggctccgtctccgaaggtggccaagtaagctcgtgaccatgggagctgcttccgttatctgggttcaatgtctcggggtctt

SEQ ID NO: 81390 - DNA, 297 bp, Triticum aestivum
  Clone ID: PAT_TA_81390
tgaagacctatgcacatccctagagctattcaacctggcgatcaagtgcgccagggctgaggaagggcgcctttccctcctcgaactcccggctgccgacccagaagagaagaagcccaaggccaaggatgcgaagcgcaagggggctgccgtgcttgcagcggaaccaaacaccaagcgaggcagggatcagcctgagtcatccaagggcagccggtactgcatgtaccatgacctacacacccacaacaccaacgaatgtcaagagctcagggccgtgagacatggacgtgtcgg

SEQ ID NO: 81391 - DNA, 574 bp, Triticum aestivum
  unsure (1)..(574): unsure at all n locations
  Clone ID: PAT_TA_81391
gcctaaggtccccacagtggcttcagatcttcaaaaaacaagggcagctgaagccaaagctagaaagcgcaagaccaagaacaccactgacaatgcttcacctaccaagaagcgtaaaaccaagaagaaagatcgggttgctcccacagagccccttgtcgtcgagccaatttctattgctcgtcctgcatctgcacaacaagagcgtcgtttgatagttcatgagcctgcttccccagaggctcctgaagctgaagacattccagctgtcaaccctaccgcagctgaagacattggtcaccaagacaatgtagaagatgatgaagtccttcctcagatcgagcacaatgtggtatcatcgcctattctcacgaacagtgaactcatcagcattgggtcgtccattgacgccaatcgctcaagatgantcatgggctgataacctcaagatccccccgtcaagcagaaacacaagctactccccaactcaagtcacantccnggngcttgaagatgagacttnanggccacctatccatctccanaangtcgctngnttcanaggctcntaagg

SEQ ID NO: 81392 - DNA, 585 bp, Triticum aestivum
  unsure (1)..(585): unsure at all n locations
  Clone ID: PAT_TA_81392
aagtttgggagtttcttcttgggtgctatgccttaagtagcacaacagagtataggaggaaactaagagccgctcgaagggagaaatatcaatgtttagttaggcaatgcaagagtatgcacccaagcattggtacaggtgagcttgcgtatgctgttggctcaaagctgatggatgtcaggactatgccaaaagaaaatgacagtagagaagaagtcagcacaagtcaacgagcctcagaaaatgcacctggcagtacagtagaaaattccaacttaaattatgactctggtggagcaccacagtcacaaagctgtagcaaatcagctgaagtagctggtttcaacgcacataatgatagctctgtatataattcatccaaatttatggtgtcctccacagtggtgaatagttgcttgtcagattctggggattacaatgacatgggtgaaccaagatatgacagtgagacattcacggggtatccctccctgcctggtacaaacttgttcgcaaatgatggtggggatgtcatggggttgacgaaagtcttgtggttccanttcctgaagataggtaagacan

SEQ ID NO: 81393 - DNA, 383 bp, Triticum aestivum
  Clone ID: PAT_TA_81393
agcagaaaaataatgtagcttcagtgagttttgatttattagtaatacaactcagacgtcataatccaactggtttaagtggtgtctttttctcagtctcatagatcaggtaattatggaaaggatcaacttcccaccgcagcaatatgtttagattctagtcaacctaattatatgatatccttaaataaactcgaacttatattatcgttgcatctacgttacaatcatgagaggaaaaaaatacccgatagggttgtgtaccatgtcatgctaccagcaccttttagcaaaactgggcacatcgcaccatctatttaggcatgacatgggagccacaccaaattgatgctttccccttagacttgacggtatggcaaggg

SEQ ID NO: 81394 - DNA, 248 bp, Triticum aestivum
  unsure (1)..(248): unsure at all n locations
  Clone ID: PAT_TA_81394
caacagcacgacggcatggtggtggatgcagcagaactccggtagggcttcgctaagcgacacnggnaaggaggaggaggtgtagcaggaaggggaggngccaagggcttcanggtgcggccagccctccctcccctccctttatataggtgcaagagagggggggaagggcgcagccctgccccttcctcaaggttangggtgcagccaagaggggggntgggagtccatcctcnccaaggcatctc

SEQ ID NO: 81395 - DNA, 385 bp, Triticum aestivum
  unsure (1)..(385): unsure at all n locations
  Clone ID: PAT_TA_81395
acaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggngttccgcgtggtgtcgacnagccccgaaatgttggcgctgcgccggatatgaatccaccgtcnacggcacctgcggtggaccctgcaatgaatnncngattggttcatgccggnttaatatgttccgccgaanattaaa

SEQ ID NO: 81396 - DNA, 481 bp, Triticum aestivum
  unsure (1)..(481): unsure at all n locations
  Clone ID: PAT_TA_81396
gagattgccgtgaagaaacttcatccctttcaaggacttgatgacaagcaattccataatgaagtccgtaaccttatcaagatccgccacaagaatgtcgtacagttgattggatactgctacgaatcaaagcataaatacatcgagcacaataaggagctccgttttccgcgagaacgatggaacgagtcatctgctttgaatatatggagggaggaagctccgataaacatattacaggtaaattttaagatattgggctgggctccgaaataattgtcccactgcccaagctaaataatggggntgntactccatccgaacacgccaattgattcgngtttgagtatactgtgtacgtgtaatgtgtgttgttaaggccantcccgttcccttgnatatttaggtttggccacctccggtacttntatnactgcccnnggcaccgtttaatacatcgcgatgcacacccaaaaaaaaa

SEQ ID NO: 81397 - DNA, 327 bp, Triticum aestivum
  unsure (1)..(327): unsure at all n locations
  Clone ID: PAT_TA_81397
acttcttggccggacggacggacaacccacccacccacccganccacattgtcctgcnaaaanactgcattttatgatcttanaatttnttngngagctccagatnaanaccangttgatcctgcaaaattggntanctggtccggcaaggctgggcttcagaagatcagccacngctctaaggaaancaacccgtgttacactaacaaggggaatacaatgtgtcnancgctttcctaantttctgcntgcatcgccttctttccacngtgnccgtngtgccctcccatctncangggnggcatccttctgatctcacntaagctt

SEQ ID NO: 81398 - DNA, 622 bp, Triticum aestivum
  unsure (1)..(622): unsure at all n locations
  Clone ID: PAT_TA_81398
ccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccgggcgccatccgcaagggtgggacacatccgtcatcaaaggcccgtccctgcaaggttgttgaggctccacctccnaagactggggaagcatgggcacgcaaagtgtcacttttgttgccattggacatcttttaatgggaaagaagtttgaggatatcgtcccttccaccccacaactgtgacgtccccccatgtttgaccgccaaagatttacaactggattggacataactgggatgatggtattcaancttccnaactggagagtggaacacttaggatgacctganttcccactgagagttccgcttgggccaattnaaacggtttncctgatggnaagactgatccgnccgttattccgcatgggtgaagacatttgccggtnaagatcngtgggggaattacacgtctgtgctactggaatgggacaatgtccggtttgggaaaatctggatcagaangttggtgaaaa

SEQ ID NO: 81399 - DNA, 620 bp, Triticum aestivum
  unsure (1)..(620): unsure at all n locations
  Clone ID: PAT_TA_81399
cgcctgcgcgccgccacacgaaccccccacccaacccgagcgagcaccggccgaggaggaagagaaggtgagatggctcgcggcgcggcggcggcggcggcggccgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccggaacctcggcgactccgtcaccgtcacgcgcgacaagagcaaggcaccgtcacctccgacggcgccttctcccaagaggtacctcaaantacttngaccaagaattactttgaagaagcacaacgtgcgggactggttccccgtgatcgcagccaacaangacgcaacgtnttacgactccgggtacttcaacatcgctaaatggaagggcgaagaaggagattanatgcattgtaaatggtatgctngtnattttgaactgatctgatactcctaattaccactanctaagttgtccctttgaaatggtgttattcgaagacctaaatttgtcgcgnnncaaattcgaactataagatatanganattgtccgttcacgan

SEQ ID NO: 81400 - DNA, 546 bp, Triticum aestivum
  unsure (1)..(546): unsure at all n locations
  Clone ID: PAT_TA_81400
aacaacttcgcccgtggtcattacaccattggcaaggagattgttgatctgtgccttgaccgtatcaggaagctttcagacaactgcactggtctccagggattccttgtcttcaacgctgttggaggtggaactggctctggccttgggttctcttctgctgggagcgcctctctgttgactatgggaaagaagccaagcttggggttcacagtgtacccatcaccccaaggctccacctctgttgttgagccatacaacagtgtcctgtccaccatccctcccttggacacactgatgtgtctatccttccttggacaatggaggcatctatgaatctgccgccgtcccctttgaatntgangcccaacatacacnacctcaacagctgtttccccangcatttcancgctgaanttnccctgaggttggangngccccgaagttgatgtcaagattccaaacaactttnggccctacccagttcattcannttccncccaancccaatgttncaacngaaangctacaagacaangccgttgc

SEQ ID NO: 81401 - DNA, 599 bp, Triticum aestivum
  unsure (1)..(599): unsure at all n locations
  Clone ID: PAT_TA_81401
gggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactggataagcttggcctgcacccccttcgccagcgacactgggtacatccagacacttggtgctacaaccaggggagggactgtttgaaagcctggactggtgtccagcaacattgccaacaanccctaatttncngtccaaatttttnaaggactangacgtttgggagggacnattgatccacngggtacctaggattgtttttgggatggaagggtgctagcatccccgtagtactgtgtatttccctgaatnaacactactgaccaccccggcggggttcaacggcancatgtttaatgtttttgacccnaaanttctccgnataacactaagaaccgtcattcgnaaaatttcaacncttcgtcaaaaaaaa

SEQ ID NO: 81402 - DNA, 466 bp, Triticum aestivum
  unsure (1)..(466): unsure at all n locations
  Clone ID: PAT_TA_81402
gcggcgcgggacaacaagaagaaccggatcatcccgcggcacgtgctgctcgcgatccgcaacgacgaggagctcgggaagctgctggccggcgtcaccatcgcctacggaggcgtcctgcccaacatcaaccccgtgctgcttcccaagaaaggccgctgcggcggtttccaaggagcccaaaggcaggcacgaccaatctcccagaaanccccccgccaagaaggcggcccgacgctttangcccggactcccctatccggttccccgtccacctctccctcctctctgtttnctctcctgtctccggttnacccntacgcacctagttttcannctcctcctggcctccgtttctgatccatctttgtcatggttcattgctgcttgttttacttgttttgcctggttcccgcataagtgcatcactttaccccgtactttgattaaacccttatttcctttt

SEQ ID NO: 81403 - DNA, 322 bp, Triticum aestivum
  unsure (1)..(322): unsure at all n locations
  Clone ID: PAT_TA_81403
naannacgatccatttggnaccatcgccgccccgctcgccctctanctcnacgccgccatacaggcgctgcantccatcaananggtgctcgccgacgccagccagcgcaagcgctagntcaaccgcgcnctcgatggngcaacactttatcatatatctatcctcgcatcncattgcatgtgtttgtacnttggcttgcatgtaattttccgtttatctcttccctgtaanattgtaatccatgtaccccgtttgcttcaatcanttaagtaaaggancangtaattgcncaantttgannggaaaaattcanataanctc

SEQ ID NO: 81404 - DNA, 538 bp, Triticum aestivum
  unsure (1)..(538): unsure at all n locations
  Clone ID: PAT_TA_81404
ccgcagcctccatcgaagccaagagaggagcagggcgaaaggaggccgtcggcgatgtcggagaagaagcgcgcccccggcccgcgcaaggacgaggtggtgacccgcgagtacactgtcaacctccacaagcgcctccatggatgcaccttcaagaagaaggcaccaaatgccatcaaaggagatcaggaatttgcacagaaggccatgggaaccaacgatgtccgcattgacgttgaactcaaacaagcacatctggagcaagcggcatcangatgtcccngaggaanccgngtcagnttgccccccaagagaacgacgaggaggacgctaaggagantgtccctccggcacattgctgattcccccaagaagccttaagtttggtacaggttttggagatnagactaacccctgtccgtttttcnnccattnattttaaacataccnctgaacatatggatcctgctttacttatggtaccacngtcaagantcccagnttcctganaaaatttnnacttgggaaaaaaaaaaaa

SEQ ID NO: 81405 - DNA, 414 bp, Triticum aestivum
  unsure (1)..(414): unsure at all n locations
  Clone ID: PAT_TA_81405
ctcattacattagttaccttgttgtccatgagaaggaacccttagtacgtttgacccagctccggtcggttggggaatctacagaaaatggtangattgttaaagaaaatatggtaacatgcaaatatgggcccaaattgaaagaattgtacaatagtcgaaatcgaaggacagaagtttataattaaacagatgggtaaacatgatgtcatggaaatatgagagtaatcganagaataatacatcattaatttgcctaatatagaaagaagagggggaaacccctttgacatatatggtgcatgtggcaccttttatccanatgtngtaatattgcagattgacataccgngcacatcctcangcatctggtacggtgagatggaatatctagcggnggccgcaangtcctga

SEQ ID NO: 81406 - DNA, 603 bp, Triticum aestivum
  unsure (1)..(603): unsure at all n locations
  Clone ID: PAT_TA_81406
ggggatcggcaagacgcagttttgtctgaagcttgcgctgttagctactttaccagaatgctacgggggcttaaacggtcgagttgtgtatattgacactgaatccaagttctcttcacggaggatgattgaaataggtcagaaaagctttcctcaaatatttaggcaagaaggcttagcgcaaaagatggctgggcaggatcctaagtgatgcgaccagcatccattatctgatttccacaaaaanttggaacagatgaaggtgaccctccctcccaaaatgatgttaatttactcattggttgatagcgtggctgctttccatgtcatcnggagaacgaaaagaggtacaacaggttccacacaacaccctccctaagatgggtcctttcatttccttaaancctatancaagttngacaaattccagttgtattccaaacnaancccgcagccaaagtatgatgatgggtancattacccctttgaataaaaagatgggtgatgggcaaggngctgaaaattgacccactggtgctgcncangaccatggccaagcggaacacgtcanctcnagcnaccagncagntcacaggngcnanc

SEQ ID NO: 81407 - DNA, 518 bp, Triticum aestivum
  unsure (1)..(518): unsure at all n locations
  Clone ID: PAT_TA_81407
cctagttccatggcgaccgccggcaacgcccccgctcccgcaagcgcatcgaggccatcgtcctcaagcacgcgcgcgacggaagtgccttcaccaagctgcgaggtgtgcaacaaggacgtagccatcgtcctcatcgacctgcacagctgcagcctccactcccaagatacgcctcaagcctccggtgcatctcaagttcctccacctattccaaatgcatcttccggttttgggccggcccgggcggcatgagaagntctgtttggttgcctccacaaggaccatgganccggaggctggggcagttctggagtttaatttttcaattancccggttgtnatattttcaactttatagccggttgctcctntctcancactttgtattttnggggaatgtccncatgttgattcctaccttccaacctggtcaaaacattaagaaacctacccntttnaagaggaatnggtanatttggtnnntttccttggagannatnataaanctngtctgt

SEQ ID NO: 81408 - DNA, 582 bp, Triticum aestivum
  unsure (1)..(582): unsure at all n locations
  Clone ID: PAT_TA_81408
gccgcgttcctcaagaagaaccttaacacggtcgacatggtcgcgctctcaggcgcgcacaccatcgggaaggcccagtgctccaacttccggactcggatctacggcggtgacaccaacatcaacactgccttcgcgacgtctctcaaggccaactgcccccagtccggcggcaacaccaacctggcgaacctggacacgacgacgcccaacgcgttcgacaacgcctactacaccaacctcctgtcacagaaagggctcctgcactcnggaccaggtgctcttcnaacaacgacaccaccgacaacactgtccgcaactttgcgtcccaacgccggcggcttaancagcgccttcacgacggcangatcaaagatgggaaacatcgcgcngctcaccgggacgcagggccagtttaggtcaactgctccaaggtgaactcctnatggngtatgcgtcggnanacgacacttaatgataaggccccaancatggcaatacactttcaatccagattaacntgtttttnaaacantgcacaacatcagcatganaanttttaanacgtngaaaaaaaaaaaa

SEQ ID NO: 81409 - DNA, 467 bp, Triticum aestivum
  unsure (1)..(467): unsure at all n locations
  Clone ID: PAT_TA_81409
cggaggcgcacgccgcgcgcgtcgggatccccatgctcacgctcgccgacgccgccgagatccacctctccatcgacggcgccgacgaggtcgacccggacctcaacctcgtcaagggccgcggcggctccgctcctccgcgagaagatgatcgaagggcgcccggcgcccgtttcgtccgtcatcgtcgacgatccaagtcctccccccgccttcggctgcacgggtccgtgcccgttcgagtcctcccccttccggcancgcctacacgctcngctcnacccgcatngtgtttcgacaaattgcccggnttccnacgccnagcttaaagaccgtncaatcaaaaggcccggcgacggcaagaaggantctttttcnaacnganaagggaacacacntcccaatttcttccccnggacggataaacgaacttgggcnaatnancacancttgttggcacaaggctc

SEQ ID NO: 81410 - DNA, 606 bp, Triticum aestivum
  unsure (1)..(606): unsure at all n locations
  Clone ID: PAT_TA_81410
atcccgcaccgccgcccacgcatctcgagtagtttccacctcgccggagaagtagaagcaggatggccggaaggaagggcggcgacaggaagaaggcggtgaccaggtccgtgaaggccgggctccagttccccgtcggccgcatcgggcgctacctcaagaagggccgctacgcccagcgcgtcggctccggcgcccccgtctacctcgccgccgtcctcggagtacctcnccgcnagaggtccctggagtcccccggcaacgcgggcaaaggacaacaagaagaccccgcatcatccccgcgccacctggctgctcgcccgttccggcaacgaccaagagtcngcaggctgtcnccggggtcaacatcgcccaacggcggtttattcccaacatcaatcccntctgtccccaagancccccgccgccngccganaaggaggcaatcccccaaagaagaactccaccaanccccaagaanaagcccccccaaggantaccgccacaatagatatatngnanacccttagncancnaggganaggaaaagactttgtgggttggtcgnagtatncctanccgtanggttttcatgggttgataagg

SEQ ID NO: 81411 - DNA, 516 bp, Triticum aestivum
  unsure (1)..(516): unsure at all n locations
  Clone ID: PAT_TA_81411
tcgagacggtgcttggagattgctcgtgagactcttgatgcaaagcgttctgtaaactctgagcgggttgctggggcatacactgagatatcgatgttgtatgagtcaatgaatgaattcgagatgtctttgtgtttgatgaagaaaacacttgcgtttctccgagggtgcctcaagggatgcagcacattccaggggagcatctctgcaaggatgggtttctcctccctgctggacaaaacgaattgatgancctgtccttttcctgggagaaagctgtttgagaagttngaaaaactgcttttggcctgcccattttgggttnagatttgctttacaagcatctgggcgaggcttanattgaaatggggcaacccggacaacctataantcctttggccttgcaaatgacaccattaatgctcatttgggctgaaacatgagatcccatggaatcatcaaaggacngcnatgcgtnttggncggatnggggagtanaagatgccangatttcaa

SEQ ID NO: 81412 - DNA, 471 bp, Triticum aestivum
  unsure (1)..(471): unsure at all n locations
  Clone ID: PAT_TA_81412
ctggagtgtgctttgagtatctggtgcttggtgtacctgactgctacggctatggggaatcatctacagaagatgatgaagtgcttctgataaagtttgtcctgaatgcacatgagttttttctccgtgaattcagatttgggtagctttctgctgtcctgcgacagagtccaccatgtatgttgttggacatatatttgggccgccgttccgagcttggcgtgtacttccaggaaacttaaattacttcccttccatacagtccaaggatgacttccctgttttaataatttaaatcccgcacgccggacatgctnagtaatagaatgtccacaanttacatgcctatttaccattaacacgactcctatcacaagtacatggtgtacaaccttggttggcttgtngtggtggtgttatgggacaatgttatcaagaatcaccttgtcctttcaanacaacacgaaaaat

SEQ ID NO: 81413 - DNA, 651 bp, Triticum aestivum
  unsure (1)..(651): unsure at all n locations
  Clone ID: PAT_TA_81413
cgagcccaagaggccctcagacaagcccctccgtcttccccttcaggacgtttacaagattggtggcattggaactgtgcctgttggccgtgttgagactggtgtcatcaagcctgggtatggttgttacctttgggtcccactgggtctgacaactggaggtcaaatctgtttgagatgcaccacgatctctccctgggaggcgttccctgggtggacaacgtccgcttcaaacgtccaagaacgtttgctgttaaggattcttgaagcgtgggttttgtttgcatcccaactcccnaaggatgaccccngcccaaaggaagcggcaactttnactccccaagtccatcatccatgaaccaccctggtccagattttngcaacggtaccccccagtgtttggactggcacacctcccacattggctgtcaatttcccccgacttggtgaccaaatttnacaggcattttgggtaaggacctngagngctccaatttcccngaaaacggtacccngatctgaaaatnttcccacaacccangtgtgggnactttcaactacctcccttggcgntccccgtcnttanataaanaacgtnctgttggngtcacaaggnctggnaaaaaggccacgtgcaagtncaaggcccca

SEQ ID NO: 81414 - DNA, 301 bp, Triticum aestivum
  unsure (1)..(301): unsure at all n locations
  Clone ID: PAT_TA_81414
gtgccggggccgatgcaggggaggggcttctacggttgcggtaactggacgccgtccatgggagcacactgctcctacttcacgtgggcagattaattgctagccaatccatgagtttggatttggggaattaataccctataaattatacgtacatgtgcgagtatcactccacctctttgatttctcttgtctgtgttgacaacacccttttgacttgggtttcttaacaactccaaatcctattgcgtgggtgtnttggatatgtccatgaattccaaattcctataaaaaaaaaaaa

SEQ ID NO: 81415 - DNA, 639 bp, Triticum aestivum
  unsure (1)..(639): unsure at all n locations
  Clone ID: PAT_TA_81415
tctgagtcgacatcggtgagctcgggtgatggggagaaggaggataagatccagagggaagagcggatcaaggccaggaaattggaaaactggctgtggtggaaggatcttgcgtctaatctggcatatgcgcccatgactgttcactggtcgctagagcagggcttgttgagtgactggggtgttggtgcttgtggtatggttgctgggtggggcactgttggctgacgcctggagaaagactgcgtgagtgtatggcaggtccatccaatttgggatacaccgcaggcattcctcaaatcacacattcctaccgcgatcatcacatggccatcaagcacanctggttaaaagtccattgttccaagtaccttccgtccccgtgtttaanaacggcaaacntcaaaaaaatctacaaaagangganngaatacnccagaaagaagaggacgtatgacgtccaaatnccacncgtncaacccntctagagncccatcacantnttccacgtcaanatcatntcacagtaaanaaaaaaaaccnagggggccgtacaatccctannatcttanccccangctctttantcgncggaactggttcaatacctgaaaaccttcagngtaanaaggccccttc

SEQ ID NO: 81416 - DNA, 589 bp, Triticum aestivum
  unsure (1)..(589): unsure at all n locations
  Clone ID: PAT_TA_81416
gcccgcccgccgccgccgccgcacagccgcaggtagagaaggcaaggaggaagggaagatgccggcggggcacgggctgcggtcgcggacgcgcgacctgttcgcgcggcccttccgcaagaaggggtacatcccgctcaccacctacctgcgcacctacaaggtccggcgagcatgtcgacgtcaaggtgaacggcgccgtccacaagggtatgcccgcacaantctaccacggcgcaccgtccgcgtctggacgtcaccaancngccatccgcttcgaatttaacaagcagttnngaacaggttcatccaagaaaggttccatgtgcgtnttggacaactncaccatccaantgcaacgagattcctcccaanaggactcaacaacgacaactnnaagcggagccaagnncnttgtgagncatcaacaccaanagnancaacaagcccaaccttggttnatggtggagnacacaatccaacgcacccatcccgncattctcactttcaaggnggtaacaaacctnttttcctgacaaacttaccatctaatacanctgtccatttggacnatatcctttccccgatt

SEQ ID NO: 81417 - DNA, 252 bp, Triticum aestivum
  unsure (1)..(252): unsure at all n locations
  Clone ID: PAT_TA_81417
agaagctcctagccaacaccaatcaaagcttccatccaatcccaagcaacctcgacgatgtcttgctgcggaggaaactgcggctgcggtagcgcctgcaagtgcggcaacggctgcggcggctgcaacatgtacccggaggccgaaggccgccggcgccaccctcctccgtctcccgctaccgccacccacaaggcgantcccggcggcatgggagatggcggcggaaaacggcggctgccggctgcaccc

SEQ ID NO: 81418 - DNA, 623 bp, Triticum aestivum
  unsure (1)..(623): unsure at all n locations
  Clone ID: PAT_TA_81418
ataacaaggcactgaaactgctagtaaaaacaatattatccaacatgataatttcaaccagcacataggcccaccataaaccagaacatactgttaaagagtacatgtctaaattttatgaaagctagaaactgaaagtcatttataggcaagaatttgtaactgatccttttgggtctacatccaatgaattatgagacgccagttgttttgggtacatatcctaaaactaccatcaagggatgccaagccaacaaagaacttccttttttcaagaaatagcacacatgtcttctcccagccacgcatcacaacactctccgtccatttttagaacttcgccatccgcacgacgctgctnaaccgccggccacatttcctttgaaaacttgggatagacagttacattgattgatagtgcactaaangagaataatccctaagaaagggtgttaaccccatacctaccccaaagattgncttcggcagttanataaacncccatccanggggttccaacacacaagtnngaaatcggaccgggaccttcctacatnggaaacctttngcatnaccgccagngtcccganncgaagccgccaaccgngcatttgcnagggaaa

SEQ ID NO: 81419 - DNA, 612 bp, Triticum aestivum
  unsure (1)..(612): unsure at all n locations
  Clone ID: PAT_TA_81419
ctgaacttgagaaacacaagaataaatgagctatcagaacaaatcggacttctagtgttcttacagatgctggacataagaggcacatatgtgaataaattacctgcatctgttgctaatctcagaagattggtgtatctccttaccgacacgggtgttataattccagatggaattgccaagatgcaagcactgggagatactgaagcgggcgcctcttcaaagcaatcagttaactttcctgcaaagaanttggncaactaaagaatatgcgaaagtgatccttgggantgcaggttaccgaccaaagaacatatcctgcatccttgggaggctttaccantcctgattgncccctaaaagatgaaantacaacaaagggtaatgacctgctccacgtccaantgggcactgggtccccatgctttaggantactttaccataaantacngtttggaggatgggtttattgtttggaccaattcagcccaagctaaaactgtcttccttcaacgcaggaancncccccaacatgacttccnttccggaccgtaccccaaccggaatncaaagtaatactggcgggcanatgcgttcatacaaaggtactg

SEQ ID NO: 81420 - DNA, 242 bp, Triticum aestivum
  unsure (1)..(242): unsure at all n locations
  Clone ID: PAT_TA_81420
gtcaccttctgcccccgcgccggcacctccagcagcctcaagtcgagcaacgacccgttgccgaggccgggcgacgtggtcgccggcgcgcaggtcgcggcggacacgtggctggcgagcctggcgaccggcgagagcgacgctgccgcggccaggacggctgcggcggcggcgctccgagccgcactggcggcngcggccgtggccttgcttgtgtcatcactctaactaatcacgcngtt

SEQ ID NO: 81421 - DNA, 262 bp, Triticum aestivum
  unsure (1)..(262): unsure at all n locations
  Clone ID: PAT_TA_81421
ccccttcaaagaagtccttcacgtgggcccgcacgatcgtcgcgttttcctcctcggtcctcttgtacggtaacttctctagaggcttgagaggtggaccgtatctgtattgcctcccgcctctgctggctgtactgctagacgtcggagcagacgaagcggctgtggcgcctgtcttctttcatgcttgcttacgaagccggaggagaaggactacgacgcaccggagcagctgggggcggcggcggnctcttccgccctt

SEQ ID NO: 81422 - DNA, 662 bp, Triticum aestivum
  unsure (1)..(662): unsure at all n locations
  Clone ID: PAT_TA_81422
gtcctcaanaccggatcccccatcactgtccctgttggnagggccacccttggacgtatcattaacgttattggtgagccaattgaccacaaagggtgacattaaagacacaacgacttccctcccaattcaaccnttgaagccccctgcttttggttnaacaaaccacaagagcagcaaatccttggtaaccgggaatttaaggcctnggntttccttgcacctttaacaaaaagggtgnggcaaaattngccccctcccgtgggtgcnagaattgggtnaaactggtcctaataaggagtttnttcaaacatgtttgccnaagcccanggnggtttcncccggttttccccgggggtccnggaaacttnccctttaaaggtaagacttntttnaanggaaattattaaantggggccaatnaacctntntnaaaacaagntttaacaatttcccctttttaaaggggaaattacaccccccggtgtccctcnccntttgcccaacggtttacgttgcnnaaattccttaacctnaaggnaaaattncctggtaatnnaaaaattccntttacagnaaaanctaagggtcggccccctggctatccacgcgtgaaaaaaaaaccttccccntttggctcaanggttttacanaaanggttt

SEQ ID NO: 81423 - DNA, 437 bp, Triticum aestivum
  unsure (1)..(437): unsure at all n locations
  Clone ID: PAT_TA_81423
ctccgccgccctctcccgcaagtgcgccgccgcctccgccctcgatggcgagaagaagcagcagaagctgtccgagattcaagccgacgtgcangagtctgaatcgctgatnaaggaggatggnttnggaggcgccggagcaatgcaacccgagcgtcaaaggccgggctggctggtaaactganggaatacaatcctgatttccaacaacgtncnaagggcgagatttaaagagtcccccggnnccaaagcccaacaagcaccccnggaagantcccccccancccgnatgttccgnaatccnccggaccacctgttttaagaggaaatttgatgnatgacatcccaaagttaaccatctttctggacaaatttttagaaacccaagacattttccnagacaaaaattggngtgccatccttcaagacttncnaaa

SEQ ID NO: 81424 - DNA, 301 bp, Triticum aestivum
  unsure (1)..(301): unsure at all n locations
  Clone ID: PAT_TA_81424
ttttttttttttttttttttttttttttttttttttggaccaacaatttgctcctttcatagtctangtagaccaaaaatgtttgtacaaaaacgaattcgaggcacgctccaactcatcgatcatctctctacatctacttatcagactatgacatcttccanagacgcgcgcggagaattagcggtgccgaggagcttttacttgatcctcgccgccggngcggccgtctgggacnggaagaaccccacggngcggcacttgatgcccgctatctactgtattcatggnatccnggtga

SEQ ID NO: 81425 - DNA, 274 bp, Triticum aestivum
  unsure (1)..(274): unsure at all n locations
  Clone ID: PAT_TA_81425
ccgagcctgtacccgcagcgcgtggctccgcacctcatagtgcagcagcagaagaagcagccgccgcaggtcgtcagaggaagcccggcgaccagactccgggctgggatactcgcctgccacggcttccgacgaaaagcacggaggatcctcatcccgactctanaccggaaaacagtgtgtgtttgggtgcngtanacttataactntttcctgaaccntttacacggactgaaacttaaaaatttcctttttaggcccgaaaaaaaaaaaa

SEQ ID NO: 81426 - DNA, 433 bp, Triticum aestivum
  unsure (1)..(433): unsure at all n locations
  Clone ID: PAT_TA_81426
aataccctcgacataagctggaatggaaatgtgtcgcaattatcgttctcctagcagccgcggaagatgctactgggcactgggctaacaatgtgcaatgatagttcagtttcaagcagttgtcttcaacggggtcaaaggaacagcttcaagtgatnnaaagctcctaataactggcctggggaaccgacgcctgccaatacagttataanccaaactgtcctcccggttaagatttccaatttcccntcaatgccatacttngccnaagcaattagttccggggccccatngcaaaantttgggaaatcaaagtagngncccaattccnttttgganaatnaggcgctttagtgtcccnactttgttcccggtggaannccccccccccttaantaattttttggancgtttnaacaactttggttccccc

SEQ ID NO: 81427 - DNA, 519 bp, Triticum aestivum
  unsure (1)..(519): unsure at all n locations
  Clone ID: PAT_TA_81427
gaagcccatggcgctcgtcaagaagctgcgcaaggcgaaaaaggacgctcctgctggtgagaagcctgagccagtgaggacacatctccgtaacatgatcattgtccctgagatgattgggcagccttatcggtgtctacaatggcaagaccttccaaccaaggttgagattaacctggagatgattggccattaccttgcagantctctactcctacaaccaatngaacacggtaagcccggtacggtgccaacatcctcccngtcatcccccntaaagatttatccgtttccacttttgaagattcaattacngccacccnggggatgtccacctactgtcccccttgttttgaccattnaanacccaaatttggtccggttnacnaaatttccnttancaaaagangttccaccnaatgcngngaaaccnngttccatgnnaaggtgntttgatccaagcnggctngcatttggganattttttaaaaatcaacttttggtggnaaaaaaaaaaaa

SEQ ID NO: 81428 - DNA, 408 bp, Triticum aestivum
  unsure (1)..(408): unsure at all n locations
  Clone ID: PAT_TA_81428
tcgagttttttttttttttnttttttttttttntttttttttttttttttttcaagtgataaattgcatanagcttcttggnaattcaaacacaagcaaagtagttgtacagtcatgccgcagtccaccgccgacgccaanacgctcatcaacgtcttcaanagccgcaacctcgaaccgntcgacctcgtcgcactctctggagcgcacactgtcnggaaggcgcantgcagctccttcaanaaccgcttctccaaggacnccgacttcgcccggaggctccccgccaactgctccaancgacccaaaccggntgcaggactccaanntngaaacccccatcnggttgganancnattcttcaaaaacctgatngaaggaaangggntttcacccnccngcaaatgg

SEQ ID NO: 81429 - DNA, 238 bp, Triticum aestivum
  unsure (1)..(238): unsure at all n locations
  Clone ID: PAT_TA_81429
gcgagctccagttccacgaggccaagggcgaggcgcatgtctacttcttgcccaagtacgactccgacaatgccgtcaaggagctcgccatggtggcggatttcgtcaaggcgctgttagagattttgctcattcgcccggtgaatgatcaagcaacaaaggagcacacatttgtgattattccatgntttccccggttacaaatttgtatgaaattccataaacaggttngntgaat

SEQ ID NO: 81430 - DNA, 559 bp, Triticum aestivum
  unsure (1)..(559): unsure at all n locations
  Clone ID: PAT_TA_81430
taaacaaaatcaacatgccgacgaangataatccacggataccatgtacagacaggttttttttttacagatcagcaacacttcttcggccctccaaagatgtcaacaaaccatcactatctcaacatctccccaacttccgattccaactaaggagtatctcaatcataagcaacaagccaactttgggttccaagcaaacacatncaaatcccattccccaaaaaaacaagcaaagccaccaanttnaaagaacccggacacaaaaacggcatcccccnacaangcacatgttccaaatggggggngggnatggccctggttgggnattgtttaancngggacccaaanagggggagaccccnggggncctnccccttggaaccgganaaactttttttccctnccattccnggttntttacaatgagcacacttttnaagtccccccttttgagcacccttcnagatggcccccccttgggggcacttcggatcttcggaaaaagacgttttccccccccggngtccgggggaacccngccgttctaactccatcg

SEQ ID NO: 81431 - DNA, 347 bp, Triticum aestivum
  unsure (1)..(347): unsure at all n locations
  Clone ID: PAT_TA_81431
cttcagactgcaagttgcgggaagatgtaccctgaatctgacngaagcagggcaagtgccgcggcccaagtcgccgccgttggtccgtcctcnggcgttgcgccctgaagaacaaaggcggggcaatttcaaggttgcccgcccgggccaattccnggcaaaggctgcaancttgccggcgacaactgcaaatttcaacccccttgcaaactggtttnaaccngcaatcactcccnntttatggggtttaaaattnaacctttaatnacaacgtnccncccgattttgnaangattccaacnaagggtgccttttccttttctntnggttaaaatngncccnctccc

SEQ ID NO: 81432 - DNA, 355 bp, Triticum aestivum
  unsure (1)..(355): unsure at all n locations
  Clone ID: PAT_TA_81432
cggacgtgctcctcgacctgggaggtggcctgcgcggtgggcgggcgcatgacgagcagcgtgatggagaaggcgcggccgccccggaggaggaggcgcttgcaggactcgagcatggacatgaggtggccggcgccccactccggcagcagcaccagcgtgggcgtcngagtagccgccattgtgacggaacaaacagaaaaatctgatctctccctggntccctccaactttttccctccttgggtgtcaactaaggatgttggtccttcccaacttctctctcctcaaaaaatgggtgggaatgtttatgcttgggttattatagataagattgttnttaaaggaaaaaaaa

SEQ ID NO: 81433 - DNA, 234 bp, Triticum aestivum
  unsure (1)..(234): unsure at all n locations
  Clone ID: PAT_TA_81433
ggtccctcggcgccgccatcatctacaacaaagaagcaggcgtgggacgaccaactgggatcttctggggtggggcccgttcaatcgggcgcggcgctgggcggccatctaccacgtgggtgggtgatccgggccatccccttnaagagccgcgactatccaccaatcaaaccagtccccaaatgganccttatcgctgttaacctcgnccattcattaagtngtggtgggggg

SEQ ID NO: 81434 - DNA, 405 bp, Triticum aestivum
  unsure (1)..(405): unsure at all n locations
  Clone ID: PAT_TA_81434
gaanacaccaccacacctctccccgtcgacgcaagaagcagcagcggcatccatggcccccaaggcggagaagaagccggtggcggagaaggccgagaagacgacggcggcgaagaatnaccaaggccgagaancggtcgccggcgtccaangagggcggcgaagaagaagggcaagaagaagtcnaaagaanagcgtggagacttacaagatctacatcttcaaggtgctgaagcagtgcacccgggacatcggcatctcctccaaagccatgtccaccaatgaactccctnaatcaacgacatcttcgagaactcgccgggatccggcaactccccaagnnnacaagaanccacnncacttcaaggagntcaaacttccntcggctcntctnccccgggnact

SEQ ID NO: 81435 - DNA, 338 bp, Triticum aestivum
  unsure (1)..(338): unsure at all n locations
  Clone ID: PAT_TA_81435
gccgcctgttcgccaagaanganatgcggatcctgatggtgggtctcnacgccgccggaaagaccaccatcctctacaagctcaagctcggcgagatcgtcaccaccatccccaccatcgggttcaatgttgaaactgtggtntacaanaacatcagcttcactgtctgggatgtctggggtcangacaagatcaangncactgtggangcattacttccagaacacacaanggtctcatcattgtttgtngacagnaancatatggacccgtgttgtttnaagcaatgggataactccacanggagnctgaatgagganagntanctcacncngtgc

SEQ ID NO: 81436 - DNA, 418 bp, Triticum aestivum
  unsure (1)..(418): unsure at all n locations
  Clone ID: PAT_TA_81436
aactcgatgaactgctggatgacaatgacttgatgcaatatctgggaacgtaatccctcggcggttgatcgctgagaaaaaggggtatttgcggcctgcaaagaggagttccatgacatgctgatgtggcgctaatcctgctacagtagagagtgatgtatggtgtcccctttttggtaatttgtaaaantgcccctttgacatgttggtgggcatgattagcccggttaaaactttnggaaaattttcccncaactaactggagaanttcncctcccgattgaanaaancggaattcccgccttttgggttttcctgttgggnaaaaagaaccccgancangccngttntcaancccccttggntcccccnnaagtngtgntttaaaccggccccgatttttccncggggcaaacaa

SEQ ID NO: 81437 - DNA, 434 bp, Triticum aestivum
  unsure (1)..(434): unsure at all n locations
  Clone ID: PAT_TA_81437
ccgatttcaactcagcaggtgagccagatacttgttttacacagtcagctgttgaatcgagcatgggagatattggcgatgcgccgcttacaatccaggtcgccgagaacaacggctgtgaggaactgagcttgtcggcggccgattcacaacaatcaacaggaaaagatgaccgtccaggcccccggggtggacaaaaagggtcatattgggcgacccctcctggaagagtatngccccttggagaaaacattnaagaggttatgccggaaaagaaacaataccgttctaatacaactgtttggtacacttccgntcnattggganaggctacacccctatacctanattccctnggaaatttggtttgggaatnaaattncggaaaantagtcaacgtcccaaagaccaatgcatgcnagaatatatttgtg

SEQ ID NO: 81438 - DNA, 379 bp, Triticum aestivum
  unsure (1)..(379): unsure at all n locations
  Clone ID: PAT_TA_81438
gtagggtttccagttgcaagccgcgccgccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttcccgcaagcaacgccaaggacattggttccatcaaattaccgtttaagaatggnaacctccaaaggaagcaaggactaaggaaattatccaacgaactgtgggtgcttcnaccgagctgattctttaaccctaataantatgttatgaactactattaatgttttgatcccnnggtgacaaaccgtnaacatgtttacgactgctgttt

SEQ ID NO: 81439 - DNA, 678 bp, Triticum aestivum
  unsure (1)..(678): unsure at all n locations
  Clone ID: PAT_TA_81439
atattttattggatgacctggggaaaaaccgaaggggtgtcaacttactggtgccagtggttggtaaattcctcccaactccagcttctagggtttttttgaagcaccccctgaagaggtttcacaaaacagggagttgtgcccaaattctagtttttttacggagcggcatatccgtggagctaccctatttaggttgtgtttttcaagagcggagttaaattttgaaggagcaaagtatccccaaacaggcattaataaagaaccacctccacatccttactgctccgaattacattngagggccaagtaaataattnaaaatttacagcaagnctcctaaaatgaacgtttgcaaataaaattacacacatccatggaagacacccgatttgcccaatttacaccaacaaccacaattcaacnacggactcgccttccaactaagataacccccatnttgtcaccgggaagncagnccaagctacgatatttttggaatgagganacatcccnnancaaaggtaacattcacaagctcaagaggcacaagctnaccatcnccnaacacggntaaaagncaatcacgacaaccatnaatgncagnatgacacnttngnccccnatntggtaattagnnaaaagcatcacnttgttnacaagtccttcactaactng

SEQ ID NO: 81440 - DNA, 478 bp, Triticum aestivum
  unsure (1)..(478): unsure at all n locations
  Clone ID: PAT_TA_81440
caaagctcatcttcttctccttgaaatctttttgggtccacagatttggaggatgtcttgcaactgcggatcaggctgcagctgcggctcagactgcaagtgcgggaagatgtaccctgatctgacggagcagggcaagcgccgccgccgaggtcgccgccgttggcctcctccggcgtggcgcctgagaacaaggcggacatttcnaggtggccgccgggcatcccggcnanggctgcactgcggcgacaactgcaattcaaccccctgcaactgttaactgcatcacccgtacttatactntgagggtgttaaagtatncgttgaataacagctccnatttgatgatccacaatntcctntgttgnggtnattgccccnccccgtnancnctcccttgcgncccgtttagttagnagtncctgtatgttaacaccccaatanggtggtgggatattnanagaaattaccnattact

SEQ ID NO: 81441 - DNA, 642 bp, Triticum aestivum
  unsure (1)..(642): unsure at all n locations
  Clone ID: PAT_TA_81441
ctccttcgtcatttgtgtcttggttaatgtgaggttcataatcctcttcattggggggaggtggtctaacacctggcggcacttcataaacgacatcccaacaactgagatttggatcactttaacaggcccatggtagatagaaaacttggggttgcctgttgagcccgtaatatagacattggggaacatccaaatgggtgctttggttttgatattggactaccctgcatgttcaatganccctcccnagtncccctccgggctgggaaccaaataacaccttnaagactacgacattttggangtttcacaccataaattgaantccataatgcttcatccctccccatatacccgtaccccctncccngatacaaaacacacattttgtaactttccngttggcataaactctttgcccataggnaccaanatacccgtngagccaattggccaaaggacacctggtaccnancattacactngccnaattnggacccanacccngattaccnanatttaataaaggttgtgcttacccaattaccaatnatgaaggccaangatncgttctgacaagataaccgggaattnccctgcttcaaancaaacctcaaaaccttggtacgncantaaaag

SEQ ID NO: 81442 - DNA, 476 bp, Triticum aestivum
  unsure (1)..(476): unsure at all n locations
  Clone ID: PAT_TA_81442
gcaccccggggcttgccatggctaaagacagcctccaaccgcgggggccaaagcagtcagcctttgttcgcatgtgcatctccatcctgcttcacctagtcctacttctccatgatgacaaggatgacgtcgccatgcgtgcacactgcaacatgtcccctgtcacagccccaccactccgttgctgatccgctccaccccgaggacctccacgatggaggttgcctcgcagcctagcgacgagaatcaaagaaggtagtgagatgtactaagtagaagaggaagaataatgtgaataaatgagataaatgtggagaagaccaaattacaaaagtgtgagagggattcagatttttcaaatccttgctgtacacataccttgggtatgttnatcactgtaatgtatccnagaaattatgaagggtaatactcaatggtgcactagcaccttggcatttttaatcaaaaaaaaaaaa

SEQ ID NO: 81443 - DNA, 644 bp, Triticum aestivum
  unsure (1)..(644): unsure at all n locations
  Clone ID: PAT_TA_81443
ctctgaccgccacgcccagctcgagcaagaggttattgagagagtcgatattgccgttagatctgcagaagaatcgtgggcagtcaaattcatgaactttatcattggatcaaaccaattattgttcaacggcatgacacgtgaacttccagtgattggggttgttgaangttcatggatgggtaggaattattgatgaactccgaatgcctatggatggaatttcttttcatccanttctaagtggatacaaagacacgtttcaaagcaacaattccctccggaagcacagaanagaaatgggaaggcttcacctgatgtgttataagtacctaaggggacaattcatttccngagaaatcccnaacagagaatttcttcactatttggacttgaacccaacttcctgttatcaaatgacgtcaannggtaattactcaattggttcaatgcanaactttcggggattnttgaaatacnacaagttagtgtaaacacgtcacaactcaagacagngntttaaanagaacgcagaaatatccccgcaagagaaacantcctatannccatggtaagataatcannacctttttncgnggggacaaaccaattttncgaaggtgaananttcgnattcccngtcg

SEQ ID NO: 81444 - DNA, 662 bp, Triticum aestivum
  unsure (1)..(662): unsure at all n locations
  Clone ID: PAT_TA_81444
gccgcgtcgccctccccgtccactcacccctcgccgccgaccaccagagtcgccgctccggtcaagcccgagccgcccactgtcgccggagttcaaccttgccgccgccggttttctctcgaaaaccgccaaaccactgcgaaccggtataaccgccgtccgatccggtttattttnaatttcggtttaaaaaaaactaatactaatccgttttttnagttttaattggaataagaaacntccactatttaatttttataaacagcgttcccctattttanatttttcctttnattttatttntccttcccaggacccgtatgtatttattntccttcnacagttatcccctatcttnnaacgcncatattttttacnccgtccantccaaatcccaacgaacaagccatttcttcnttagattcccctcctaccaaatnaccaacataaaattttttgaantccaaatttgatttccaacattttaatatttatctccttccgattntactggtttncgtacncctttgattgtccttttnaaatcnaatcttgaccaaattctgataaggcaatncaatatttggacgtaaaattgttnagttgaaaattatgctggttgtgttcaangctctctctccgtnttnggagcnagggganaa

SEQ ID NO: 81445 - DNA, 629 bp, Triticum aestivum
  unsure (1)..(629): unsure at all n locations
  Clone ID: PAT_TA_81445
gaggaggacgagctcgtagccggcaatgccggcctcttccaagaacaacagtaccgtggagacgccgccacccagtacaccttggcggcaccgcccacctctctgttgtaattttgcagctctgtttttttagatcagtttgtttattatcagtaagaagtttcggccaagatgcttcctgatcaaaccttgaccaaacaatatcttacctgatggaatattggagtggttattatggttaacctaagtgaacttttcttgtagattgatcttgtctcaagtcaatttgtcacatcatctataatgagctgtccaaatctctcaaaattataaaaatgtccaatcgtcaacattattgaattgtggatattgcactacctccttccttttgtcnatgtcatcatggtgagtacattggatgatctacgtctccccccccccgctataggttaagggatgaatagaaagagtaaatgcacataatgatccctggggtgacaattatccagacttnaaatgcnnccacacttaaatggtaagtggnganttatcaaaatggggnnttgaantgnacaagntgtcaaacgacgngccaataacgtcacaacaanaantacaccangtccacc

SEQ ID NO: 81446 - DNA, 412 bp, Triticum aestivum
  unsure (1)..(412): unsure at all n locations
  Clone ID: PAT_TA_81446
gttcattgatattctgtgcatgaacctatttatatagcatgtgttgttcacagtaaaaaacatgaacatgtaaaagtatgttgccattctggcatgtggcacaagttcatttctacatatgtttctaagtatgtgtctttgcaacttgtcattgtaggtatgtaaacataggtgttcagtgttgtgtatttgcattcaactccttctgtgttacacgagcatcctgggcaaccatattaatccatgaattaaacatgtccgtgatgggtggcagttggaactggggcctccggtactccccaaactgtccgcaagtgctccgacaatcccttgggaagatggcctgccctgatggncttngatgcttccaacaacaaaanggaccccggatganaacaagtgaanaaaatcc

SEQ ID NO: 81447 - DNA, 339 bp, Triticum aestivum
  unsure (1)..(339): unsure at all n locations
  Clone ID: PAT_TA_81447
cgactccctcnaccatgggccccaccccanagatcagctcgccgccggagccgtcgatgatgaccccgacccctgccccgtccatggacgcgcccaccacccccgccggcgccgcangcaccgtcnaccccgccgccgcntgggccgccancgccgccctggnngccnccgccgcnttcnactgagagatncgcccccgcagcagatcggcngcaantgataccgtntatttaacttatcngangganccgctccntctccttttgtggtggngttcttcgagctgttgatcgncgcattttntgnggcnttngaggaatanattcggaattcggagta

SEQ ID NO: 81448 - DNA, 650 bp, Triticum aestivum
  unsure (1)..(650): unsure at all n locations
  Clone ID: PAT_TA_81448
gggataaccattgcacaggacttcatgtgtgcctccatcatagaaaaatagactgaattttgccaagttctaaggatgaacaaatgaaccatacagaatattgtcaaaaccccgcattttttctcactcaaacaaacttctgtacttgcatacaaccctctttgaacttgggacggcacctactgctccaacttgggactatgaccagtggctcaactccgaacggaggaggtttnccgtcctttgctttttttaaccatgaagnttcccaaaaacactggggaatgcttccaaactnttccctacttttttnacatgagggtcccctcaaactggggccaaagaancaatggcataacatatttttataaattttccctngacttatttaaggtgactggaaacaaccatgaagntntggnccaantaaatgttcccctgacatccaacatccctcctaaccccaanagncnccctggggtnttgcccaccaaagnaaggtcttctgatccctacgnatgccnaacccnaatttaacgggagngaccgnaccactagccgnacgggatanctaacccagggggcggacaatccctaatggctatacccccangcgtctttaactcgcggaacctgttncactacctgan

SEQ ID NO: 81449 - DNA, 384 bp, Triticum aestivum
  unsure (1)..(384): unsure at all n locations
  Clone ID: PAT_TA_81449
ttccagttgcaagccgcgccgccgccgccgccgccatgggacactcgaacgtctggaactcgcaccccaagaactacggccccggatcgagggtttgccgtgtctgcggcaactcgcatggccngatccgcaagtacgggctgatgtgctgcaggcagtgcttccgcagcaacgccaaggacattgggcttcatcaagtaccgttaagaatgggaaacctccaaaggaagcaaggactangaaattatcaaacgaactgtgggtgcttcatccnaggtgatctttanccctaataactatgttatgaactgctatatgttttgaaccccgggtggacaaaacccgtngaaacaaanttatgactgncgtttnganatgtgaaac

SEQ ID NO: 81450 - DNA, 447 bp, Triticum aestivum
  unsure (1)..(447): unsure at all n locations
  Clone ID: PAT_TA_81450
gtctcctcccgccgccgccgcagccgccgcctgcctcgagccgccgtcgccatggggagaagacctgcgaggtgctatcggcagatcaagaacaagccgtaccccaagtcaaggtactgccgtggtgtgcctgaccctaagatcaggatctatgatgttggcatgaagaagaagggtgtccgacgattctctccactgtgttcaccttgtctcaatgggagaaggaaatgtgtccagtnnaggtcctttgaggctgccccttatgcttggcaataantacatgaccaacatgccagaaaggatncttccacctcnaggtccaggttnacccttccnatgtgctcccgtttcaacaatctttccntnncccgggctatagtcccaaactggatgaagggtcttttttngaacccccagatctncccctttttccattggcagcctctt

SEQ ID NO: 81451 - DNA, 460 bp, Triticum aestivum
  unsure (1)..(460): unsure at all n locations
  Clone ID: PAT_TA_81451
gcctgaaaatcttcttcttgatgagaaccgcaatttaaagatctctgactttggtctgagtgcacttgcagaatgcaagagacaagatgggctgcttcacacaacttgtggtacccctgcatatgttgctccggaactgattaagtaagaaaggatatgatggtgcaaaagctgacatctggggcttgtgggancacttgtatgtattgttggntgggtatctccctttttcaaggacaagaatttgatgggacatgttttaagaagatttacaaaagcaagaactccaaatgggcnaactggtttcctttaaaaatgccccggaggttccngangcnaatccctgaatccgaccccggtanacggttnccttttcaaaaatnttnggnaatcctgggtccccgganaggctttnanaaaggactgattactatanacaccaacggagnatnttgccgtt

SEQ ID NO: 81452 - DNA, 692 bp, Triticum aestivum
  unsure (1)..(692): unsure at all n locations
  Clone ID: PAT_TA_81452
gtttttttttttttttttttgcgcantgaataccgctacaagagcagagagcaaacttatncngaataaattggttcanagttgatcgttcanaanagggttgtaaaancaacaccaangggctactcggnatagcatgttccgagaaaagagaaaagaacaagggacatgccctgaacctgaactatccatccaatgaagacctccaagacaantccccaaaatgccnagagaacagatgttactgctaattaaccacaccaagactgaaaantcctgcctgggnttaacgaacctggggcttcncccccngttttccttgggtttnagcccgggggaatgacatgcccgantcctccccccngggaatgacaacgggcactntccccccggggctcnccncanaaaaaaaanccccaggggggggggccccggtcccatttnccctaaaatgagcntataaccccnaaatggctccttttaaactccnnaacgggaaaccctggnttaccaactaaccccttgaanaaaccccctttccaaatggggtntacaaaaggcncacgttncctccaaaatttcaaccnaanggaatggaccccttncggcataaanccgnggttgngtcccactacngnanttcagcctagccgccttctttcctcttccattncggnttccgaagcaaangg

SEQ ID NO: 81453 - DNA, 634 bp, Triticum aestivum
  unsure (1)..(634): unsure at all n locations
  Clone ID: PAT_TA_81453
gccaagacgaggggccggaagaagggcagcaaggccaagaagagcgtcgagacgtacaagatctacatcttcaaggtgctgaagcaggtccaccccgacatcggcatctcctccaaggccatgtccatcatgaactccttcatcaacgacatcttcgagaagctcgccggcgagtccgccaagctcgcgaggtacaacaagaagcccaccatcacctcccgggagatccagacctccgtccgcctcgtcctccccggcgagtcgccaagcacgcctctccganggcacaaaggcctcacaantcactctcctaaatgacgcgtgtattggttcccggtaccngtcnccgcttacnacnancggaantacggtacgtacatactgtgcnggtgattgcaaccttgttgncttgttgtataaaancaattgcgctttggaacngancatccaaaancaattgtttccaaaaaaaaaggggggccgtaccatcccctaanngatntatacccccnaanggcgtctttaaaantntacggaaaccngngtnccaantancctganaaacctttcatgntaacaaaggccccgttctcaatncactatgaangacccnncggataccgngggtggtacn

SEQ ID NO: 81454 - DNA, 473 bp, Triticum aestivum
  unsure (1)..(473): unsure at all n locations
  Clone ID: PAT_TA_81454
cgatgacacttccggaggcaatgccagtggagggggtagcggcaacggtggtggccaaggtggaggtgtagctcaaggtccaagcatgggagttggttctggttctggctttgggggcgggcatactggtagcactggctcatttggtcaaggctatgccaccggattcggtggtggaaaagggtgggggcacgggcggcagctacaacggtgggtctgggcaacggtggaggcagcggatccggaggcggcaagaggcggatacactaaattcaatttccaaaaaagcaagaaccggacccaacacacttctacctccttgttcaacaatatcccacacatttgtgttcccctcatccataggtttttactaagngctccccnaataaagntccatgatccnagtggganactaatatttaatggananctacaacatttaccctacctaanatacctaagntaagattctt

SEQ ID NO: 81455 - DNA, 454 bp, Triticum aestivum
  unsure (1)..(454): unsure at all n locations
  Clone ID: PAT_TA_81455
ccgacaagaagaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctggccggcgagtcggccaagctagcccgctacaacaagaagccaccatcacgtccccgggagatccagacctcccgtcccgcctcgtcctcccccnggggagtccgccaagcacgccgtctccnnagggcaccaaggccgtccacaaattcaactcctccttaaatacccgttccctggtcttccttgggccgtcnaanttcccccnggtaaanggttactgttcnggcannccccggngtacttttnccggggttnnnggatcaaacgttttaattccccnggaaaaaaacgaggntttttcc

SEQ ID NO: 81456 - DNA, 417 bp, Triticum aestivum
  unsure (1)..(417): unsure at all n locations
  Clone ID: PAT_TA_81456
ggctactggaggcctccggccagtggtgccaatggttggcgagctcccgacggcgcgcgatgctccccggccatggttacgaccagttcgaggcacgcacgactctgcggcggcgaacacgaggccacggaggggctcaggttgcgcgtcgcggcggtgctgggtggctcgcaggtcggtcgtgcgcgctgggcgtcggcaaacttaagtgtgtttgccggcggtgcgcggccaaggcagactcnacggcatgacacttttttcatgcgccttggtgggccggaaaaanaccctcgggaccgtncgaccttnagtcctcttngtaggcaaccccggctgctgcaacaaaggancccccgactcccggggattcggcggtgagtaaacccggcccttttaatnncaactccacttctt

SEQ ID NO: 81457 - DNA, 513 bp, Triticum aestivum
  unsure (1)..(513): unsure at all n locations
  Clone ID: PAT_TA_81457
cgagttttttttttttttttttttcatcaaacaacagctccatttgatagttacaaatacacattttaaacttctcaggtccacactctacttaattagtgttctcgcatcactacttggagattagagcagccttattattcaggaagaaaccacacanaaatcaaaccagggagaacataatccgtatttgatccctcaactgatttagttgtaggcgtcngggttggcgatgaggtangcctccggcggccttcaagatggccgtgacggatccttgggccttggggaaccccatcatnnactccaanccctggaacacttgtagtcgatcccacttcactagcnccacngttngcgccggncacttgatgnccaatggtgccatccatccgtccacgcctcnaaaancgatncaccccatatcgcgtaaaaacccactcncttaagaggtaaggcagntgaggaattnacgccgagggcgaacgntcnccnaaggggggacggaaaatg

SEQ ID NO: 81458 - DNA, 383 bp, Triticum aestivum
  unsure (1)..(383): unsure at all n locations
  Clone ID: PAT_TA_81458
tttggttctaaggaccgctgccctgatatgctaaaacaagtttcgaataaaatactgaagaaatgtggaggcctcccattggcaataatcagtatagcaagtttattggcaaacagaccattggtcaaagatgagtgggagagggtcagaaggtctattgggttctgcattgggacaaaaaccgaagcttagatgggaatgaataacatattatcccttagttacaatgatctttcacccatctccaagacctgcttggtaaatttangtatataccccgaggattatgtgattnaanagaatatttttanngaggcnatggatacaaaagggtcnatccccgaaaganngtgggcaaagaagcanaagggttcccnaaaaca

SEQ ID NO: 81459 - DNA, 442 bp, Triticum aestivum
  unsure (1)..(442): unsure at all n locations
  Clone ID: PAT_TA_81459
ggcggctacggcggcggcggcggcggctacggcggcggcggtggtggctacggcggccagcgtggtggcggtgactccggcggccagtggaggaactgagcggcggggccctccagttatcgatctatctaccatctcgtcgtcttccgtcagcaagttatcttcaagttcctgtgtcagtcaatctgatcntccgtgtgtgtccgttgatcctgtggtgttttgatcgccactccagtgtcctcctgtcccggggttaattagagtgggttacgcccaggaaagaaacaacatgtgttactttccatccttggccgtcngcctccngtgatgcanatccctttccggccatgggatnggatgttatgtttggatacctatgttttgaccccgtttaaatgggaaaaatcaancctcatactggcgaatacctcctccggtg

SEQ ID NO: 81460 - DNA, 166 bp, Triticum aestivum
  unsure (1)..(166): unsure at all n locations
  Clone ID: PAT_TA_81460
tttttatttttttttttttttttttttttttttttttttttttttttttcacacantaaattaatccangttccaactcactcacagcggttttncacaggttcgatcatccacccancaccaacactaacagtaanctaactntcattggccaacattaacggat

SEQ ID NO: 81461 - DNA, 476 bp, Triticum aestivum
  unsure (1)..(476): unsure at all n locations
  Clone ID: PAT_TA_81461
ccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggtttgacattgttgacaccttccgtcttcaaggagcaacctgcttttgacaagaagcatttactctccacatgaangctacaccaaaactccactgccaacttngaaggggatgactaattttttcaaagaaatgtttgancctncacgaanacttccttaacaantcaagcttcattctttgttggcnaacatcatgatatgcgcttgtntcncctacanaaggaggactcnatcacttcccggacttgcaaagggtgaagagcaatgctaangacatatgctaa

SEQ ID NO: 81462 - DNA, 609 bp, Triticum aestivum
  unsure (1)..(609): unsure at all n locations
  Clone ID: PAT_TA_81462
gtggtcctctgagtatgcaaatgacatagagtgggcactgcaataatacatgctaataggcgcagtttcatctcgagcagacgagcactgcaatagtacatgctactctcagcgactactaacgtgaagttgcactcaggctctcgcatatactaaagagtgcggcttttggacatccttatcacgataagcgcaaacacgaagattaagacgccaccttggatttgtctggttgttaacttgtgggtcattanacacatatatattgtgccctgtccatatgctctagagcanacaagcaatgnatagtgggactgcagtttctggggtatcacgcccattttaaactgatggtgcaattcaatgtcatcaatnggacaatnaatccntgataactagaaggcatccgatccagtatggtaaatatccgatggatgacaaanggcccgaaggantcgtttgtgctgacaaatcancatttctgcaataccncngattacatcaaganctgcaatnagtttcgngtgcacaattnaaagtcangcttgtggataacttgngggtggtcaaaacttggnttgcaaaaggtcnctaananggnaaaanctc

SEQ ID NO: 81463 - DNA, 626 bp, Triticum aestivum
  unsure (1)..(626): unsure at all n locations
  Clone ID: PAT_TA_81463
gagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggccttctcccggggtccgacgtctgcgacgacgcccacccccaaattgcccccaagggctgctccggcgtgcccgccgtggtgtccnacgacccccngaaatgtgggcgcctgcgccggataatgaatcccaccgttccgacggnacctggcngtgggcccctggcaagaantactggattcggtccatgccaacatgatatgtttcccncctaaaaatgaattaaaantccaaacgaatgagaacgtcatcnngcctatcctgtgtnnttgggcnacatattntacaatatgcctgtcttcnncgctgtgtttccccccccaanaaattgggntctggttgtcaaatacccggatnctcctnaanataatgatgtccttggggnaataaggantcctgtcacngtaaagttncgttgattaancccccgttaaaaaanaaaaaaaaaaaa

SEQ ID NO: 81464 - DNA, 670 bp, Triticum aestivum
  unsure (1)..(670): unsure at all n locations
  Clone ID: PAT_TA_81464
ccgcagcctccgcccgacgctgccgcttccccgcgatctctctcccgctctcttctccccaccaccacccaagtcgtcgtctccgtcgccggccgccatggctccgggcctctacaccgacatcggcaagaagaccagagatctgctctacagggactactgcacgcaccagaagttcaccctcaccacatgcacccccgagggcgtcgcaatcacagctgcaggaactaggaaaaacgagtcaatctttggcgagcttcagacccagcttaagaacaagaacttgacagttggatatcaaagcaaactcagatcagttctctgacaacattcacagttgacgatttgcaactccaagggctgaancaattctcaatttggtggtccaagacaaagtcaagggaacttgaatccantnctccaaggatcccngtgtcaatgcaagtgttgggtgacccaacctatggtaactttcngggtatccgganaaagatatcattgggttgacttcgttgcncggactacatttncaataaagcgcttaactagtaccggnntatggttcccccggaaaacagggaccttggggtnaancttgantcatcanncgngtgggaaatncaanttcagagaagnatngnttgtcaanatgcccnattagantnaantg

SEQ ID NO: 81465 - DNA, 357 bp, Triticum aestivum
  unsure (1)..(357): unsure at all n locations
  Clone ID: PAT_TA_81465
ggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactggggaagcatggtcacgcaaagtgtcactttgttgccattgacatctttaatgggaaagaactttgaggtatcgtccttnatccccanaactgtgaacttcccccaatgttgaccgccaaattatcanctgattgaaaataacctgataanggantncaaccttccaaaacngaantggaaaacccangggg

SEQ ID NO: 81466 - DNA, 569 bp, Triticum aestivum
  unsure (1)..(569): unsure at all n locations
  Clone ID: PAT_TA_81466
atggggtggtcttgctgacatctcagctgagcgatgccaatacaaactgcccatctgggctgacaactgtacaacgtcaagaagatgctaacctttacagggatacatttgttactagtttagcagagattcctggtctaattgtatctgccattcttgttgaatggattggccggaaagctacaatgtggtccatgctcttcacttgttgtgctttccttggggccactagtacttcatcaggatgagctacttacaactgcactccctattccggtgctcgcgcatgtgccatgggtactccacattcctagtttaaatgccccagagtatatccaacacaatccgctcgacggtntttgggccaacaacctccatngggaaatngggggggttaatgccccttgnngctgtccggatgctacngncctgccacaaanggaacctttggtgtttncnggngtatccccccggatggctgatcnctcccggtaaaccaggccgttaatnnctgaataaattgntggggcaaancaaganncttgaatnaanaaaaatttgcggnttct

SEQ ID NO: 81467 - DNA, 506 bp, Triticum aestivum
  unsure (1)..(506): unsure at all n locations
  Clone ID: PAT_TA_81467
ccgccgtggcccttcgtcgcgtgctcggatccagccgggctttctcattgctgtgagcggaggaccccgggcagaggaccacttgacgtggcccatgcagcgacgagcggggcgggctccattcctctcccggccgagaccgtgctcctctcgggacacagcgacctccagcacgcgacaccaccacccctcccttccctacagagttgcatctcgccggcgtgtgggtgttgcactcatangaaaagcgttgancactggtgcanttcgcaaggattnccaattgttcgtgcccccntatgcgttnaaaacttntggctntgcnccnggtccnccangggccctggtgaaaaaaaaattcccgtngcctaacaaananntccttttgggaacganttccttngngactganttnctttggaacnacggatactnatttnaccncggannccgcacnttcgggatcttttcataattgtttntttggaatnnatttattaaccttt

SEQ ID NO: 81468 - DNA, 614 bp, Triticum aestivum
  unsure (1)..(614): unsure at all n locations
  Clone ID: PAT_TA_81468
ctcccagcgaaacaccacacctctcctcgtcgaagcagcagcagcagcggcatccatggcccccaaggcggagaagaagccggtggcggagaaggccgagaagacgacgacagcgaagaagaccaaggccgagaagcggccgccggcttccaaggagctgangaaaagaaaggggaaagaagaatccaagaagagcgtggagacgtacaagatctacatcttcaaaggtgcttgaagcangtgcaccccggacatcggatctcctcccaagncatgtccatccatgaatccctttcatccaacgacattctttcnagaactccgcccgcgatcccgcccaagcttgcgcgctncaacaagaanccaccatcacttcccnggagatttcaactcccttcgncttctcctcccctggcgantncgccaanacgcctnctcccaaggaaccaaggatccacaattnactcctccccaangtaggatgtccccgttacatccgtgttaaaacagtctcttgtatnccttgtccgttggaannttgtncattcncangaatatnaggngctcttgttaaaaaaagggggncggtaccattccctaatgatcttnccccc

SEQ ID NO: 81469 - DNA, 477 bp, Triticum aestivum
  unsure (1)..(477): unsure at all n locations
  Clone ID: PAT_TA_81469
gccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaagcgagctccggcgggatggagatggcggcngangatggcggntgcggctgcacccagtgcaagtgcggcaccagctgcggctgctcctgctgcagctgctagatcattgntcatcgatcatgcatcaccgccgcgcatcatcatatctatgatcatnatcnatcnatctagtacatgtaanctacctgatcnagggtctttgaangtaggtaaagcacctgccagcatnntcatacnangtgattcccatgcatttaacgancccnaataaatccccntggttacctanaagaaaa

SEQ ID NO: 81470 - DNA, 584 bp, Triticum aestivum
  unsure (1)..(584): unsure at all n locations
  Clone ID: PAT_TA_81470
ccgccccctaacccaaaccctaccccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggatccaccctccacctggtgctccgcctccgcggcggcgccaagaagcgcaagaagaagacctacaccaagccaagaagcaaaanacaagcacaagaagtgaactcgccgtctcaattctacaagtcgacgacccaccggcaagtgacaagtcaggaggatgcccaacgccgactgcgngccggactnatggcaacantngacgcatatgcggaatgcggctcactanttanacanagnttaaggtgntccgttgtcgcctttactactannagatcacnattnttncgttntttaacgaacttataaagttcgat

SEQ ID NO: 81471 - DNA, 642 bp, Triticum aestivum
  unsure (1)..(642): unsure at all n locations
  Clone ID: PAT_TA_81471
aaagctctaaacaataaaagacagaattagcaaatatttacaacttcgtcaaatttttaaggggtgtgctacgcgtccgccggctgatttttttaaaagccacatcaagcgctcaaacgtgccttcatcattgcaacaaaggtcttgttgcaggattacttctgcaacacatgtcttgttgccggatttttctgcaacagttgttttcttgcactttttgcaactggatttttgttgcaatttttttgcaacccgaggtttgttgcaagaaaaattcctaantgatatttgttgcaaagcgtatacccctcatagaccattgcaacactacatatgtttcaagaaacatactcctatgcaagaacgcgttcgacaaagntggtgtgtnactcncactgggacacnncaaggcagggaagtgcnganttgacccgcatctcccggtgatggnaagattcccaattttaancctcaagatgatggcgacccaatcctaanactatcaaaganatggtgtgaatcatacaatcgagaacacctcttttttggaaaatgatctgtacaatgcaaaanacagccattaatcagcccttaganacaccgggtagganattcacatctcnaggaaaattaatnctgaan

SEQ ID NO: 81472 - DNA, 600 bp, Triticum aestivum
  unsure (1)..(600): unsure at all n locations
  Clone ID: PAT_TA_81472
ctcccactcacgtttctcctgagagcctcgtgcccgagctaccatcgatgcgccgtcgccgtccccgtggccactggcctccccggcggccgggagcttgtccagggacttcctagtcaccgactccgtcatctccgtgcatccgttcgaccggagccgcactatacgctcgggatcgagctgattttctgccacggccgtcgtctctcgtcgtcgagctcgtcgcatccggtcgcccccgcgcctcnaatcnacgtctacaagcttggtgtagactccgagactgatgttgcccctgtgttcgactacgtcgacgacgatacttctttttcancagagttccagatgacggttccaggagccagacgacaccactgatgactactgctacccgagggtgcctactactacgtgatgaccgctgaagacttggatanttaggagctccaagcaagaggcttacttttgaccatttgctttgtgcnaccttttaaggaaactgttaaccatgtcgtaccaaanaagttctcgctannctgtttcnacttantntcancctcaggcccgantntaaaaaagttgntntttaaaaaaaaaaaa

SEQ ID NO: 81473 - DNA, 595 bp, Triticum aestivum
  unsure (1)..(595): unsure at all n locations
  Clone ID: PAT_TA_81473
cncgtgccgcttcaatcctccagcgaaaccccaccccgcccnaccccaccgtcagnatcnatggcgcccaaggccgaaaagaagccggcggcgaagaagccattggaggaggagcccgcggcggaaaaggccgagaagaccccggccgggaagaagcccaaaggccgagaagcggctgccggcgggcaagtcgtcngcggcggcaaggagggcggcaaggcgaagaagaangccaagaagagcgtgggagacgtacaagatctacatcttcaaggtgctgaagcaagtgcacccccgacatcggcatctcctccaaaggcatgtccatcatgaatccttcatcaaacgacatcttcgagaactcnccggggaagccgctaactggcgaagtacaacaagaacccaccatcactcccgggaattcanactccttcggctctcctccccggngaatcgccaaanangccttctccnanggacaaggttcacaatttactctcctgatccntattactttgggtgtgttgtgcctttacctgtanatccatcctanttcggtttcnaaaananaagnccgcnaatnttattaaaaaaa

SEQ ID NO: 81474 - DNA, 566 bp, Triticum aestivum
  unsure (1)..(566): unsure at all n locations
  Clone ID: PAT_TA_81474
ctcctcatcgacctatctgaaaccataaaatctcctctcttgacgacttggcgtcaggcgccggcgggctccatccatggctggattcccgtttttagccggtagtcacctgcttctgatgaaatcgtcccgtcaacgcgaccaatctcgctctgctccgttgttgcagccgccgggaactccagcgatccagggggaccgttccttccgcgggatggaagaaggccggcgaccacggcggaccgccgcccagataaaattttggtcaatcttcatcaggggttttacactcacaggtgggcatcgcatgggcggtttggctcttggtgggtgcgatttgtgtaccagaatcaagaattgcaggacaactttacaatgatacttcttttgatcctttctctcgtgccggnangattctttggggcttaacaatgaagatatgcagnacctacccgtccnaatnatacagngattanaaattncgttatagggtaacataatcatttgtntgaacanacctaaaaactgtntgaatnttgataaaaactaatgtcaaaaaaaaaaaa

SEQ ID NO: 81475 - DNA, 404 bp, Triticum aestivum
  unsure (1)..(404): unsure at all n locations
  Clone ID: PAT_TA_81475
aacttcaaggaagtagagccaagaagaacttgacatttgtgtgcaagggaatacaaactagaagtgtttttggtacttggtttttgtgacgagcaacatagaaacaggggagcggtagttcaaactacgagctaagcattcagtgcgcccaaagggaatacagagaatttgatgtgtgaagacgccacaccccccaaaaccagttntaggagatttgtttgattttgacaacacctgaagnttcaaatgtcaactggggtgggatcataagcaaacttgctacccacccatgcnaaaatanacnagtcacaanncgaatccccccactccaaaatganaagngacccccaangntcccanaatangaaaagggntttcccatngnganatttncnaaaaaaccc

SEQ ID NO: 81476 - DNA, 564 bp, Triticum aestivum
  unsure (1)..(564): unsure at all n locations
  Clone ID: PAT_TA_81476
tgcgttcaatataaaggactgcaacaccggaacttcactgatcaatcctgaaactgtacagaagatggcagagaaagaaggcctcaatgttggcgtcggttttctgagtcatatacgcctcatggacaaccaagaaacatggggtggctgatgtgggctcagctcttccctgtgtccggcctacgtccaaacggcccgacattgagaagaaaaatagcaaaaatccattgttggattcgaancctcactgctcctccttgggttccctttacaaactttttacgatgtcctacaggttatggcattttggtttcaaattttcctggctcatcgttccctttnaacaggagagntacaccatttccccnangatgccagaaatantttttnaggattccgttttggttttttgcacatttaaatcnncatttgtggtattgcacatnttgttnnaatcanaagaagttggngaacatgtatttagnaggttgnagagaantcaagnatttgccaaactttgttccaaantgtccccctgcagatgtaacttgggccgtgtaattc

SEQ ID NO: 81477 - DNA, 228 bp, Triticum aestivum
  unsure (1)..(228): unsure at all n locations
  Clone ID: PAT_TA_81477
catcaactgcatatgactagttgattattactcagtaccaactggatcgaggcggcgcggtcaataaaatgggcaatgcttcccggcggaggggccgtagaaagaggacgctggtggggcagttagacgccctgcagccccaccggcggcgaaggtgacggctcctttgacgagccgagacccgtttcacttgttccggcgggtaaggnntcnaaagggggggggggg

SEQ ID NO: 81478 - DNA, 473 bp, Triticum aestivum
  unsure (1)..(473): unsure at all n locations
  Clone ID: PAT_TA_81478
cagctgtcattcagtcctcacacagactccaaagggatcatggatctcacagaatttctttcacccagccatgtgattcttgttcatggcgaaaagcctcagatgtcctttttgaaggagaggattgaatctgaactggggatgccatgctattacccagctaacaacgagactgtctccattccgacgaccaagaatctgaaaataagcgccacggacaagtttatcgcaagctgtncacttctcangctagagatagtacacagaatcnaatctgatttgtgggaaccaactggtcaggagccaacggngaacaagaagctaaccggaggggaattcttcngaatggggaaancaaaggaccccaaaattttgtnccagggataaccttcttcaattcggggcccaaaaagggnatnaacccaatttaacaanggttnanccngattgggnaggnaaaacccnnatttaat

SEQ ID NO: 81479 - DNA, 260 bp, Triticum aestivum
  unsure (1)..(260): unsure at all n locations
  Clone ID: PAT_TA_81479
ctgacgcgaaggagaagaagggcctgctgggcaagatcatggacaagctgcctggttaccacaagacaggggaggaggacaagggccgccgccgctacaggcgagcacaaagcccagcgcttgatcgccgcccgtgccgaagaccgttgaccggaccctcgattgatttgtgggcnttttgttgtngttgncttacgtccnaatttggtggncaaggtggaaggggttaatntccttnaaaggnccggtccttnaacccc

SEQ ID NO: 81480 - DNA, 152 bp, Triticum aestivum
  unsure (1)..(152): unsure at all n locations
  Clone ID: PAT_TA_81480
gtccaatcagctgtatgcaactacgccattggggaaaggatgttcaaagccatgaaaagcagttgtccggaaaagggaggtnctttcaacngggagggacctgcnccaaatttaggaaattccttggacaantttngagaangaaattttgt

SEQ ID NO: 81481 - DNA, 164 bp, Triticum aestivum
  unsure (1)..(164): unsure at all n locations
  Clone ID: PAT_TA_81481
nggggctgatatccttctaatnaaacntgaantgcngtacttggatatnatcngacttcncngggataattctgcaatncnaactgctgcatatcatgtgtctggcgagnacacgatgtcatggccggcannggcgctgaacatgtcaacnanggagatgtgat

SEQ ID NO: 81482 - DNA, 260 bp, Triticum aestivum
  unsure (1)..(260): unsure at all n locations
  Clone ID: PAT_TA_81482
ataagatccaagagtcctggaacggagaagaacaaaaantttggcgtcaatttgcttcaagtacaaggttgcaaccgtnaaacctggacaagccgttaattggagnctgcaatnatggaaaattnccccaccaattggnaacanganttcaaccacaaagaagnaaagggtnanccnacgtgcccaaccacctgggaactgaaccattnccaatngggtcccccgnaaangggggtaccccattgaaaaagncccttggg

SEQ ID NO: 81483 - DNA, 357 bp, Triticum aestivum
  unsure (1)..(357): unsure at all n locations
  Clone ID: PAT_TA_81483
ngggacgtcgtggcgtcgcccgttccgaggattctccatggtggtgaccctccttnaacgaagancatggcgaaaacattaacccttaaggtccaacgccgttttnnaacgaaancccctggcgttccnatgaaataattcccgggnttcctcaangtcttgccggaaattcgggagccctcttccaaggggctggagtccntnaacgaatgctgnnggcggcaaaagggaaanaaacgcaaaggggccaatcctgnaaggcccttttcnnnaaaatcaaanttcaaacgttcccaaaactttccngggggnnattnaaaaaanttcnccctnccaaaaangtttctttaaaaaaac

SEQ ID NO: 81484 - DNA, 286 bp, Triticum aestivum
  unsure (1)..(286): unsure at all n locations
  Clone ID: PAT_TA_81484
gcggcgacaagaaagacggagacaagaaggacggcggcgacaagaagccggccgtgccggtgtgcccgccctactgggtaacccgatgcccgccgcaagccgcgctacatcgtccaaaagcggcngaagganggaccccaaactcgtgccgtnaatctggctgattcnaaggccaacgccgncggccggccgccggccaatctncccctggtacaattcntncnctgtcctggccgttntcctncggccggcgccggcggcngcggntgccgttggttgntggttt

SEQ ID NO: 81485 - DNA, 302 bp, Triticum aestivum
  unsure (1)..(302): unsure at all n locations
  Clone ID: PAT_TA_81485
cgctcctagaaactaagttgggattccccccggggcctgcaagggaaatttcgggcaacgaangggggaanggtngggaagccgaaggggaatngggtggttatcctgaatnggggggggaanggccaaaacggtcaaacgggcgggganggnccaaaagttccctcccaatnccttgaaagaaaaggggtccntttggtgnaaaccaatgttcnaacaacccttccttngaaggggaangaaacnttttacaanaangggggcananaaggggtttttggncnaattcccaaaaganttta

SEQ ID NO: 81486 - DNA, 476 bp, Triticum aestivum
  unsure (1)..(476): unsure at all n locations
  Clone ID: PAT_TA_81486
gagaggtttttggacttgatgccagcatgcttcttgggtgagatgtggaggatgcccaaggggcttgtagatggtaaaatacctgaagaacctgtgtttggtgctaatgaagcaaagaacacatattctcttccacttttgatttgctatttccaattgatgaagtatgaggtgaatctgggtgcctcagctcantatgcgtcaggatggctacaaggaggcacatgaatgctgaagtaattcctggacatggtccgttgggtccttggnggangtgatgaananaaggagagttgaaacttttttnaggctttaaattggngatctgaaccaacggaattncaacntaanccggaggnattccccccaanttttangcctggaaacccattttccangnaaaatttnaaancngggcctaanttattnaaaccttaaaatttnacctttttcanaaccacacnaagggcccnatt

SEQ ID NO: 81487 - DNA, 595 bp, Triticum aestivum
  unsure (1)..(595): unsure at all n locations
  Clone ID: PAT_TA_81487
cccccaagtcataaacccaagtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactgggaccacacttcaaccctgctggtcatgtgcaatggggcaccaagaagatgngncccgccatgctggtgatnntgggaatgttacagctgggancgganggtgttgctaaatcaatgttaactgactgcntacccccnnanggacaaatcaatngttggcgtctgttgtcnccaaggtgacctgatatttggaaaggnggcataacttncaagagactggaacctggnncntttgctgcngacacggtcaaggntaaanntatcncaacggcaaatcgaaatngggactttanatgagattgnacccaatcna

SEQ ID NO: 81488 - DNA, 283 bp, Triticum aestivum
  unsure (1)..(283): unsure at all n locations
  Clone ID: PAT_TA_81488
caaccctctccacccccagcaatccatccatccaccccacccccacccccctttcccctcccctccccggcggnttcnctccccgagctcggcaatggcaaangcttcatcaggagntgggatccatgatgantgcangctgaggttcgtggagctcaantccangaggatnnacngcttcataanntacangctggagatgcanancgaggtcattgtagacnaaantggggagcntgaggcaacctangaggacttcancantacctcnntnagaacattg

SEQ ID NO: 81489 - DNA, 301 bp, Triticum aestivum
  unsure (1)..(301): unsure at all n locations
  Clone ID: PAT_TA_81489
gtcntcctcatgttcttcgtccncaacggggtcntcagcttctacgantcgatttcnaantttggntcgggantgttccttcacnttcaggttgttcttctgttggncttcnctgcacagatggaatganaactgngttgctaaanatnaacagttctggtacatggctctgttggctntaacggttgtttgntaaantggttcattcgctttctcgggtcaantctttcacaggttcattctatngggncaagactgcngnctcantangttcttcagtgtcnccanantgaatcgtgtt

SEQ ID NO: 81490 - DNA, 525 bp, Triticum aestivum
  unsure (1)..(525): unsure at all n locations
  Clone ID: PAT_TA_81490
gttttttttttttttttttagcacacaaaaatacctggaataaaattgtgctagtgcaactagagcacatgaaaacaatggtgaaagataaaacaagaattgaagttgcagcacaaatcaagatgatcaactgtacaaataaaactggtttcttcctcctggcccctcctgagtcgggacccactaccactaccaatcatcgcacccatctaaacatgccaatcattcatcacggatcaatccatccaacaangaaaataagatanacagacanganaatancaccaaanataaangangcctaaggcctagcaagaanctgtccttgcantcaattgcttcttcctcccaccatcnattttccancctcctcttaaccaagcagtgacaatccaatgatgggctcaggaatccaagattcgattncagccacccactngcncnatggcaanngtcagggggnttcaaattttcacnaggnactaaggtaacnttncgganaagggggccggaccattccccaaa

SEQ ID NO: 81491 - DNA, 256 bp, Triticum aestivum
  Clone ID: PAT_TA_81491
gtcgtcctcgccgccttctccatcaggaagcgctgaaaccagccttgctccggccggcagtgcagctgctgcaaccccgggctttgtttaattaaccgtgcctgtgtttttaaatattgcgtgcatcctcagtttcctttctgcatttgtgtaatttgtgcgcattggcgagtaagtggcagtgcacctgttaatctgtacttgtacttgtgttgcttgggtaatacaaggtgggtgagcgatcaaaaaaaaaaaa

SEQ ID NO: 81492 - DNA, 584 bp, Triticum aestivum
  unsure (1)..(584): unsure at all n locations
  Clone ID: PAT_TA_81492
cccagcacttgaccggatctggagtcgacgcaacggcgacgaaaagggaagctgcagaggtagtttcatcggttctaggagatgaaaacaaggaatagcaagcacagcgacgacaaacatcggatcgaggaaaggagaaggcccatgatactggagccaaaggcaccaaattatgtgtcattgtcatatgtatttgagaaagacaactagagggcttgtaagaagtgcaccaaaggccaaaggctgaagtgatgttgcaaagcttttatgcggttngangaagcaactatcaactagtaataataatgtagctgcatgtggtatatgtaaaatctanttgtgggtnatatcctttcagttgannatctgcaaacagnatggnaggacacgggtgttngtnatgggtgatttacttatacanctgttggggataanncatgggactatgtttggtgcncgcnctgcncncctgctngagaaggagaataccaacgaccacatggganagcagnctccggatcaaattgtgtccnnggaatggnaantnaggatcanattttcgacggaagnaacatnncaaaatn

SEQ ID NO: 81493 - DNA, 461 bp, Triticum aestivum
  unsure (1)..(461): unsure at all n locations
  Clone ID: PAT_TA_81493
tgtaccgcgacgacatcatctacagtgtatctgtccctgggcactgttttataaagtgcgccagggacaaggaggcatgcacatcacgtacatgggcatggtgccccatgcccacttgtcccccacgccactacctagcttaggtagtaagctaccccacactatatatagctagcattcatccatccaccacagccacaagggctccctggacactctcacacactccacgcatgcatactagttagcaagcaagctagctagcacacacacatatccattcggccaagcacacacttgtgctcatacgcatatataccaagtcagatgcctatggcactgacttcagatacagctccaggagcacttgtactgcccgatgtncactcanatatatacttagacatcaggagtaggggtattatctctccgggagaccccgaactggtaaaaaaaaaaaa

SEQ ID NO: 81494 - DNA, 633 bp, Triticum aestivum
  unsure (1)..(633): unsure at all n locations
  Clone ID: PAT_TA_81494
gatgggggaagggccgctgatgcaggacacctcccgatgctttgtcgtcgtgccatggatgaccacgaaagctgccactcgggatccccgcactcaggccctccccttgccgccacgaacttctccccctgccaccgcgaccttcttccccttgcaccgcgaccttcttccaccttactcgcaccacccttcggccgcagggcaacgctccaaccagcaaaaatgggtcaccgcccatcatctgcgcaccatccaacacagatcgacgccagaaaacattgagatctccctcctccctaaggctctctaccatcctgtagtattgacctccctgtcntctctgaacctcattttggggaggatttgaccttctctgaaatttgtttttgagtttggtccccnggaaaactgaacttggataccctttaaatatctgatggtgggttgaggttngagaatagttgactgcactatgacaaaatgtgaaaatgcagnccgtccaatcgttggcacacgggctcattnagcgcatanataaaaacctcaaaatgacnatggtggcatntanaacacngaaaatccacaaatacaaatctaacaaacagggtgtaattncgtcagtgccgtaantga

SEQ ID NO: 81495 - DNA, 624 bp, Triticum aestivum
  unsure (1)..(624): unsure at all n locations
  Clone ID: PAT_TA_81495
ccaaccttgactggtacaagggccctacccttcttgaggctcttgaccagatcaatgagcccaagaggccctcagacaagcccctgcgtcttccccttcaggatgtttacaagattggtggcattggaactgtgcctgttggacgcgttgagactggtgtcatcaagcctggtatggttgttacctttggccccactggtctgacaactgaggtcaagtctgttgagatgcaccacgagtccctcctggaggcgcttcctggtgacaatgtcggcttcaacgtgaagaacgttgctgtcaaggatctgaagcgtgggtttgttgcatccaactccaaggatgaccctgccaaggaggcagccaacttcacctctcaagtcatcatcatgaacaacctggtcagttggcaacgntacgcccaagtgctggactgcacactccaattgctgtcaanttgctgactggtgacaagatnacaggcatcngtaaggaatnagntgcgccaagttctgaaaacgtgacccggatctgaaatatccacanccatgtgtgggacttgcactactctctggcgttncgtctgataanaacgtncgtggnacaggttnaaaggcccgccaggtn

SEQ ID NO: 81496 - DNA, 622 bp, Triticum aestivum
  unsure (1)..(622): unsure at all n locations
  Clone ID: PAT_TA_81496
cctggatagggctctctttggccagaaggcactcatcggtgatgtgctctgccgacggtgttggtccatgtgatggtcactccggtcggcggtggcctcattgcggattgcgatggccatcgaaagatcttcgcggggattactctcttcagatctggtggtttcatccagcgacaagatgcaatcgatggacaacgacttgacgcataggacaagatacaacggcgagcagctgctaggatcntggaaaagcggtggcgacaacatatgattgacttcaatggtggtgctttcgagtacccggtcntganctcccaggggaaaacctaatgtctgacacgagtggcatacatggcaaaggtgatgttttgcgtcatccctttttgaaggattgctccnatatgctanactgatctcaaggtgaaaactaagaccgactttggtgggtggntcnggnacgggatctcaagnaccccttcaanaaggttncgttaagaaccatatctaaggttgataaaggtctggtganatggcatgtgnatttncatntgttgtccctnggttttttcnctaagaaacttgctaaanatttnantcacggnttngtgttggttgncggacn

SEQ ID NO: 81497 - DNA, 400 bp, Triticum aestivum
  Clone ID: PAT_TA_81497
caaccctagagcctcgcctccctcctctcctctcccgggcgcctccaccccccgcccagcggcgcgaagcgaccatgacgttcaagcggaggaacggcgggcgcaacaagcatggccgcggccacgtcaagtacatccgctgctcctgccggcgctggtgctgtccctggagctcctgctccccgtgtggcgctttgatctagttctggcatgattgggcggtggcgccatccctagttttacccgtgtctgggatattgaactattctacctaagtttttgctgcaatcggttgtactgaaagttggttggtcaaaagcacaatttgtgatcaggtctttaatgtttggcaattcgctgctatctatatcagagagaacttttggttaaaaaaaaaaaa

SEQ ID NO: 81498 - DNA, 847 bp, Triticum aestivum
  unsure (1)..(847): unsure at all n locations
  Clone ID: PAT_TA_81498
ctaagaaactnagtngggattcccccggggcctngcaaggaaattncgggcaacgaaggaaatngcngccctttttncgaatngaaataatggggttnatcccggtnnaacctggcctgggtggaacaatnaacaatnataatttngaatttnatcctcctttcctttnggggaaggaacctaatggtncgaaccngaagggtcaaggcaacaagccttngggaaaaacaaatnaacaattaaccttccttggcctcctttaaaaaataanaagtaaccccttgaaacaatngtcccaacttngaatttaagnaagggaaaatcaattgaaggggctggcctggaacaatccaaatggctcctttttccgggcctttcccggtcctttgaaatggcaatttggaagaagaaatgggggttgaaaaagtgaatgggtatatgggggctttgggactaagattcaaaccaaactaatttaatttatctccctctgggctgctatgataagaaaaaagaaaataatatgcatgcatggtggcatcngggaggtcaaataaaacagtgtgggagcaaattgaaaaaattgaaanggctaattacaaagggatgtccggatcnatgtcctcaatggattcttttaatgggccngattcctacaagaaaatgatanntgtanagggtttgaagggcaaatgcacaaggacctggcttggnaanatttgggcctgatncaatgggcanaattcngtnaacaaacaaatncnattgatnaaaagagccaanaatgtgttatggaaggattnaacgttccccaanggaattgtcacttaatttnaccacaattatg

SEQ ID NO: 81499 - DNA, 511 bp, Triticum aestivum
  unsure (1)..(511): unsure at all n locations
  Clone ID: PAT_TA_81499
gacaagtcaacctcaccgaggagaagcagagagaagggagaagatgtcggggcgcggcaagggaggcaaggggctcggcaagggcggcgccaagcgccatcggaaggtgctccgggacaacatccagggcatcaccaagccggcgattcgacgtctggcacgtcggggcggcgtgaagcgcatctcggggctcatctacgaggagacccgcggcgtgctcaagatcttcctcgagaacgtcatccgcgacgccgtcacctacaccgagcacgcccgccgcaagactgtcactgccatggacgtcgtctacgcactcaagcgccaaggacgcaccctctatgggattcggaggctaagctccggcgaagcgaatccaactcgcacctgctgatcnagatattcagataacaatagctaggcgttgtcaatggtcatggngatncatgtattaataagtntgggcnttcgtgggatggtaatccccngttttaccttaaaaaanaangatngc

SEQ ID NO: 81500 - DNA, 523 bp, Triticum aestivum
  unsure (1)..(523): unsure at all n locations
  Clone ID: PAT_TA_81500
gccaattctctctgcaacttccttggatactatcaaatttctctctagtgctaacttctagctccgatcttttcagttagctagctagtcgatcgccatttaatccatgggggctaaagttcttatgctgatcaccgtggccatggccatgctcgggatggtgctcggcgcaagtcacacagtgggcgcgccggccggatcatgggacctgcaaaccaactacaccctgtgggcttcgagaactangttcaccaccggcgatgagctccagtttcangtactccaccaccgttgaaaatgtggggggnggtnagaaaggctgggtangactcntgcaaanagctccagccccatcgcgacgttcttgacnggcaaaatgtcgtcccacttgcagncattgggacgcgtacttcaactgcnggttcaaggcattncttccggtanaaaggtcaaatcatngtaaatcaanggattcggacagtaaacggnccanggacgggaaacggttcggnccggncnaaac

SEQ ID NO: 81501 - DNA, 608 bp, Triticum aestivum
  unsure (1)..(608): unsure at all n locations
  Clone ID: PAT_TA_81501
cgatgacttgtcctaccagatggactgccatgctgtagagtgtgagagcaagctggaggccaagaagctggctcatgccatgatggaggcctttaagaagacttttcacagcatgaaaagtgatggccggatccacaggaatagctcatcagaggaagtgtctcatggatttgaatctgatgatggctgactgaactcattcatgattcagcaaaggcagaaatggcctagggaatcagagctgatagatgaataagcaacagataaagttggggaacaaaaagactgccaaacccttggctgactagctttttaaatcaagagagtaatttggtacctaaagatatgcatcattgaagtaaatacattacattgaaacctgctgctgttggaaacatgaggaagaaaactcccctcttttgccccagatgtcntgcaccactcantgctgtcccttctcactccgtnntcaagtcatactgcaaagtaaatcatcctgttatctaaaagacggcagnatattatagtgctccccgggtccactggactacaanatcagaaacanttactgaagccaaagtccgaaaccncgtagacaaaaanattan

SEQ ID NO: 81502 - DNA, 565 bp, Triticum aestivum
  unsure (1)..(565): unsure at all n locations
  Clone ID: PAT_TA_81502
acccatgctctggaaatgggcttcacaatcaatgagtacacgatccgtcccttgggtgtcactggagttgctggggaggccctaccagtagaatgtgagaaagacatctttgactacatacagtggaaataccgggagccaaaggatcggagtgaataactgtctacatttgtgacttagaaagacattttcatagctttttgtgaacatgcatatcgagaacatgcatattctttctctggatgttactgcaaaaaaatgtgcattactggtatttaaaaggaggatatttgtagtaaagtttaaaacctttctgtactttagagaaagtgaatgagaaccagtgagaaacagcactccctgaagagtgttgtatctgcttttggtgtgcntgtcctggnagcctgaatgaaatactcccgccggtttaagccaataactaacccctaaatangtgacttacccttttgccaatatcctaacatttaatttgttcccaccatccttccaaggtccttgtnattgtacatgggtacnccnaaaggttaatgaaaagaaaggacgg

SEQ ID NO: 81503 - DNA, 606 bp, Triticum aestivum
  unsure (1)..(606): unsure at all n locations
  Clone ID: PAT_TA_81503
ctcgtgccgaatggttatggatggccaaagcacaggggtggccccatgttctatgcttccattgtggggctccctaacattctgactaagctgcagaaatactctgagatccaccctgatgttccccagctacgtcccagtgccttcctgaaaaagttggtggctatggggaaccctcctctcaatgactggatgtcctacctacacaggcagagcaacaagctgtgatttcgctgatacccgctatagaaattccttggaggttgatctcatgaaacagctgctgtaattgcactctcttttccaatcaaaaacaaagtgctacaggcttataaacaatgtcaagttancttcccaagtgagaatcanctccttccaaccttgctggaagnaacaatggcaatggccaaccttccttctgggcaacaanctcantcaacttcttgggacnatccgtgtaaaatgcattcatcccctcggtactaagtcttanagaatnnacnctcaatccttctttgtnaaggaaaacaaaaatggccnaaagaatcaacaagnggaaacagtgcnaatnaccanacaanggttccaattnggcnaatcgtttna

SEQ ID NO: 81504 - DNA, 497 bp, Triticum aestivum
  unsure (1)..(497): unsure at all n locations
  Clone ID: PAT_TA_81504
gcggagcagcggcaggagagcgccggttcagcgcgaagatgagaggcgtgctggtgaccctcgctgtgctcttcctgacgggcacccaggcccgctccttctggcagcacgatgagccccagacgcccctggaccgcattcgggatatggtggacgtctacctggagacggtgaaggccagcggcaaggatgccatcgcccagttcgagtcctctgctgtgggcaaacagcttgacctgaagctggctgacaacctggacacgctgantgccgcggntgccaanctgcntgangacatggctccctactacaangaggtgcgcgagatgtggctgaaggacaccgangctctgcgtgctgagcngacaangacctggaggaagtgaaggagaatatcggnccttcctggacagttctctgncactggacgnaggagctgnagcantacgccanngctgangccngtgntaaggacnaaggantacaagcaacaagtg

SEQ ID NO: 81505 - DNA, 575 bp, Triticum aestivum
  unsure (1)..(575): unsure at all n locations
  Clone ID: PAT_TA_81505
gtttgcttagtgtcttcactgtatttttcttttaaaaaacaaaaaaccccaaaaaaacaaacaaacaacttaaaagaaaacccaacaaaatcacacacaaacacacatgaaaaaaaccaacccaacaaacgacaacagattttctttttgccaacgaggagtcgagctgtgccctgtgctggtgcgagccatttccgagagggctgcctgcgttcccccggtgtgagcacctccaaggagccgacgacgtgggagccgtgcagaaacacctccgtgcagctgcccccagcccacccgggccctttgctgcctgcccgtaccctctcctggtttttagtttcntctccttcttctccctcccctttggggtatctcctgctttgtaattttttaatatatatttcagtataaggnttcaaccatatacatttgacttgctcccttttcncgaggcaagnnttccgggggaagggattgctttcggtcggcctttaagaactanggcnnggaggatcanattcncaacncaaganaaatcgatttttttttaaggaaaaaaattattccaagataan

SEQ ID NO: 81506 - DNA, 594 bp, Triticum aestivum
  unsure (1)..(594): unsure at all n locations
  Clone ID: PAT_TA_81506
gtgcaatgggacttctgtgatgtttcaccgtgctctggaacagatgaggagagacaagagcaagaagatgaaatgttcaaaacctgtggacaaccagaaagtcaaaggggactcaggagaatctatggtggaactaagactacagctggcaagcacccctggatggtatctctgcagagaaagtcttctagaagagtaacacacttctgtggtggagtgctaattaaatcatgctgggttcttactgctgcacactgcgtcgaacacggagcaagaaaatctccaagtggccctgggaaagcaaaactcaagaggagagagcatcaagagcaaatatttgatgtggagaagtcatcgtgcatcacaagatacagactgggtgatgatgatgtccatacatgatattcattacttaagttgaagccgattgatggtcantgtgccatagaaccaagtttgtgaaaacagcattcgcaaatttgaatcctgttggactgacngctcattcaggatgggcaaacganaaagtacattccctcaacgtanatcaatgtaactattccaaacatcatcaccangttngttaaggngntg

SEQ ID NO: 81507 - DNA, 607 bp, Triticum aestivum
  unsure (1)..(607): unsure at all n locations
  Clone ID: PAT_TA_81507
caggagataaagccacagctggggctgtcagctgtcatgaacaggaaccctctgggaaaaccctctcttctgaagaggaaggagagggtgaagaggaaagctgtgacataacttggaagaagagccagaagctagcaaatgggctgatgagattcagcactgatctcctgagggaggtccagcaagagtccaacgggaacaacgtgatcctgtctcccctcagcattgcccttgccctgtctaacctggcactaggagcagccaatcagacagagaagcgcctgctggaggcgatgcacctggaatctgtgccctgcctccaccacatgctaagcagccttcgcangangctggcangagccacgctcagccttgcatcacgtgtgtacctgcagaaaggatataagtcaaagaggattcctgnaggagtcggagaaattcttggggcaaacctgtgacccttctgggacantgaggatgactcacggcattaacaatgggtaaggaggaactatgggcaatacaacttctaancactcccngagaanntatcnctgnaatgaatcantcanggttttgnggaaattgtcactcncnnacaaatcat

SEQ ID NO: 81508 - DNA, 502 bp, Triticum aestivum
  unsure (1)..(502): unsure at all n locations
  Clone ID: PAT_TA_81508
agcacagagagccttccatcatgagcttcactggaaagtacgagctccagtcccatgaaaactttgagcctttcatgaaagccctcgggcttcctgatgatcagatccagaagggtaaggacatcaagagtatctcagaaattgtgcagaatgggaataagttcaagatcactgtgactactggctccaaagtaatgaccaatgagttcaccattggggaagagtgtgagatggagctgctgacaggagagaaggccaagtgtattgttaacatggaaggtaacaacaaactggttgctaacttgaaggggctgaaatccgtgaccgaactcaacggagacaccatcacccatacaatgnccaangggagactcacctacaagagaattacaagagatctagagacctgcatgcacttatcatttacgtgtaaaatgttcaataaagtaaatttgtataaaacatctcataataaactcttgcgttgcataaaaaaaaaaaa

SEQ ID NO: 81509 - DNA, 597 bp, Triticum aestivum
  unsure (1)..(597): unsure at all n locations
  Clone ID: PAT_TA_81509
gtttcatgcgtccttggatgtccctatgaagggaacatttctgcagctaaagttgcagaggtctcaaagaagatgtactcaatgggatgctatgagatctcccttggtgacaccattggcatcgggaccccggggagcatgaaggagatgctggcggcagtcatgaaggaggtgccagtgggggctcttgctgttcactgccatgatacctatgggcaagcccttgccaacatcttggtggcacttcagatgggcgtgagtgtggttgatgcttctgtcgctggccttggaggctgtccctatgcccagggagcatcaggaaatgtcgctacagaggacctggtgtacatgctgaatggctgggcatccacacgggtgtggacctgcaaaactcatggacaccggcaccttanttcaatgctctgaacagaagaacaattccaaagtgtccaagccgcatgcagctgtgattactgaaggaggttgctcgtaatcaagacatgtgtactatntgcagcctgctcctnatggtctgcttgggctctccaagccggaaagatgttaaccgatggacctaagaataaatggantcttctn

SEQ ID NO: 81510 - DNA, 614 bp, Triticum aestivum
  unsure (1)..(614): unsure at all n locations
  Clone ID: PAT_TA_81510
atggggagagaatgtctgcaatcatgtagaagatgccagtgtggagtgctcagagacagatatttctgagattggaccagttcggcttgtggatggcccaaaccaatgtgctggaagagttgaggtgttccacgagaatcgttggggtagtgtgtgtgatgacaattgggatatgaaggatgccaaggtggtttgcaagcaggtgggctgcggctcaccgctgtcagccttgggaagtgcccgctatggtagagggccagatgtcatctggctggatgatgtgaattgcgaggggacagaagaaagcatctttgactgtaaggcaaggccgtggggtgaacacaactgctatcatggagaggacgcttctgttttctgcacagttaacaagaatctggaggagacagaaacatcgtgagtgccacactgtccccatcagactgtgttcatattgtcacatgagtgggccaacaaattcatgaatggcaaagatgtacagagacttcactgcacactgggatcaggatggnaaacatccnaccttgaatgtnacaaccattatacgcacaatgaaagggnatccacaaaacaacatncantacatactcccaatn

SEQ ID NO: 81511 - DNA, 597 bp, Triticum aestivum
  unsure (1)..(597): unsure at all n locations
  Clone ID: PAT_TA_81511
tggatgtcttcagtgccataatggaactgaactacctaggcacgatctctttgacaaaacatgtcctgaatcacatgatcgaaaggagaaggggaaagatcgtgactgtgagcagtgtgatggggatcatgggtgctcctcttgcctcagggtactgtgccagcaaacatgctctgcagggtttttttaactctcttcggacggagctgacggactaccctgagataagcattatcaacatatgcccaggacctgtgcagtctaagattatacaaaatgtctttacagagaaacttgataagtcgatagagaacagtggtgaccagtcccacaagatgccaactgagcgctgtgtccggctcacgctggtgagcacagcaatgacctgaaggaggctggatnagcgacaaccctacctggcagtctgctactctggcagtagcgccaactgggccngtggctgataacaaaatggcaagaggagaatcagactttagaatngattgatctgantccctatcanaagagantaagaaaagtcaaatccgcntccccncnaggtgaaggaaantccctatgatggtgaaagaaattttt

SEQ ID NO: 81512 - DNA, 580 bp, Triticum aestivum
  unsure (1)..(580): unsure at all n locations
  Clone ID: PAT_TA_81512
agactctgtaactttgtcaaacttgaagcaacgttaaggttcctcgctcacccctccctggacctctctgaggctctctgaattattagagacaaatcccagctatctctgagaactgagaggaggtgagaaaggatgggacggtgacccaggagacaagctcaaaaaacaggtggagtttcttccaccctaagtgaaagttgcccgaagggccgagatgccccactgtgctcagtctgtgtcctttttttttcctccccacatttatacaggtttgttctcttgcaagctttgttttttgatactcaatgattgacagtgtgtgatgtcaggttggctttttattgtaccttccactttgccccatatggcagcatccatggggaagaactgaatgagaactttagaggcaaaacacaacgttttgtttttttttantnacatanacatnaaancactttcangnttcctttaacaancactctcngccnaggacactggaaaaggaaacacacntgcaggagagantgatccaggaagcaacggntngcaatctagtctgtcagaaaatnantcaact

SEQ ID NO: 81513 - DNA, 548 bp, Triticum aestivum
  unsure (1)..(548): unsure at all n locations
  Clone ID: PAT_TA_81513
tgctgttttgctttgtaaaaaatgcttatgtaaactctgagaggtagcaagagctgttgaaaagtgctggatgatagggctacagggaagggaaagtcctcttccctttggaataggtaggaatgtttttcttgattgattgatcattcttgaatgattttttttggctgaatggaacaaaatgaaaagggaaactgaaattcagcatatgccaaatttgtcatagtcaaacgcttgaagtattctagatgagggttgaagtcttatgagcagagtaagggctcaactctgtttcatctacagtacaacacagcgtgtgccgggctgttgggcatctggaggaatagaagtagtgtcatctttgaacacagcctcntttcctcatttgggtttctagctagtactcagagcactttggaggagaatgggatgttccaaaacaattttcagttttcaaaatggcaagnaagcaagganaatgtcatantnggtcaaatggaacggatggaaccgaatttttccccttggaaancncanaagtcanatcc

SEQ ID NO: 81514 - DNA, 613 bp, Triticum aestivum
  unsure (1)..(613): unsure at all n locations
  Clone ID: PAT_TA_81514
aaccagtctgtggctcagatagcttcacttatgacaacgaatgtgggatttgcgcctacaacgcagaacatcacaccaacatttccaaactgcacgatggagaatgcaagctggagatcggctcggttgactgcagtaagtacccatccacagtctctaaggatggcaggactttggtagcctgcccaaggatcctgagcccggtttgcggcaccgatggtttcacctatgacaacgaatgcgggatctgcgcccacaatgcagagcagaggacccatgtcagcaagaagcatgatggaaaatgcaggcaggagattcctgaaattgactgtgatcaatacccaacaagaaaaccactgggtgggcaaactcctggtgcgctgcccaaggattctgctcccagtctgtggnaaaacggtttacttanacaacgagngggnatttgtgccaataatgcaaacatggactgaggttaanaaggccacnatggaaanccaaggacggngnaccccttgacngaccantnctgngcatnccaaaacngtgagcattacgcngcctcnaccncagagtcgtggacngagggtcctaangaanagttccntttccaaaa

SEQ ID NO: 81515 - DNA, 481 bp, Triticum aestivum
  unsure (1)..(481): unsure at all n locations
  Clone ID: PAT_TA_81515
tggagctggatcagattcataaagggattttatctgttgtcagtttcttggctgcaaatgctcctagaagtttgacataaagtttttgtatttgtgtgtacattaaaacacccttcgaagtcatgccacttctcagttatgctctgttattgaaacagtctctgatcactctggtacagattttaagcatggtgttgagatattgaggggaaattgtgaattttgttaaactcaaaactcttgagagacgtcattcaaggaattccagtgctttcaagtgaaagtgcaagactgccgttcactgacaccttaaaaggtttgcctcangaaatgatacaaacaggggcttttttttttttttaacaagttctttcttaatacatgttggtccttgggaatcatgnccgatnacattcatttcgcaatgcacaaacgnatttccttttaaatctccctttcaataggcaaaagtaaacgattg

SEQ ID NO: 81516 - DNA, 585 bp, Triticum aestivum
  unsure (1)..(585): unsure at all n locations
  Clone ID: PAT_TA_81516
gagaactagtctcgagtttttttttttttaaaaccaaattccatcttcagaacacatctccgtggtgctataatgaaacttcaacacttaaaaaaaacaacactgtgttctattagttgaatgttagccaatttccaaagcactggttgttcccagaaccaaagtttacccttatttctaagatgcagtccataaagctagaaagacttccctgtttcaactacctcaacatggctagaaacagggctaagtcaaacaaaaaatttgatccaatcaatcaaaatacattgaatccattgggtcaagtcagtggaatcatttcatacaaaattgcccatttctgtactgatcagctgtgaaaaagtacagtctactttaagagtttaataccttcatggcagtagtgaccacagttttattgttggatgtatccgtaacaaagngctcnctacttccngcantgctggcaagacacaaaattaggagntaaangctaaagatgggcaatgttttcacccaancggagcaaggttatgctctggnaccaaagaaggtaaanatggaagnccgcaatgctggagcaan

SEQ ID NO: 81517 - DNA, 569 bp, Triticum aestivum
  unsure (1)..(569): unsure at all n locations
  Clone ID: PAT_TA_81517
caggaaaatgctttacagtccgacaaaatcctgctatagacagaaatgaaacagaacaacattttcttcaaatgtcccttttccacattcatatgcacttttatatagacagctgcctcttacaattgttcgtcaataactggaatcaaaaatcacctctaaatacacctgcacttgtaggtactcgctcggatgtgtacacaaatccattttcatttagatttatgtagcttctaacctccagataccagagctgctcaatgtcacagcatacatgcatgcacaactactactaaaaatgtcatgtcagtaactgtccaatttctggcaacactgcagcccnttcaagacacttccnacaaccggtctgcaangcaattacaatacaagataaacataaaacctcagtgttatcactagaaacgggagacacacccgcaaacactcgctcnaatcanaatacatatagaaagccngtccganatctaagtgacatccacaacatcaaaggagaactcactgtgtaagtgaatatttaggcgtaaaatacaagagccaataattactgn

SEQ ID NO: 81518 - DNA, 324 bp, Triticum aestivum
  unsure (1)..(324): unsure at all n locations
  Clone ID: PAT_TA_81518
agaatactggagggaaggttcaacctctactgccataccaccatctgcctccgacatcacgggccaacataataaattaggaagcattacttttggagcagccctcataactgcaatgctgaaggcctgaataagccagatgcttccaaaaacaagtaattcctccacagaatggangacagctggaagtaagagctttatgcaaatataacggaaaagttcgcttccaatctaagccatgctatggttctatgattctatgaaaagaaagaccattacctaaagtgcactgtaaaaatcttgaacttaataaaacagtctcaa

SEQ ID NO: 81519 - DNA, 420 bp, Triticum aestivum
  unsure (1)..(420): unsure at all n locations
  Clone ID: PAT_TA_81519
gcaggtattactatcatccacctcaccttcctacacgaatcaggctcaaacaaccccctaggcatctcatccgactctgacanaattccatttcacccatactactccttcaaagacattctgggcttaactctcatactcaccccattcctaacactagccctattctcccccaacctcctaggagacccagaaancttcaccccagcaaacccactagtaacccccccacatatcaaaccagaatgatattttctattcgcctatgccatcctacgctccatccccaacanacttggcggtgtactagccctagcagcctcagtcntcatcctcttcctaatcnccttcctcnacaactctaancaacnatcaataaccttccgancantctcccaaaccctattcngacttctagta

SEQ ID NO: 81520 - DNA, 452 bp, Triticum aestivum
  unsure (1)..(452): unsure at all n locations
  Clone ID: PAT_TA_81520
ctgtcaagtttgctgagctggtgaccaagatcgacaggcgatctggtaaggagctggaggcgctgcccaagttcctcaagaatggtgacgccggtatcgtgaagatgattcccaccaagcccatggttgtggagaccttcgccacctaccctcctcttggccgctttgctgtgcgtgatatgagacaaacggttgctgttggtgtcatcaaagggcgttggagaagaaggaccccaccgggtgccaaggttaccaaaggctgccatcaaagaagaatgatgctcnggngtctgccaacnaattatccaacaaaattttaangncaanctttttgggaanctaaangtagttaangttatcccgggcgttnttgcacttgaccccgcactgtnttccaactagagttccgttaatanccattccatccataatgngcncccaaaaaaaaaaaa

SEQ ID NO: 81521 - DNA, 411 bp, Triticum aestivum
  unsure (1)..(411): unsure at all n locations
  Clone ID: PAT_TA_81521
gtcttagtatgctgaggccggacatccgatgccccttagagaccagctgaagcagctggtcgagctccacaaggcggctgaacaggccatgaagggcctcatagttcggctatggccgaaggaggctatgcttgggagctacttcggcctggtgcggcggctggtggacgcgtgcccgtgggttgaagttatcaagcactctgcctgtatccangggtgggtgtcgggccctttgcccgcgcaaaggtgcactggggcaaaatggatgcccaagaacctgtgacggaccccccaccaanagggcaaaggacatcncacgcccgaattatnaangagtgtgctgaaaggccccgcactaatgccggtgaatgctccaaagatgtaatattggataaacnccattttgtaaca

SEQ ID NO: 81522 - DNA, 552 bp, Triticum aestivum
  unsure (1)..(552): unsure at all n locations
  Clone ID: PAT_TA_81522
cgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcngtgtgatggtgtgaagatatacgtgaataacgagcgtcctctgatctgatggatcnaacaanggtgcgtgtgcgttgcgtgtggtttacttgctccctctcgcctatgctccgcccttggtgtccttgtgtgtagtgtgtcactgtccccggtattgctcaacnactccactanggatggatgatgaatatgtaagaannatgattacctaattaaaananaaaaanccaagggggcccgtaccaatcgcc

SEQ ID NO: 81523 - DNA, 260 bp, Triticum aestivum
  unsure (1)..(260): unsure at all n locations
  Clone ID: PAT_TA_81523
gaggcatcggttcgaccagtactgggacacgaagcctagaatactgcaagcctgcaacccaaccagctgatcacgcncatggctcattctttttcttattatagcacccatcgcctctcgagtagctctgtagagtcctgtgactgaatcttgttcatcagccaatttggttgcaaatcgtttangctaatagttgacccgtttcgtgttattaaacctgcggcaaaataatncaatnctangggttttncacaagcctt

SEQ ID NO: 81524 - DNA, 521 bp, Triticum aestivum
  unsure (1)..(521): unsure at all n locations
  Clone ID: PAT_TA_81524
gtgctaagtttccggttaatacaattctagtaggaataataaacatttatcatgatataaggaaatataaacaacaactttattattgcctctagggcatattttcttcacgagagcccatattagaggctacctaattaaactcctagagattgtatagaaaaattgaactcctgactacccatattagagggcacctgcagtccgtcccaagtaagcgtgttgtgtggcagcctgtgctgctcctgtcaagagtaggcgtgaacggagagacaacgcataacagtgacgcaaactcaagcgggagataacaatatggangggtcctgaaaacagagagataaatatggcggcaatccgctcccgatncgggatcacgcgcgccatggnatccgnccaaattctnggggagngttgtccnatacaaaccatctnattcctccttttccaccttaatnccaacatgcctcaggaatnactttctncacaacattcctnaaatcaccctcncttncctaaac

SEQ ID NO: 81525 - DNA, 650 bp, Triticum aestivum
  unsure (1)..(650): unsure at all n locations
  Clone ID: PAT_TA_81525
gcgccatcaagttcaacggcggcggtcatgttaaccattcaatcttctggaagaacctcaagcccatcagcgagggtggtggtgaggcacctcatggcaaacttggctgggccattgatgaggattttggttctattgagaaacttataaagaagatgaatgcagagggtgctgctttacaaggatctgngatgggtgtggctagctttgggataaagaggccaaaaggctttcagtttgaanactactcctaatcaggaccctccttgttgaccanagggtcaaaacctncatccctttgttgggaattgatgtctgggaacatgcgtactacctgcnagtacaagaacntnaggccggnctaactgacaaacanctggaagntggtgaactggaaatatnccgganaagagtatnanaaagtgcttgcatgatttgtccnacttaanagcattcttcncncccttaatttcccccnttgttnttnnaatcgcattaaaaatngncacatnccatgtnggacctngtcaaccaannagngggtattcaaccnnnaaatcccnncattgnatttacgggcctgnnnaaaaaccctcnaagngtncgncttncctttgangnggtnttcaaaancccattnttangggcgt

SEQ ID NO: 81526 - DNA, 167 bp, Triticum aestivum
  unsure (1)..(167): unsure at all n locations
  Clone ID: PAT_TA_81526
cacaagcacaagcagctcgatcgcactagctttgctgcacgacctgctccgtnacaaatggccatggcaccgagagcgttgctcctcctggccgttgggctcatggtcntggctcngggaacnnccaangggggnaacgggtcntgcccnagggacggcntnaaggt

SEQ ID NO: 81527 - DNA, 278 bp, Triticum aestivum
  unsure (1)..(278): unsure at all n locations
  Clone ID: PAT_TA_81527
gttttttttttttttttcaacggaaaacttctccaccaatcaattgattgattaattaattaattaatcaaagttcaaagtacatggacnacgaaaatgcgcggnggaacaactggatggatgagatgcactacactgggganggtgacaggagangaggctaatcatcaaagcanngncaacacacacannntttacaacagcattgaacacacacatnttggnanggnagcancatgaactgtnncacgcatctnanatnaacggcttgtnccaag

SEQ ID NO: 81528 - DNA, 609 bp, Triticum aestivum
  unsure (1)..(609): unsure at all n locations
  Clone ID: PAT_TA_81528
catggcattcagcctgatggacagatgcctggtgacaagactgttgggggaggtgatgatgctttcaacaccttcttcagtgagactggtgctgggaagcatgtcccccgtgctgtctttgttgatcttgagcccactgtgattgatgaggtgaggactgggcacttatcgccagctcttccaccctgagcagcttatcagtggcaaggaggatgcagccaacaactttgcccgtggtcactacaccattggcaaggagattgttgacctatgcctggaccgtatcangaagcttgcanacaactgcactggtcctcanggattcctcgtcttcaacgctgttggaggtggaactgggtcctggccttggttcncttcccctggagcggtctccgtttgactatggaangaatccaacttggttcanagtgtccaacccctnagtctcaacncngttgncaacaaananaggtctgtcaccaacccccctnacancnatgtngcgtcccctaaaatgggcactanaattgcgcgnccttnaaatgncnccanaaaccanctaaaggccntntaagnaactnaccnatgtcctagttgagggcccaatta

SEQ ID NO: 81529 - DNA, 521 bp, Triticum aestivum
  unsure (1)..(521): unsure at all n locations
  Clone ID: PAT_TA_81529
ctcctaccacatagttgacccaagcccatgaccaatcttcggcgcagccgcagcactactaaccacctctggcctaatcatatggttccactacagctcgaccaccctactgacaataggcctcctctctatacttctagtcatgctgcaatgatnaacaagacgtagtccgagaaagcaccttccagggccaccacaccccaactgtccaaaagggcctacgatacggaataatccttttcattacatcagaggccttcttcttcctaggattcttctgagccttcttccactcaagcctagccccaacaccagaactggggggccaatggcccccaacaggagtcaaacccctaaacccccttgaagtaccctactaaatacagcatcctcctaacctcaggagtcacgttantgggctcacacagatcacagaaggaaaccgaaacaagcaatcaagcacnactctcaaatctccaagatcattcanagcctacagcattgatcatgagctcttccaa

SEQ ID NO: 81530 - DNA, 555 bp, Triticum aestivum
  unsure (1)..(555): unsure at all n locations
  Clone ID: PAT_TA_81530
cggcgttaggggtctgtcgccatgtctgaggctgcgttccagaaggcggctgaggaggtgaagcagctcaagtctcagcctacggaccaggagatgctcgacgtgtacagccactacaagcaggccacggtgggcgacgtgaacacggatcgccctggtatgcttgacttcaaaggcaaagcaaagtgggacgcctggaatgcattgaaaggaatgtccaaagaagatgcaatgaaagcttatgtaagcaaaagtggaagagctaaagggcaaatatggtatctgaaggactggatagagcagctgtttgcacatctgaaacatgccttatttctaatactgtggaaaactgatttatgatgatgatggntttaaataangaagtacactgtancctgtcccaagtttcctgtagttcanggggaaggcatgtacctgcctgattactgacacaatttgattttgagaacaaaatatccggaacncattaaangncattgtactttaanaaaaaaanaaacncanggggggccggtacaattcgccanaggagtc

SEQ ID NO: 81531 - DNA, 419 bp, Triticum aestivum
  Clone ID: PAT_TA_81531
actgagcttagcatttctagccaggctgaataaaatgtgtgatgtggatgcattctatattcaaaacaaatataagagtaactgtgcacatagtccttaacagtagtttggtcccaccctttttgacctctcccactatattcataacacagttcctagagcactggaaaggtaatggtcagaaagccagctagtgccttgttttgcacatgaagcaaataggagcagctgctcagctcctagagaaaatgtatgatttctgtaggggatcaaaaaagtgacttctcctcatggactggtctatcagaaaggcgacagctttggcaagccagtggacaaagctgagcatcagatagttgcccatgtttgtcacctcgacatgtgatggctgtcgtatggaataaagctctctcacacag

SEQ ID NO: 81532 - DNA, 481 bp, Triticum aestivum
  unsure (1)..(481): unsure at all n locations
  Clone ID: PAT_TA_81532
gtaggagtggtttgcttgggtcctcattgtagtacggctggggtggtgccggtggcgggctgcacatctgtgggtgtggcggctggcgacaagtgcagctggtctggctctccattgaagttcggcatcgaggctgaagtctcctccagctccagtgcggtgcgcctcccttgccagaacgactatgtanttcggtgggggtgtgtcgtctgggtacggcgggtcatgccatgtagtgtggtgtgcaacatgcttggtggcgcgccacttttttccttgtgcactcancgacgccccgccgtgcaactcactactcaatccattgtgtgtcaatgcatacggtcaacagcttccccctcccatgtaacccaagcncccnaacttgcggtcgccaagacaccaaatttttgaagaancanaatgtattcacccnatttgtgtaccatgaaancatttgttaaaatgttcnaaaaaaaaaaaa

SEQ ID NO: 81533 - DNA, 542 bp, Triticum aestivum
  unsure (1)..(542): unsure at all n locations
  Clone ID: PAT_TA_81533
aaagagttttgtagatcggatctttggtggagaattaaccagtacaattatgtgtgaggaatgcagaacagtatccttggtccatgaatccttccttgatttgtcgcttcctgtactagatgatcagaaaataaaaaatacaaatgagaggaatgtaaaaaaaatcaaaggaagggaatctgaagaggaagaagaggataaaaacaatgattattatattaaacagagagatgagcccccaggtacaagtaagcaccttcagaaaaaagcaaagaaacaggccaaaanacaagccaagagccagcgccgccagcaaaaactccagggaaaggtacttcaattgacagatatctgtgctactgaagatcagaanaagatgttataagtgaccaaggaaggagangcagaaattactctgaaattctgatgtgaancaggaagaggatcacaaatgattgcaaagatactacttacncaaaatgactaaatatcaggaattatcaatgtcagagatgcatgaagccaggaagcagacaagaaag

SEQ ID NO: 81534 - DNA, 597 bp, Triticum aestivum
  unsure (1)..(597): unsure at all n locations
  Clone ID: PAT_TA_81534
agggccacttcgtctcgtgggaggcccaaaccgatgtgctggaagagtcgaggttcttcacgaagagcagtggggcagcgtgtgccatgatgaatgggatatcaatgatgctcaagttgtgtgcaagcaactgggttgtggggatgcagtgctggccccaattgcagcaaagtttgggcgaggaactgacaccatctggctggatgacgtgaactgcacagggtcggaagcatctctctctgaatgccaggcaaggccgtggggggaccacaattgttatcacggggaagatgccaagtgcaatttgttcatattcgggggatnagcatctccacttcagtttcgcctggtaggaggccccaaccgctgctctggaagnttnaaggtgcttcacaacaatgtctgggggactgtgtgtnatgacaactggganttacggaagctaaagtggtgtcaacagctgggctgtgggaaaccctatnancctgccggatcaaatatgggaaggaaaggcaaattgctgacgattnaactcacaggacagaggtcccacnaatttaacaaancatgggaanattcgaatatgnaaaatcattg

SEQ ID NO: 81535 - DNA, 621 bp, Triticum aestivum
  unsure (1)..(621): unsure at all n locations
  Clone ID: PAT_TA_81535
gccacactgtccccatctacgaaggatatgctctcccccatgctatccttcgtctcgacttggctgggcgtgatctcaccgatcacctcatgaagatcctgactgagcgtggttactcattcaccaccactgctgagcgggaaattgtgagggacgtgaaggagaagctgtcctacattgccctggactacgaccaggaaatggagacttccaagaccagctcttctgtggagaagagctatgagctgcctgatgggcaggttatcaccattgggtctgagcgtttccgttgtcctgaggtctcttccaaccatccttcattggggatgggaagctgcangtattcatgagactacctacaactccatcatgaatgcgacgtggatattangaaggtnctgtacggaacattgtccttaatgggtggacactatgttccatggaccccngataggtgacaagaattatgcttggtcctacacatgatnaagtgttccccccngaaaggatcatgtcggttcggngtcactgganctcnaanacttcagaaantggttnaaagtgatncanaatcngccacattggcanggaagtcaatctcgccanaanancaaaggctta

SEQ ID NO: 81536 - DNA, 478 bp, Triticum aestivum
  unsure (1)..(478): unsure at all n locations
  Clone ID: PAT_TA_81536
ccccacccacccagtccattccccgtcgccctcacgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttcgcttgcagccagtgccgatgagatttgctgtttgctgctcagcanagcangatacaagtggagaaagtttgtgaaattgttaanaagcagttgctgttcctgnaaggaactggaagtttgcggtacaccaattttccggacctgggagctgatccactggacacgtcnnaattgtgatgggcctttaagaggantccnatttaagcgttggaggaacaacccgcaggaattncaaagttnaagagctgccacgctcaattgaaactgtctcggcaaatcatcctngaaggagtcgtaac

SEQ ID NO: 81537 - DNA, 463 bp, Triticum aestivum
  unsure (1)..(463): unsure at all n locations
  Clone ID: PAT_TA_81537
ttcattttttgaatttatttgaactgcatagtttttctatgttgaaaatgcaccattcaaagccacatcatcaatttacaacccttttcgacttcatttgttatttttcatgcatttactgattattttgagctataagaccatgaaattgaaaagcatttgaaatgaactctgaaaaggttccaagttggcatggtatcatcatttcacccacatagcaagtgcangaaagtacagcggcttacgggcaaaaacttggatgaacttcngtgtacaaaacacacaatctccctccgnangtatcnangttttatacnggaaaccntcnggtnccaaaggattcaatttttttaacctaatttnactccaataattttcnggngtcaaaccngaacaatccaangcaatnccacaattaaaacgtttcgactcattggtatttcnaggnntaactaataattaa

SEQ ID NO: 81538 - DNA, 610 bp, Triticum aestivum
  unsure (1)..(610): unsure at all n locations
  Clone ID: PAT_TA_81538
tgagcgcatatccgacatgaccaatggggacgttgcagcaaactcctaccatctatatgaagaggatgtcaaagcgctcaaggacatgggcatgaaagtgtataggttctccatctcttggtcgagaatactgccagatgggacggggaaagtaaaccaggcaggcatcgagtactacaataagctgatcaactcgctgatagataatgacatagtgccatatgttacaatttggcactggggacacccctcaaagcactgggaagacaagtacggtggcttcttaaaataggcagattgtagatgattacaaacattccgccgaggtgtgctttaaagaacttcggtgacagggtgaaagaactggtcacctttaacgaccacatacatattggttgttccccntacggagagggatcatntccctgggaaggctcccccggggatgntttnccgtcccaanangaatcnctcaagagaccatacacngctgggcacaaatctcctactcaagcgaggngttnacnttaaantcgtacacagcatgggatccanaatagaaggtttgacgtanggttcgacaacaagacctctcgaagacagccgggaa

SEQ ID NO: 81539 - DNA, 376 bp, Triticum aestivum
  unsure (1)..(376): unsure at all n locations
  Clone ID: PAT_TA_81539
ntcatcngnancaggctgcnancttctccattcgggnanaanatgggaaangtcgtgtctcattcgatgatctcaggaagaatatcgtgcgcaggaccnatttatgtctatttctctacnanggtagtttatggttagctagactgatgtcnatcctatcgaaactccacagcttgcntgttgacactatcttccgactangngtgtggtttgtnaatgccctacnnaanaacttgcactatgacagtgnccgacactgctataatgntgtnngaacacctcccacnatantcntgaatgcctgatnctgctangctactggcagcagtctgaatatnacagtcaancngtngagttgggntgcttggntaccttc

SEQ ID NO: 81540 - DNA, 384 bp, Triticum aestivum
  unsure (1)..(384): unsure at all n locations
  Clone ID: PAT_TA_81540
ccatgctcgtgtaccaggacaagctttccggcgacgagcttctgtcggattcgttcccttacagggagctggagaacggcgtgctctgggaagtcgatggccattgggtcgttcaaggagcanttgatgtggacattggagccaatccctctgctgagggtggtggtgatgatgagggtgttgatgaccaggccgtgaacgtggttgacattgttgacaccttccgtcttcaggagcaacctgcttttgacaagaagcatttatctcncacatgaancgctacatcaagaacctctctgcaaagcttnnaangggatgacctanatctttcaatannaatgtttagtccngccacanagtatctccttagcanctcaaggactt

SEQ ID NO: 81541 - DNA, 518 bp, Triticum aestivum
  unsure (1)..(518): unsure at all n locations
  Clone ID: PAT_TA_81541
tttggtttctattttgtttgggcaagtggaacagcttgcgaagctttacactaattcacggactcactatgtagcaattaaagggtgattgatagttccaacttttactgttataacttcggttattaccttttccaatatatgcatatttaatatttctctctgcacatcatttaagcaggtggttccatttgagacatttaggaanagtacggtcttttcagattttaattgatatctatattgtttctttccatataatgggcaagtgtggaaacaatgctaaatagaaggcatgcattgcacatgtatggcctattaacctgcacattttggggcatganattgcaaaatggttgtcaaaaatacgaggaaactncatgcngtccaaatcctaaaanggaccagtaatgagggaggcattttnnaaaacggacggngganagggacattgnaaaaaaggcggctcccccncaaaactctttgcnaataatccaaggacgttcatgactcccgaa

SEQ ID NO: 81542 - DNA, 393 bp, Triticum aestivum
  unsure (1)..(393): unsure at all n locations
  Clone ID: PAT_TA_81542
cattcatcaactttttgatattaacagaaacacaccaaatgtacgtgcatatatgatataccaatatatcacacgtcgttaggcaataaacatggaaattggaaacatattgttgttttcagaaatctatgctgctgctataatgctcaccagcaaaactagaagcggtatactccagtttgggtatcccttagtttgagttttgtttgtaagatcctttgtctgattagcttatgtttagcacaactttatactgtactacttcataagttgatagtgtaccaagatcctggctacatcaatgcaangntaatgacagaatttncaacagntacttggaataaataancaaagtccnatccnancatattgacaccagaagaatccntgcaa

SEQ ID NO: 81543 - DNA, 621 bp, Triticum aestivum
  unsure (1)..(621): unsure at all n locations
  Clone ID: PAT_TA_81543
caaaactgcaagatcatctatgtggcaagaaatgcaaaagacaacctggtgtcatactaccatttccacagaatgaataaagtattacctgacccaggaaccatcgaggagttcacagagaaattcatgaatggagaagtgctctggggttcctggtatgaccacgtaaaaggatggtggaaggcaaaagacaagcaccgtattctctacctcttctatgaagatatgaaggagaatccaaagagagaaattcagaagattatgaagtttctggagaaggacttagacgaggaggttctcaacaagataatatataacacctcatttgagataatgaaagacatcccatgacaaactacactaaggatttgtgggagtaatgggtcactcagtttcccaatcatgagaaaagatcgtcngggactggaagaattattcacngtggcactgaataagaattgatcagggatntaagaagaaatggtgaactcncagtttcgcatggatggatatacaaggagttatcttnaaccacacattcctttcaaattgcttcctnaaaancttcaatctctcaaacacggntttatnnaggattcaacaantgaacttatgcnccag

SEQ ID NO: 81544 - DNA, 601 bp, Triticum aestivum
  unsure (1)..(601): unsure at all n locations
  Clone ID: PAT_TA_81544
ctcaaccaaccacaaagacattggcactctttacctaattttcggcacatgggcgggcatagccggcacagcacttagccttctaattcgcgcagaactaggacagcccggaactctcttaggagacgatcaaatttacaatgtaatccgtcacagcccatgctttccgtcataacttcctttaatagttatacccatcatgatcggtggcttccggaaactgactaatcccactttataatccggtgcccnagacatagcattccccccgcataaataacataanttcctgaccctccctccctccttcccttctccctactacctcatcctaccggttanaancnggggccgggaaaaggtggncanttacccccttttaccngnacctacccangccngggcatcnattaacctacatcntttcattaacttacagngttcctccatcccaagancacactttacacacacacacataaccccgacntcaaatcaaaaccatctagtcgcccatacgcaccacatctccctacgtccncacggatcaacanacgcgactancaatcngcacnggnggacatcntcaaacatcgtctng

SEQ ID NO: 81545 - DNA, 489 bp, Triticum aestivum
  unsure (1)..(489): unsure at all n locations
  Clone ID: PAT_TA_81545
caactcacataatctcttgaaaataaccagcttcttttttcttctaatatttagagctctttgtatttttttttttatgcacttcagttctctacaatttattttagctgctgctttatgcaaagttgatgaggatgaatggacaaaaagcagtgttcgtgctaagctagcttttttgcacttcaagcagttagaaattgtctaagtgacagtgacccaagtctatttactcttgcagaaattaacttctttttactagcttttttaaaaaagggaaatagaaaaacagggtaaatgtgagccaaaaatatgaaggatgtatattcaaattccttaattttggatttggacccaggaagtactgcactgataatatcctaagttnaccttacaatgtgatccacatcataatttgctgtttaagcaccaggatgctggacacgtgaataatttgaatgttttttgcctggtttaacnaaaaaaaaaaaa

SEQ ID NO: 81546 - DNA, 464 bp, Triticum aestivum
  unsure (1)..(464): unsure at all n locations
  Clone ID: PAT_TA_81546
accgacaaacacttctacttcaacaaaaccaagggcttcccctgcctgaagaaggcggagggcagcagcaaaccccactgcctggggaaaacgaaaggcaggacccaccccgacatcgaccaggaggtggtgcagaggctgcgggacttctaccggcccttcaacatgaagttctaccagatgacggggcaggacttcggctggggactgaaggctggcgtgggaaatcccctgtaattacttgcccatcacagtttgcgtatataaagagatatatatgtatgtaaaatgtacagaaatctattttaataataatttatttttaatccctaagcatttattcactaactgcctaaccgcactgggctaaaacggtacccggtaacctgtttaaatcccacggngtttaatccnaaaactcctcctttttttngtttcccccngtcctttggttgggtttgtaa

SEQ ID NO: 81547 - DNA, 611 bp, Triticum aestivum
  unsure (1)..(611): unsure at all n locations
  Clone ID: PAT_TA_81547
gatgtcatcaccatgacccgcttcgtgatggaagagggccggcgggcgaaaggcaccggggagttcacgcagctcctcaactcgctctgcaccgccgtcaaggccatttccactgccgtacgcaaggccggcatcgccaacctgtatgggattgctggttctaccaatgtgacgggagatcaggtgaagaaactggacatcctttccaatgatctggtgattaacatgctcaagtcatctttcagcacatgcgttattgtgtcagaggaaaacaaggatgctgtcatagtggaagctgacagaaggggtaaatacatagtctgcatagaccctcctggatggtnatctaacattgactgtcctgtttccaattgggacatatttggcatcctatagaaaagtacccctnataaccactgggaaaatctttacncctgggcgtnacttgtggcaacggttatccnctanggatgcacatgctngtacngtcttctgctggangntcaactnttnagctgatcggaatcgagatcatttgttanaggatnnaatcaaagagggatacacatccatgaggaagcaatnttgnctcgtncanttcagaaaaatcc

SEQ ID NO: 81548 - DNA, 601 bp, Triticum aestivum
  unsure (1)..(601): unsure at all n locations
  Clone ID: PAT_TA_81548
gtcaaagttaaatcaactttgacctgtactttcttatgtttgcatagactatgtacttttttattaaaataaataaataaatgcttgaacgagcttttaaaatgaaaagtgagtaagtagtttcagcactgataagtgacacagcattggtgggagggaaaaagcaaagaagaaatagtgcagccatgcagtgccaggaagtagttttgggtaagatatgggtcttggggagaaatgtaagagttgatcacaaggagatgaaaagcatctgctgtactgtgtaactccagtacagtcccctctttccttggttccnggaagtagagtaagtcctgaatcctcagtttcctttggctgcatctatagttangtatagangtggaccctccnggacaaaaggtctaattagtcaacagtgtgcacaaatacctgcgtctctaaagcatgaccncaatactgctacctttgatgtggcacaaatcaactctccatcaccgactcttttaatagtggnataatgcttttcttttttttggtctcaaatcantcccaatcaccgtttaagcagcatgggaacantcacntggccccatcgtcctta

SEQ ID NO: 81549 - DNA, 617 bp, Triticum aestivum
  unsure (1)..(617): unsure at all n locations
  Clone ID: PAT_TA_81549
caatggcggtgttgggatactgggatatccgcgggctggcccacgccatccgcctgctgctggagcacaccgggacgccctatgaggacaaactgtacagctgcggggaagcccccgattatgataagagccaatggatcaacgagaaggagaagctggggctggacttcccaaatctcccctacttcatcgacggcgacgtcaaactgacccagagcaacgccatcctgcgctacatcgcccgcaagcacaacatgtgtggggacacggaggaggagcggcagcgcgtggacgtgctgggagaaccaggtgatggacttcccgtatgagcctgntgatggtgtgctacagccccgacttcgagaactgaaccgggatatttggagcaactgcccggcaaactgcggtcttcccgccttcctgggggacagaaagtggttgcagggagaactcacctcgtgattcctcagtttgtgtgtggttanaacgatctcgcccgccnctgagcctanggaaccnggaactatgacccttcggcctgaaagtgcggtactaatcaaccgctcaaaaatccatatatagatgcaatgggggaaaaganaggggcccccncnctt

SEQ ID NO: 81550 - DNA, 589 bp, Triticum aestivum
  unsure (1)..(589): unsure at all n locations
  Clone ID: PAT_TA_81550
cagcaggtagccagcccctgatctcctgaagcaaaaatgccgttcggctcctgcctgctctggagaatgctgttttttgtaagtttagcagggtttctttcagatttgtctgaaactggagcttttgccagtgagagtgactgcgacagtacaaccgtagataacgtgattcagagccttcagaaatattcaacatgctttcctgaagtggccaaaaaagatggacgagatttactcaatcgccttatctggatactcaaagacactcttaatcttctgcaacctgttcaagacaaattttgcaagcatctacctcagtgtccgcagcctattgccccgaagaatgggtgggatagtgtgcatcactattgggagcactgagtactgcaaaccatgtgcacaagggtatgactccatcccaagaagaacagctgtatgaaccgtggnatacacgattactgacatcactacggggggnaancggcgtcgcaacctcgaaaggcntaatggactaactgcnattccgaaacncannctgaaataccnaacatcancacggaactctgaactcacangataccacacanag

SEQ ID NO: 81551 - DNA, 608 bp, Triticum aestivum
  unsure (1)..(608): unsure at all n locations
  Clone ID: PAT_TA_81551
gtgtagatgacccttgtcataatctgaggaagcactgacagctgtgggagcggcccccaaagccttccaggttgggtaattttactgagattcccctcactcacggagcttcctccatcacttcctcttctctgctttcgcgggggcggcgggggtgtatttatactgcaataattttttggtatgttaaagaagccagtatcttccactttgcagtttcgattccctgtccccaccacccggtcccttcccagccctggcagangagcggacgagcgtanactcaaacccacgcaagcgcatttgcaaaccangctattcccaatgccaaaccccatcgcctctgcaagatgaactattccgtaaatanttgtangggctgctttttccttccttccttttttttttccntttcctttcctcttggaattaacattgcgcactgaaactgaaaacaaagtatatgagatatataatatatatagatgtaaaaaagtgctggaactgggaanaatggaggaaancaaaaagtaatgtcatcnctgggagaaangcnccacaggtaacctcaaataattaatanaaagtgtgcccaaattgaatgccga

SEQ ID NO: 81552 - DNA, 564 bp, Triticum aestivum
  unsure (1)..(564): unsure at all n locations
  Clone ID: PAT_TA_81552
gaaaacactggcggcaaaaacaaagctgattgggccaagaatctgcaaatggatgactttgagttgctgtgcaccgacgggagacgggcaaacgtcatggattacagggaatgcaacctggctgaagttcctacccacgctgtggtcgtgcgcccagagaaagcaaacaaaatccgtgatctgctggagagacaggagaaacggtttggagtaaatggaagcgagaaaagcaattcatgatgtttgatctcaaaacaaagtcttctgtttaaagacttaaccaagtgcctgtttaaatcccgagaaggaacaacatacaaggattccttgggagataantttataccgtgattccaacctcaaaacctgcaacccatcagatacctccantttcactccttgaggcataanaaggaaggaaggcctttngaaaggggaggaacttcgcgcatgancctctctcccccgcacggacacgatgtcanaggcctctgcatgcgctcctcgcctctcgcacccgaagtgctcctncnacgcacagaagaataatccacnctanaaaaa

SEQ ID NO: 81553 - DNA, 622 bp, Triticum aestivum
  unsure (1)..(622): unsure at all n locations
  Clone ID: PAT_TA_81553
ctttcaagctttttcccttacgaatatctaagctcaggtaagagcttgagaacgaaacaaaacacaatctagttatattttactgaccagtaatgcttcccacagcatagaatggtacagttttaaatttccggaggtagaacgatagtgttttacagtttgatttgatgcactggagtagcaaatcttatcagcacatctggctagaaattgtactcaattctcattactgaactccaaattaaggcaatacgatctctgcttttctcagctgatgccacttctctctcaactattgccaggacagtgcttctgacaattgagactcagaagagtagggacacagtcaatagaagaaagttcaagacacttgacaatatgtgatattgggaattacacctgttcactccngggcatgtcatataaggaaatgcaatccaatggtaggaatgaaccgcaagatgtataaatggcttaagnataacatcntattaatataatttagaantatanaaaatgatgtgtctggaaaagtcaacnctgcatagtgnatggaattaacngntcatccgggcaagtatnnaggaatnaatcatgagatgacgaagattgaangtaagaa

SEQ ID NO: 81554 - DNA, 595 bp, Triticum aestivum
  unsure (1)..(595): unsure at all n locations
  Clone ID: PAT_TA_81554
gctcctgggagcagcgagtgtggtcctcctggtttgtgttgcttgcctgctctccatcgtgcaatggagaaaaaggactggaaaggggaagatgcctgagggaccaactccccttcccatcgtagggaacatactggaggtgaaaccaaagaatttagccaaaacccttgagaagctcgctgagaaatatgggcccgtcttctcagtgcaactgggttcaactccagtagtggtgctatctggatatgaggcggtgaaagaaccttgattgatcgtgcggatgatttgctgccanaggacacatgcctatccggggaccgggcaaacaaaggattaagcattatttcaacaacaacganggatggttacacgttcggcggttgctctcacatctcgcacttgatggggaaaaaggancatttaanagaggttcaagaggaactgacactgcttaagagtnacaanacaaagagacgccttgacaacatcaactaactggcgtcncaactanagctcattgnttggaacattacntaagcagaatctaccgananaatacacnattaatataancnctggaatntcaatttncatt

SEQ ID NO: 81555 - DNA, 408 bp, Triticum aestivum
  Clone ID: PAT_TA_81555
ccatgcccagatgcagttcagcacttttgaccgggaccaggaccactgggaggagagctgtgcagaggtgtacgggggtggctggtggtacaacagctgccaggcagccaacctcaatggcatttactatccagggggccattatgaccccaggtacaatgttccatatgagatcgagaatggagtagtctggataccatttagagcctccgattattccctcaaagttgttagaatgaaaatcagacccctggaaaccctgtagaaggacgggcatttaatatatgtgtcacaactaaaagttggaaacatcttttatatacctgtgtgcacgatgtacctttacctatgaattgaaggcagcatggcacatctatgggcatacaaaataaacgattatattaacaa

SEQ ID NO: 81556 - DNA, 581 bp, Triticum aestivum
  unsure (1)..(581): unsure at all n locations
  Clone ID: PAT_TA_81556
gaagacagggaactggtccacaaagccatcctgcaaagagccatgtaaaattccagtaaagaaagctgtagtattgtatgaaggagagaagaaacgagttcagagtgatcttaaagaaggcatcatgcacggcgaaactatatccttctactgcaagaataaagagaagtcctgtgcctacactgtgcctgttcagtgtgtgaatggcaatctcactctccctttctgcttcaaagagcgtggcttcttttcangtcttgttaagacngacccatcggacatgaaaccgtgcgaagatctgaaatgagtcaaagaagtaaagcagtaccaaaatgccttacagagacagatacgtggatacacaggacaacttangactctgagtgtaaattcaagcaaacttgggatgcactgagtagcatcgcngccctttcctgctgctgcatccaacctccttcaaagctgngaccattattcanccatanctcaatttcntcccggctcctcaacgtccngcaacnacgtccttanantccactttagnctgnaaggtntccatncncccttaaaagtacttggca

SEQ ID NO: 81557 - DNA, 623 bp, Triticum aestivum
  unsure (1)..(623): unsure at all n locations
  Clone ID: PAT_TA_81557
ggagagcggccggcggggggcggcggagggtttcggggttcggaccagagcggccggatggtgaaatcctccctgcagcggatactcaacagtcactgcttcgctagagagaaagaggggaataaaagcaccatcatgcccgccgtgctgagcctcagtaccggacagagcagttccagggttcccttcaattgctgtagtaacctgggtccggggcctcggtgggtgctcctgatgtccctcacccacccctgaaagatcccaaggtgggcgaggggaatatcagagggatcacaatctttcaagctaatttattttatccggataatccggctgaatgtgacaagaagaactaacatctaatacaggacaagaattctgaatgtcaatcaaggcttacagatgcaaacacattagttggagacatgctgacaacaacaactccatatgaaataccatggtgctctgctgaaggacaaggcatttgaattctccggagttgctaaganactcaantgatatgtgtcattgtcacagaaagagatataactcattcncgtcttactttggcttaatgtanacangaaccctgccaanaacaatgttctnagcnaanttgaaaa

SEQ ID NO: 81558 - DNA, 445 bp, Triticum aestivum
  unsure (1)..(445): unsure at all n locations
  Clone ID: PAT_TA_81558
agatgatcccctctcctgttgcctgtcatacagaaagtatgttagataaaaagcaactctatttgcaatttgggcctcatgctgcaatcctgactgagaaggagtcttctgtgagcaacctcttgttgaagaagtttcgcgcttcaagttttacagcctattctgctagatgcttatgcaaagctgctatgctgttagttgtgattagagatgagtctttatacgagactaacacagaaacttgaaggtgttttgcagtaaatgctgatattaccttacaagcctgtaagtaaatttaagtctaaaatgaaccatagaagaaaanttctgatggcaaacanctatcaaaatgtggaatttaaaatgtaaaagnactttctcaacnggttngagaaactacacngtagatnagaaattaatcctgcttctnaggaatatgaaaaaa

SEQ ID NO: 81559 - DNA, 614 bp, Triticum aestivum
  unsure (1)..(614): unsure at all n locations
  Clone ID: PAT_TA_81559
cttcggtatcaaccgccgcactgaagccatcgaactgattaaaaagggttacacccaacaacttgcataccgcaaagaagacggctcatttgctgccttcactacccgcccatcgagcacctggttgacagcctacgtggccaaggtctttgccatggccatcaacatggtggacatcaagccggaggtggtttgtggagccatcaaatggctcattctggagaagcaacagccagatgggcttttccaagaagacgctcctgtcatccacaaggagatggtgggaggctaccacggtgctgagccagtgtgtccctgacagccttcgtcctctccgcgctgcaggaatcccagaagatttgcaagaactacgtgaaaanctggatgggacattgcaaagcctccgattactctcccggaaatacaatctctgactcgacctacangtggcctgactcctangcctggcctaacgggaaatcaacagcgagaaatctgatgaagtctcaaagatggaccacgggcggaagcaagccaactacaatcagggatccaccccgctgggcctctcaatgnaagcactacggcgtgcnctgtggcacaacactcggggg

SEQ ID NO: 81560 - DNA, 566 bp, Triticum aestivum
  unsure (1)..(566): unsure at all n locations
  Clone ID: PAT_TA_81560
cagctctcagctcctctgtaccaacctaccattctgatctgctgcgctgctttttccaagcagaatgctgttacttatttcagtgctctttggcacgcaggcgctttgctcctgggctgcctctcctcctgccagagagctgccaagcgtgctgctctcccccacctgccatgacgctgcagtggaggaggctgcagacctggctcttcgccagatcaatgctgaccgaacagagggctacatcctcagcctctaccgcattttcagtgtcagagaacatcctcaggagatcactgggttctgtcttctatctcatcttgggacgtagtgngatactgaatgccacgtantcagcaaacagttgtgggagaactgcacagtcagacngctcatacaactgttatggcaatgcaagcaattatctacataancagtcaagaaaaattgccatctgaatactaagaatgcaattgcagcagttcaccagatatattggggatatgtcctgacnccanttgatacgtcaactgagccgatattggnatgtgtaaaanctgcangtcata

SEQ ID NO: 81561 - DNA, 517 bp, Triticum aestivum
  unsure (1)..(517): unsure at all n locations
  Clone ID: PAT_TA_81561
gagagagagagagagagacattttcaccattagggaggtcagctttcagcccaccggagaatcagattggaaggacaccaactacaccctcaatacagactccctcgactgggctctgtatgaccacttaatggatttcctggctgaccgaggagtggataacacatttgccgatgagttaattgagctcagcactgcactgggagcaccaggagtacattaaattcctccgaagaccttaaaagctttgtcaaatgtcagtaggttangaaagcagtgccaatgtggggcattacacagcatcctccagccagcagtaccacagtgtaccttcacaacaggagacagagantaantaactgattttggaagcgacaccatgtgtggagaactcactgtagggnggattgtattncattacttgcaccanatgattccacaacatacngcctggtctgctcacctcctgcnggtttgtacgttaaaatatgtggaaataaacgtcanacaaaaaaac

SEQ ID NO: 81562 - DNA, 611 bp, Triticum aestivum
  unsure (1)..(611): unsure at all n locations
  Clone ID: PAT_TA_81562
gctgaatcctggtaatgaggatgcaaataaggttgcaaataattgctgtggtctggcagcacatggaacagttcaaatggcccatgctctcaggttctcaagtccttgcctttcagcataatgctcatcttaatgcagcaatcagaattcttatcctctgctaattgtgcagataaaagagcactgagcaaactccagagagcctgttagttgtcagcagtccctaggcaaacaggaccagggagaacatgagctggctgaaactgtgggctgcaggaagaggcaaatctcaagggactgggctgtggtttctggcagcccctcccaagcntgcagatggtgctgaaaaacggattttgtgtactgcaactgactaagcaagactgacttcctgatcaatcactggctcctgcctgggaaangatgggactccctggtgtactgtgtcatctcagaagaaagnaatgcctactggcgctctaacaacgggatgtggtanncttatcgtgnccacnataattcncnctgttgcgttcactggntactcacagaaacaaaggngaaataatncaggaaagatcatnatcagggaggaacannaggactgngaa

SEQ ID NO: 81563 - DNA, 294 bp, Triticum aestivum
  Clone ID: PAT_TA_81563
ccaacaaacttggaggtgtactagccctagcagcctcagtcctcatcctcttcctaatccccttcctccacaaatctaaacaacgaacaataaccttccgaccactctcccaaaccctattctgacttctagtagccaaccttcttatcctaacctgaatcggaagccaaccagtagaacaccccttcatcatcattggccaaatagcatccctctcttacttcaccatcctacttatcctcttccccacaatcggaacactagaaaacaaaatactcaactactaaaataaaa

SEQ ID NO: 81564 - DNA, 610 bp, Triticum aestivum
  unsure (1)..(610): unsure at all n locations
  Clone ID: PAT_TA_81564
ctcgtgccgctggaagccagcaaccggctggtgctgcagcgggcagccctccatgagctgccggggcagtatggggtgaaaacccacgggcagggctgtgctctggtgcaggtgacgctgcgctacaacataccaccacctcccagcgcggggacattcaacctccacgtagagacagagcccaaaacgtgcacgagtgatgccagcacccacttccgcctcctcctccgggcacagtacactgggaaagcgtgctgccaccaacatggttgtcatcnaggccaagatgccatcaggctacatcccaagacaagactccgtggtagagctgaagaggcagaaactgggtgaagaagtggaggtgcagagcgacaagtgacatttacctggacagctgacaaaggaggaggagacttcanctttgcagcaccaggactccagtgaagaactcaacctgctaccgtgacctgtagactactacaaacgggtgacccacgganctctaaacgtcctgcactcaagatgcagcagcaagagaatctagagaccacttacaagngtcacnccactatctacagacagaancagtttcacgctagggagnncacna

SEQ ID NO: 81565 - DNA, 534 bp, Triticum aestivum
  unsure (1)..(534): unsure at all n locations
  Clone ID: PAT_TA_81565
gccgcccgccgccgccgccgccgcagagccgcagggagagaaggcaaggaggaaggaaggggaagatgccggcggggcacgggctgcggtcgcggacgcgcgacntgttcgcgcggncgttccgcaagaangggtacatcccgctcaccacctacctgcgcacctacaaggtcggcnancacgtcgacgtcaaggtgaacggngccgtccacaagggcatgccgcacaagttctaccacggtcgcaccngccgcntctgcaacgtcaccaagcgcgcnatcggngtcganatnaacaagcangtcngcaanaggatnatcaanaanaggatncatgtccgtntggaatangtnaaccatccaaggtncaacgangattcntccaagaggaaactcaacaannanaacttganggnggtgccaaggnngngtcaagtcanannacaagagnaancagnaggccnagccggggttatgnttangcacacatcanaagntaaccanncctntaagtcntaanatttaaggtgctata

SEQ ID NO: 81566 - DNA, 562 bp, Triticum aestivum
  unsure (1)..(562): unsure at all n locations
  Clone ID: PAT_TA_81566
cgcctgtttgacgcaattgttagtggatgtatcccagttataatcagcgatgagctagagcttccttttgaaggaatacttgactacagtaagatagcattgtttgtgtcatcaactgatgctgtgcaacctggctggctggtgaagtacctaagaggcatcgatgccaaaagagtcagggatatgcaatccaatcttctcaagtactcgaggcattttctatattcaagtcctgctcagccccttggaccaaaaagaccttacatggagaatgattgctgggcaagctgggggaacatcaagttgcatattcagcggtcatggcgtgtggtcagagaatcaagaagcgtatncacatgtgagtgttaatccgggacactaacnaggatgcccngaaacancttttctttggaattnaaaattnactaccgnggaaccctcccaaccgtcattggataantttcnnaactggtanaccccttgaaattgacctgaaaaaccaacntaatttgaggnangccaantgggaattatangaattgnaattcaanngcagnaattg

SEQ ID NO: 81567 - DNA, 452 bp, Triticum aestivum
  unsure (1)..(452): unsure at all n locations
  Clone ID: PAT_TA_81567
cggcacgaggtggctacggcggccagcgcggtggcggcggctacggcggcggcggcggcggctacggcggcggcggtggtggctacggcggccagcgtggtggcggtgactccggcggccagtggaggaactgangcggcgnngccctccagttatcgatctatctaccatctcgtcgtcctcgtcancaaattatncttcanttcctggtgtcagtcaatctgaagtcntcntgtntgtcgttnatcctgtggtgttttttgatcncaactccagtgtcgctctgtcccggggttaaatanaactggttaccnaaggaaacaaaacaacatgtgttaccttcantncntgggtcngtcgtcctccggtgatncaacaatcccttctgtcaaaggatnggatttaaanttnggaaaaacctangttttaaccggttanangaanaaatcaat

SEQ ID NO: 81568 - DNA, 397 bp, Triticum aestivum
  unsure (1)..(397): unsure at all n locations
  Clone ID: PAT_TA_81568
ctttcgctggaccgaagcatcggcatcggtcgcctctgcatcagctccccgacggttaggcgcttcagcttctctccccatcgggacaaacaaggtatcgtcacttgccaagagctgctcgtccaggacgtcccatgccttgagagattaatactacatgattcacacattggtccggcgaccatccggataaccggggcacctaaactgggagctattggggttgttgtctcaaggcatatctacactcaaagcctggaaacacaattctccagaaaaacaattgatgtcagcttgacaancataatgcataaagtgaagatttgggttgttgactccattggtccaatccnggatcaattgttggccaatcaantgctcantttctaaaaaaggt

SEQ ID NO: 81569 - DNA, 539 bp, Triticum aestivum
  unsure (1)..(539): unsure at all n locations
  Clone ID: PAT_TA_81569
aaaacaaactttcctcgtccgaaatcgatgtaggcttatattttaaataggggcagatgtgtaacttccatcagacgtgacacaaccgccctacctgtcagccccattcatacactgtgggcgccaaccgtgggnggcaaaacaccctctcctcacccgaaatagntaccggcaaatatttgtganatgcgagattaccgtcctatccccaaccgacgtgatgtccgaaattttaatgggggataagttcgtaactttccccatttcaagagaagcgcgtaccaaagtttgagattcccctcncctccatttcccattcatacaccgtcggcggcacancaacgtccacactgcnggcaagctcctccgtnaacaaccatcctcaacttgccgngagccgctaacctaacccgtctccacacatatatgacgtctctcatcaangggctggancaaatccttcacgcttctctccntctctctcctctcccttctcaactctntcctnccctctctccctcnctctctctctctctctc

SEQ ID NO: 81570 - DNA, 274 bp, Triticum aestivum
  Clone ID: PAT_TA_81570
ccgccgcctcgggaccaaccaccaccaccaccaccacccgccgccggccgagcgatgagacacgcacgatcccgtctcggcagctccgtgggcgcgcatcgatcagtgtttcattcggtcccgattcttgatcctggctgtaaatcaaaccttcttgcgtttctttcggtcgcgctagcagcggcagccatgttagcatagcttctaagtagtactctgttgttggtgtttcttgtcgtttaagatgatcggaatgtaagcaacagttgccact

SEQ ID NO: 81571 - DNA, 294 bp, Triticum aestivum
  Clone ID: PAT_TA_81571
gcccgaggaggtggtgcgcgtggtgccggcgtgcgggcacttcttccacgccgcgtgcgacgccgaccggtggatccgggcgcgccggacctgcccgctctgccggggcgcgctctggccgcgcccgccgacccgcgccgccgccgccgccgtcgtcgtagtagtagcatagtcgatcatttttttcgccgatcagctccagctgcttcgagcttcgtagtagtcttagtagagacagatgcattgtactccaccttcatttacgtcagcttgctactggtgaaaaaaaaaaaa

SEQ ID NO: 81572 - DNA, 612 bp, Triticum aestivum
  unsure (1)..(612): unsure at all n locations
  Clone ID: PAT_TA_81572
gcagcgtctcatcttcgctggcaagcagcttgaggatggccgcacccttgcagactacaacatccagaaggagtccacccttcacttggtgctcaggctccgtggtggtatgcagatcttcgtcaagaccctcactggcaagaccatcacccttgaggttgagtcctcggacaccatcgacaacgttaaggccaagatccaggacaaggagggcattcccccggaccaacagcgtcttatcttcgctggcaagcagcttgaggatggccgcacccttgcggattacaacatccagaaggaatccaccctccaccttgtcctccgccttcntggtggatgcaaatctttgtcaagacctcactggcaagacatcacctggagttgatctcaagacacattgacatgtgaaggcaagttcaagacaaggaggcattcccccggacaacaacgtctnacttcncggcaacactntaggatggcgnaccttgcggctanaaatcaaaagancaacctnacttgggcnctccgcctggngcataacnctgcatgnctcgctcgtctcgntcctaaggntcctctgnccacatccgattgcttgtccgncctaggata

SEQ ID NO: 81573 - DNA, 331 bp, Triticum aestivum
  unsure (1)..(331): unsure at all n locations
  Clone ID: PAT_TA_81573
cganggcggcggcngcngctacggcggcngcngcngtggctactgaggtggccgcagcggcggtggcggtggctacggcanccgtgagggcggcggcggntacngcagcggcggcngcggctacggcggcagccgnggcngctccggcggcggcaactggngggantnaatggtgggccccctcgctggnagttatcctagttanccnatccgtttttacntgtctaccaagaatgttatctctcgctcgctctntagtatcctncatctcnctccntctcctacgttccnngatnttcangctnccgttacatntnnctctgctnccgtt

SEQ ID NO: 81574 - DNA, 513 bp, Triticum aestivum
  unsure (1)..(513): unsure at all n locations
  Clone ID: PAT_TA_81574
gtggatttggccctgtctatttgggaaggcttgaggatgggcaagaagtanctgtgaagaggttgtccaagaaatcatcacaaggcgtcgaggaattcaagaacgaggtgaggctaatcgccaagctccagcacangaacctggtgaggctgctcggctgctgcatcgacgacgacganaggctgctcgtgtacgacgttcatgcgcaacaacagcctggntaccttcatatttgatgatncanagcgtaagttgctangatggagcaaacgctttgagatcattctggggatccacggggtctgctctatctccacnaggattcnagggtcangatcatccacanggatattanngcgatcaactgctgctggacaggaacatggccccaanatatccgacttcggatcgcgagatgttcggnggcgancacacancgcgtacacctganggcatgggantannttactgtcccgnntnccatggncgggtntctccatcaatccacattac

SEQ ID NO: 81575 - DNA, 476 bp, Triticum aestivum
  unsure (1)..(476): unsure at all n locations
  Clone ID: PAT_TA_81575
gcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcnaacaagggtgcgtgtgcgtgtgcgtgtggtttgcttgctcgctctcccatgctctgcccatggtgtccttgtgtgtatgtgtgtgttcatgtgtccctgtnattgcttcatctatccccactatggatggagtgatgaatatgtaagaatgaaagattacctaattaactaccccnaaatcgctactcggttaaaaaaaaaaaa

SEQ ID NO: 81576 - DNA, 332 bp, Triticum aestivum
  Clone ID: PAT_TA_81576
aacatcgtcaaggagggctgcggcgtggaagggttgtgcgtttgctctgacgactcgcactgtgcgcccgagcaaggctacttctgccgtccaggaaaggtgcacgacgaagcgagggtttgctccacaagtgttaacccgtgacctcgcttctcaagattctgcgcaacaaaccgcactagcgtgaacttgtgcacttattagagcaataacgtttcatatactgtagtattattgcatttatccttgtctttgtatttgcaaggcttttgatttttgccttggtcatctacataaatttacaagtttatattttttccaaaaaaaaaaaa

SEQ ID NO: 81577 - DNA, 550 bp, Triticum aestivum
  unsure (1)..(550): unsure at all n locations
  Clone ID: PAT_TA_81577
gagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtgggtgtcgacgacccccgaaatgtnggcgctgcgccggatatgaaaccaccgtcgacggcacctgcggtgggcctgcaaagaantactgatcggtcnagccagcatgatatttccgcctaaangaaataaaantcaagacgagatgacactcacntcctatgctgtgtgtgtggccaacaatattatacaatatccgtgtctcgtcgctgtgtttcctctcgaaaaaaattggtgttgcctgttgttaaaatatcggaatatctccgtaataagtatgaatgtngttgtggaaaaaaaaaaaa

SEQ ID NO: 81578 - DNA, 503 bp, Triticum aestivum
  unsure (1)..(503): unsure at all n locations
  Clone ID: PAT_TA_81578
gggagaagaagcccaaggcggagaagcggctgccggcggccaaggagggcggcggcggcggcggctcggacaagaaggccaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgcgcangaggccgccaagctcgcccggtacaacaaagaacccaccatcacctccccgcgagattcaaacctccgtccgcctcgtcctcccccggcgactcgccaaacacctgtctccgaaggcacaaaggcgtcacaaattcactctcctagacctctccccgccctctctctctctcctccntttgatgatctcttggccaaggatcnagctcntanttgtaattgtttcntttgtaaaatgacatggataatggatcctacaattggtgcataaaaaaaa

SEQ ID NO: 81579 - DNA, 379 bp, Triticum aestivum
  unsure (1)..(379): unsure at all n locations
  Clone ID: PAT_TA_81579
ctanagcctcgcctccctcctcccctctcccgggcgcctcnaccccccgcctagcggcgcgaagcgaccatgacgttcaagccggaggaacggcgggcgcaacaagcatggccgcggccacgtcaagtacatccgctgctccaaactgcgccaagtgctgccccaaaggacaaggctatcaaagcgtttccttggtgaaggaacatccttggagcaagctggctgttaaaaatgttcaaggaggttnttgtncaatgatggtatttctttcccnaagctgttaccccaaggtgcacaactgtgtttcccttgtgccanccnatcccanattttcccttttccgctcccccttttaaaacaaggaggaccntttaccccc

SEQ ID NO: 81580 - DNA, 681 bp, Triticum aestivum
  unsure (1)..(681): unsure at all n locations
  Clone ID: PAT_TA_81580
tggagaacgcgacccgcgggaggaagcgggtgctcttccggcacaaggccaagagcgccctcgccaagaagtgctaagaaagaaaaaatggagatgtgccagacgtgtgtgtaacgagggggaattccgaatctttggggggctggagatttggtgcatgtccgtgtgtgagtgtgcgggatctacatcttttgtgcaaagatagtagtactaagtggttgtgttccggcgattgttaccgtgcccgttggatatttatcccgaacatataaaaaattccattcattttaaaaaanaaagggggggcccggtacccaatccccctatatgancctattaccgcctcactggcntcntttacacgtcctgactgggaaacctggcntacccaacttancccttgcaacaacccccttcnccaactggcgtaatacgaaaagncgcacgatgccntccaaaattgccagctgaatggcgaatgggacccccctgtacggngcaataacccggcggtnttgtgtaccncangtaccgctnactncacgcccaacgccgnccctttgnttctcctncttnccagtcgcgntttcctaanccaaccgggncccctaggtccattaggttngncccnccaaanttttngggggtncctngcancccnaaagnttttcccttngggan

SEQ ID NO: 81581 - DNA, 490 bp, Triticum aestivum
  unsure (1)..(490): unsure at all n locations
  Clone ID: PAT_TA_81581
aggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctgggacagtgtggcagagctgatgggtacatcctggagggcaaggagctggattctacatgaggaactcccagaagaagaagggcaagggtgccacagcttaagctgaagactgctgcatgttaccccttggttttccttaaatgttgcctccatgtcatgtttgcagacatactgaacaccatttcccgttaacggtccganccctaagttngaactgagaatgttttgcctgtttttggtgtgtttgtgatccnaaactaccaaatccnataagtttccacctngcatatttcanccgtcaatngaatttggtcttgatcncaaaaaaaaaaaa

SEQ ID NO: 81582 - DNA, 371 bp, Triticum aestivum
  unsure (1)..(371): unsure at all n locations
  Clone ID: PAT_TA_81582
gcggcaggtcggcttcgacgtcgacgaggagctgtgggccaccctgggcgacatgctgtccgtgaacctggcgtcgtagtaggcgatcggtggatcgacggcatggatgggtcggtggagccgttagtggtttttgggtgggctccgtccgacgcaccagacggcagcactaccatagcccgattcggtcaagtcaanggtggcggctccggccagctgccgtttngcgcggcacaatgcaccatgggaggcaagagtggcccccgttgaccttgtccccccggggttgtataattgtnaccttttacccaagaaacacatgagancccggagacaaaaggagaaccattnccttccccctgttaaacttt

SEQ ID NO: 81583 - DNA, 553 bp, Triticum aestivum
  unsure (1)..(553): unsure at all n locations
  Clone ID: PAT_TA_81583
caaagaagcttagaacaccatctattctttagaggaggatgcgctccgctatcatgggaacagaggctgaagattgccattggtgcagctcgaggacttgcattcttgcatgcatcagagaagaaagctatgtaccgtgacttcaaggcttccaagatcttctagatgcacactataacgccgaactctctgattccgggcttgctaacttgggncaaagtggaatccccttatgactacnagcccacgcgcacccacgggatgcantcccggagtatgtnatacctggcctccngtatgagcaaangactttacgttccnggtatgatcctggagatctncccgtcnactttccaagttccaaccgccccaaagggcaaacgaaatcnacnacngggcaaagcattggctggacgggagaaacnccatttaatggcccccggnnaaggcaatacaacccnaaacaaacctgcaagncttgctgtggaataactgctgctgggaaccaggacaagncccaataaggggttccaggcncacaantnagaataaa

SEQ ID NO: 81584 - DNA, 589 bp, Triticum aestivum
  unsure (1)..(589): unsure at all n locations
  Clone ID: PAT_TA_81584
nctcgccncgccgtctcgcccnangccgccgacgcaaagatgccgttcaagaggttcgtcaagatcgggcgcgtggccctggtgaactacggcaaggactacggccgcctcgtcgtcatcgtcgacgtcgtcgaccagaaccgggcacttngtggatgctcctgatatggcangtgccaagatgaacttcaagctcctttcgctgaccgacatcaaagattgacatccaagcctaccctaaagaagnaactttngattaaaggccatggaggaagcaaatttttaaaaccaattgggaaaacaacccaangggntaaaancttnttttncccaaaananaaacaccccnnnatactttttnaagttaaaggccaattttggcnaaattaaaagggnggngccattntnggnaaactttccaacccaaaaaagnggtncngctaaaatacttaanggtngantttaattttggtcaaattggttgcccaaantcaaggtctaaacncaatnttcaacggtttcggaaaacttaaatttgcnngtgttttaaaccagctatttnnaaaagtnccctcctaaaaaaaaaaaa

SEQ ID NO: 81585 - DNA, 708 bp, Triticum aestivum
  unsure (1)..(708): unsure at all n locations
  Clone ID: PAT_TA_81585
cttgaggttgagagctccgacaccactgacaacgtcaaggccaagatccaggacaaggagggaattcccccggaccagcagcgcctgatctttgctggcaagcagctggaggatggccgtaccctcgccgactacaacatccagaaggagtccaccctccatcttgtcctgcgtctgcgcggtggcatgcagatcttccgtgaagactctcaccggcaagaccatcaccttgaggttgagactccgacaccatcgacaatgtcaaggccaagttcaaggacaaggagggcattcctcccgggaccagcagcgccttatcntcnctgggcaagcagctagaggatggcgtaccctcgcaagactacaacatccaagaagganccacctccaactggtgctgccctgcntnggtggatcaatnttccgtgaagacctcaacnggaagacancatctggagttgagactccgacacatcnacaattcaaggcaagtcaagacaaggaggatccccggacaacacgctgatcttctgcaacactggagatgtccacctacanacaaaatcagaggatcaccttactgngcccgtccgtgggcataatgccnggttgtcacctaatggccntccctggtgggctatncctggtccgctaattanggttnctcganccgngtgtaaaacaccccttccntggaattngaatctt

SEQ ID NO: 81586 - DNA, 651 bp, Triticum aestivum
  unsure (1)..(651): unsure at all n locations
  Clone ID: PAT_TA_81586
ccctctacttcagtctgctcagcttaaaccagatgtgagcgtcacttctgcaggcgaggatggtgaatctgatgatgatggtgttgagactattaccctgggagataagaggattggcatcaggaccagtctcctggaggagaaagcaacagcatgcagtatgctgtgttgctatgctgatgactcaaaggaagggttttcccatgggattgatcangttgcaactactcctgggtacctctccctccaaatcctatttccatgacgaanttaagaagcactnttcnancgatgcctgacttctgcgttcnacaaaattggcagttnnaaaagccaantccaagnccggaattccttaccttnannactacctgattacatagtcccacnccttggnanagctatgccataaaaacctggacacacatgtgttccaanatactggancttgaacgatccatcaagattcaaggacactctcgatgaangcaagttagatattatggaggaatnaagaantatacacaagctcatagagncagacaacaaaggcaacctaaaanttntcaanancacctcnaggaaaaacacaggggtaaantttttaattggatttttggnccgggaaattttaannncccccccctttaa

SEQ ID NO: 81587 - DNA, 408 bp, Triticum aestivum
  unsure (1)..(408): unsure at all n locations
  Clone ID: PAT_TA_81587
tcgagggtgacaacatgattgagaggtccaccaaccttgactggtacaagggccccacccttctcgaggccctggaccagatcaatgagcccaagaggccctcagacaagcccctccgtcttccccttcaaggacgtgtacaagattggcggcattgggaactgtgccaatggggccgtgtttnagactgggatcatcnaaccaaggcatggttgtcacctttgggccctactggcctgaccactgaggtgaanccctttttagatncaccatgatctctcccttggagcgttccctgggtgacaacgtccgttncaacgtccaaaacttgctntcaaggtttccaagcctgggtacttcgcttccaactcccaaagacaccttccnaggagctgcatttaacgccaa

SEQ ID NO: 81588 - DNA, 425 bp, Triticum aestivum
  unsure (1)..(425): unsure at all n locations
  Clone ID: PAT_TA_81588
caaatccaatctcgagcccccctctcccgtccgcccgtcccaacccgatccgatctcccccctcctcctccgtcgccatgggccgcaagttcttcgtcggcggcaactgggaaatgcaatgggaactgtccaacaggtaagaagancatccgtcaaatactctgaacgctgggcagtttgcctcctacngatgttgtccgaggttgtccgttaaccccgcctatntctccttccccaccgtccaagggtaactgcgccagaattcaatttctgtccaaaactgctggtgaagaaaggcnggctttaaccgtgaatcaattgctgaatcttgtnactccgggtccctgggcacccttggactctaaaaganncttttatggagatccaccttttttgaaaaagntcaaatcacccnaangctgaaa

SEQ ID NO: 81589 - DNA, 447 bp, Triticum aestivum
  unsure (1)..(447): unsure at all n locations
  Clone ID: PAT_TA_81589
tcgccttcggggccctcnncgtcntcgccggcctcttcatggccgncaaccaagtcggaggtgacaccgcgcacggaatcttcttcatggttttgggcattgtaatgttcatccctggattctactacacaanaattgcctactacgcatacaanaggatacaanggcttctctttttcaaacatcccaccaatctaaanaacaggtgtttgcaaactccctcgggcccttccgtccaatggtctactgataaagcaagcaccttgttgtctcnttgatcctatgtgtacatccttccgcttgtanaatgaactacgggnaatttgtgcatataagctacanaacatgttnacggngaatgngcagaaagtgtcnacgtntgataagtttattgctggntgtccgctcccatgtctganaggaagacataccnggatatttacgtgt

SEQ ID NO: 81590 - DNA, 678 bp, Triticum aestivum
  unsure (1)..(678): unsure at all n locations
  Clone ID: PAT_TA_81590
gtgaagtgaggattatgcgtcggctccgtcatccaaatattgttctctttatgggtgcagtaacacggcctccacacttatctattgtatcagaatatcttccaaggggaagcttatataagattattcatcgccctaattgccaaatcgacgagaagcgtangattaaaatggccttggatgtggtaatggtgaaattgggatgttatatttccatgcttattcccatgtgttatggcatataatgataatntcccccccggttaggccaaaagcatgaatgnccttcataccaatggtgcccaacaattttcnaccgggattntaaaaccaccaacttgccgggttgaccataattggnctggtnaagcccngtgattccnnctttcancgtcnggaacacataatttttgncaaccaaaacccacggccggaccccggatgggatggacaaaantttnccggnatgacatccaatganatgtganattacaacttggggtanctgtgggacnacacactagaancaggntggataacaatcanttgggccattgnttcagccnggttnaatccaaaatttccaatgncattactatgcggaagttaattggcctttnccaananccaaataagtntaccccaanagaannttcnaaatttggggacnccggggnn

SEQ ID NO: 81591 - DNA, 514 bp, Triticum aestivum
  unsure (1)..(514): unsure at all n locations
  Clone ID: PAT_TA_81591
attgtcacaaacatgaagattattgcccacttgctgctgtgctgtgccctttactcttcttgttccttgactggactctggggctctgaagattattcagtacccctcagcatgtggctatgttacatgttttgtcaacaccttttttagccttggatgattactctagttgtgtttgtcaatagaacctcatgaagcattgctacctttcaccccaagcaagcgagtgccatgccgagatagaaancatgtgtttttcaatccnacaacccacgggtaatgatgnatccaaaggctgcttaatgcaccatgactgaatgcaanactcctttgatgccaaacgggtaaccctacgaatcctaattatagccaaaantaagatccgtatgccttangctgctccnaatgggttacacnaccatgtatatatgtaggntccaaagaggncacgggtggagcattgggaaggatactgcgggtacggcctcntctgtccgtactgcggaaacctcat

SEQ ID NO: 81592 - DNA, 280 bp, Triticum aestivum
  unsure (1)..(280): unsure at all n locations
  Clone ID: PAT_TA_81592
cttagattagctactaatcacccccactaaccccactgacacctgggcccaaggccattaacttaacctaaaacattagattaaataaaactccccctgagtcacttacaagtggggccaggcggccactttgactgggtcaaggtgtaccggtcaactgctgtctgtgcagtttgactgggcccaccatcaacccctccnggtgcactccgggtgcaatgcacacatgtgcacctaacaattccccnttnatttccnaattaaaataacccgntatttc

SEQ ID NO: 81593 - DNA, 599 bp, Triticum aestivum
  unsure (1)..(599): unsure at all n locations
  Clone ID: PAT_TA_81593
caaatccaatctcgagcccccctctcncgtccgcccgtcccaacccgatccgatctcccccctcctcctccgtcgccatgggccgcaagttcttcgtcggcggcaactggaaatgcaatggaactgtcgaacaggtanagagcatcgtcaatactctgaacgctggacagtnacctcctacggatgttgtccaagttttccttancccgcctattcctccttcccaaccgtnnaagggtaantgccccaagaattcaattgctgtcaaaacgctgggttaagaaaggcgtgctttaaccggtgaattcaatgctgaatcttgtaactccgggttccctggtaaccttggcatctgaaaggagactttatggganatcaacatttntttgaaaaaagtgcattgcancctcaangctnnaagcatgattttggggaaactgancacaaaactggtaacatgggtttcctanaaaaacattgtaaantaggcggcactgnccccaaacaatgtgcatgacgnaanttaccgnagaaagatcaagantggaggcaaaaatnccccggtntacacggtanaggggttntgaatagttgccacc

SEQ ID NO: 81594 - DNA, 390 bp, Triticum aestivum
  unsure (1)..(390): unsure at all n locations
  Clone ID: PAT_TA_81594
attccgagctgacgtgaagatcgcttttaatgacctgagaggtcactgtcggagcggtggccgaacaggcggtcataagaaaagcgcctagccggatagtctggccggcggccaaagctcccttgacgacggtgccgtctttgaagacgggaaaaggcatccttcctgatggtgacggcacaaaggaactctcaaatgaaanaccaatgtccgtgtcnaaaccggcggtttccgtaanggggncccccaactgttcatcctaagncgantgtaacaaggaacaaaggaccatgttttanccaagttttggccnccttnnatggaggtnaacccaagtccngctttgatnanatggatangttttttannagatngttttaccacgaattt

SEQ ID NO: 81595 - DNA, 498 bp, Triticum aestivum
  unsure (1)..(498): unsure at all n locations
  Clone ID: PAT_TA_81595
gccgtgcccgcgatcaccgtgccccaggtcacgttgccgcccatgccggccgtccctgcgctcaccgtgcccaaggtcacgttgccgcccatgccggccgtccccgcggtcactgtgcccaaggtcacgttgccgcccatgcccgcagttgttgtgccgaaggtgacgatgccgccaatgcctgcaatccatccatctccatccccaaggtggcattgcctccgatgccttccatcccactgtgaacgttcccgatgccatcccttgcgccacctccttnnagcataagcacgaacaagagcaccgggagcgggaatctacgatgctggtcaaatgattttngaatgtttacttgatatttgatttggcattaccgtttngcactgtttaattgtnccatccatttgttttggtgnttgggtatatgtatacaatgggtttcaatgggcactctttcttcccttggncgantttaaaanaaattagtaatttacaann

SEQ ID NO: 81596 - DNA, 555 bp, Triticum aestivum
  unsure (1)..(555): unsure at all n locations
  Clone ID: PAT_TA_81596
cttcctcgttcgtgtggcagatctcgcgttcatctgcttcttcctaccgggatcctactccggcaagagcaccatcgccctcgtaagcagatggtgtggcgtgtttttccccaaggatagcacttcaattttggtccagattcggctcaaatncaattagaccgttgttgttctacaaggaaaaagaggtgtggcgtgttatcccacaaacancaaattgtacacccaacaacaaaccaacaagatacatccaacctgattgggngctgacaaaatggcaatttcgaccctggaacacatgncttttttgggactggatangcttcaaccaaggaaagagaaaacnctttaangtttcccnaaaaaggaagngttatccccnatatttgccacattgagggnaaaccatttttncngttaacattacncaaaaaanattggtggtgactccatgaaaaanaaatgtcccatgtgaagtgtcnaacaaanggtttgtttcctgcatttccnagncccaaaaaatncccncaaaaagggtttgtnaaaaaaaaaaaa

SEQ ID NO: 81597 - DNA, 389 bp, Triticum aestivum
  unsure (1)..(389): unsure at all n locations
  Clone ID: PAT_TA_81597
cttggaggcacaaagtacatggtcatccaaggtgaacctggggttgtcatccgaggaaagaagggcaccggtggcattactatcaagaagaccggcatggccctgattcttgggtatctacgatgagcccatgactcctggccagtgcaatttggtcgtggagaggctccggcgactacctggtccgagcanggtttcctaacccgccctggatatgctgttatttgggcctcctngggactaatttgctcctactgtgggtttgcacccacctgcttnggcntacgcangatatagccatgnatattttacttgggggttgnccgntgggtgatgtntccaaaggggaaaaaggttacnagttcctttttaagtttgggaccctccgt

SEQ ID NO: 81598 - DNA, 354 bp, Triticum aestivum
  unsure (1)..(354): unsure at all n locations
  Clone ID: PAT_TA_81598
gccacctctccctcctcctcctctcttctgtgggctgtagcaacggcaagcgggtgtcgccagccgtcgccgaggcgcgaggatcatcgtcatcgtcgtcgtcgacaccgccgggagactcntgtggatggcgtctgtcgctgcccctgcggaaggggccgaggtgcaagaagaaaaagactggtcgggtcatncaacggattaactgatctgtttggacgctgtnccnagcttcnagttcttcggnagtccaatccttggtgtttgtttcttccatttngcaaccaatttgattcctcccccgggtgcaacgtntttccccnaactgatactatatccaagatttnaaaaaan

SEQ ID NO: 81599 - DNA, 387 bp, Triticum aestivum
  unsure (1)..(387): unsure at all n locations
  Clone ID: PAT_TA_81599
tgcagttcttttttggtgtcatcacattgcaaaaaatgcagtgcagtttggcgacggtggacttgcattgtggttcgacgcccgtggaggtgcagtttgtccacagggatcttgtgtttttttttgtcaattttttttatgcctgatgatgtcccaggcgccctcgacaagcagtacgaatagcgacctcgagcagctcagcagcgacatactctatggttttcaagctaggagtgtgcagttcggtagccacctgatacatgttatttttgtatttcttttcttgtgctgcgtgatctccatgtgttctaccaagtgctatgttcacttcataaanaaaagtancaaagatatcccacaagagttcactcctttccnaatgcaaan

SEQ ID NO: 81600 - DNA, 626 bp, Triticum aestivum
  unsure (1)..(626): unsure at all n locations
  Clone ID: PAT_TA_81600
tttgagaccaattcaaagggagttgaaatattctggaagagttggctgcctagggagggcactcccaccaaggcagcgcttttcttctgccatgggtatggagatacctgcactttcttttttgaaggggtcgctaagagaatagccgctgctggatatgcagtatatgctatggattatcctggttttggattatcgtatggtcttcatggctacatcgcaagcttcgatgggatggtggaccatgtcattgaacaatatgcgagaatcagaggaaggaaagacgtgcaagggtcccatactttctcttgggggcagtcaaatgggaggtgcggttgctctgaaagtacacttaaagcaaccaaaaagaatgggatggatgctcctgttgcgcctatgtgcaagatttcaagaagatgtaacaccaccagcactagtgttgaagcattgagcatatatcatcctcntccccgaagcaaattattccgcaaaagncataggagattgggatcaaggatcantgaaaagaaaatatgtgagtacaacggatacattatgacagataggtaggcacattactttaaggtacaagacatcaatccattgaaaaattgtcccatgtatct

SEQ ID NO: 81601 - DNA, 556 bp, Triticum aestivum
  unsure (1)..(556): unsure at all n locations
  Clone ID: PAT_TA_81601
ccacaccgccgacactcatctgatcacccactagctagctagcagcttaaggaacttccagctagcgatcgatggctcgtctcaacagcaaggctgtggtgtccgccgtggtcctggcggcggtggtgctaatgatggccgccaagggaaggcgacggcactgtcgtgcgggcaggtggactccaagctcgcgccgtgcgtgtctactnaacnggggaaaggngccctcgatcancaaggagtgctgctccggtgtgcaaggggctgaaacggcctggcccgcaanaagcccgggaccgcatgatancgtgcaggtgcctcaagagctcgccaccagcaatcaatccatcaacatggaaaagtctccggcgtncccggaantncggcgtcagcgtgcctttcccatcagcattncaacaactggaacaatgtcactagtnaatataaaccttccacgtgnatncaggacccctttntggnnctaatgtcaanttgatggatgctnatacatactgactactaatannaatnattgcttctntttaaaaaaaaaaaa

SEQ ID NO: 81602 - DNA, 474 bp, Triticum aestivum
  unsure (1)..(474): unsure at all n locations
  Clone ID: PAT_TA_81602
cgcangccgtgtaccagtggaaccggaacgacgacnggaagcangtgcccacgggcaacgtggtgttccacaaccattactgggcgancaacacncggcgcaagcggctgaanaanaagcacctccggtacgagagcctctagggcctcatgtccatgctctangagctcnttgttaccancaccactacanaacattgggcancggcacgggagtttcaanangccccggcgggaggcacggganctttgcttctgcttctgcttttgttggccgctggcaccctggtcngncggcggacctcttccgcggnggcggacacggtggcatatggtataacctgggcattcatccattccacacacttcttcagactgtgctggtactgctatataatgaaacgtccgtccgaccatgttaaatccggcatctagatggcacaactgcacgttaaatcgataacacccaaagtag

SEQ ID NO: 81603 - DNA, 446 bp, Triticum aestivum
  unsure (1)..(446): unsure at all n locations
  Clone ID: PAT_TA_81603
ccggctcgtaccctccgacgacgggcgggcgagactactacagctacggcggcggcggcggcggtggcggctaccccgcgcagtaccagcagcaggggtactactacccgcagcagccggctgcgaacatgcacacggtggtgcaccatgggtactccggatgaccccaaacagctgctccatccatgtnagcaagcagcaatgagaaccatgggatggtnctccccccatttacttcccgatccaagttattaagtgtacataatgcaaaccccggcaantgtgtgcnttcctttcctcctttcctttcctttttttcccnatgaactgtgtgctttccaggtgtnttgtgttnatatgtnanttactccnaggattacanctacttacgtgtgggatgttaantattccancnccttattaaaacagagggaagcaagaaaaaa

SEQ ID NO: 81604 - DNA, 238 bp, Triticum aestivum
  Clone ID: PAT_TA_81604
ctcttctctcttctctttctcttgtcttctctttcttctgtcttccctttctcttctcttctctgcttgctcttctactctcttctctgccaattttagtgtagaactagtgtaggagtacaagcaaccttcttctcatttcttctcagtcaattaaaccttttctgttaattaaaccttttcaattcagtaaatgaaagtttccattaaaccttttctgttaaataaaaaaaaaaaa

SEQ ID NO: 81605 - DNA, 618 bp, Triticum aestivum
  unsure (1)..(618): unsure at all n locations
  Clone ID: PAT_TA_81605
cccggacatccgaccccgaccggacatccgaccccagcccatccgagccgaatctacagacgcccgataagcaccggacgtccggaccctcgcgagcctccggacaaccggtaaccaccggacgtccgacgcctgtgtgctgatttcgtgttgggccgaagcccatgtaccccttcgacctctaagactatatatagacctcctcctcctcttttctagggtcagtgttgtgatagctcatattagagatagagcctcgctcatccacatcgggatctactccttgagagaagaccgcggcccctctacagagaagatctccttgggattcaagacccccttttgggtggccccatcaagacctcctttggagaagaaccggttaccgtgtatcgtcccttgttgatcgtggatcgtgtgaaccctttgtgtccgagaatctagcatatgtgtgatcatcttgttggtttagtgttcctcggttccctcgtgtcatcgtgtcaangcggatcgctccttcgtgaagtcggcgtaagggctacataatcaattancatgtaatgtgaactgtcaacaacatatgaagttngantatggcaattggcaagaatcagcgtt

SEQ ID NO: 81606 - DNA, 379 bp, Triticum aestivum
  unsure (1)..(379): unsure at all n locations
  Clone ID: PAT_TA_81606
ccgggcccaaacgcacagcctctgccacaaccagacgtccaaggctcgtatccgcaggtacaaccattgccagattcaaacacgtcagggcgacaaaataacgcactacagggaccgcaaccacttggtgcagcttcaacgttatattcatgtggtgctacatacaaaaacatatttttcatgggtttattgttgtactattttgtgtagataaagcgatgctttttcatgtaaataaatctaccattttgtagactttgtatctaaagtgatgtatcggtctggcatgatctctctgtatttacattcatactactaatgtactatatgcaataaatttttaaaaaaaaancnanggaagaaaaaaaaactccccgga

SEQ ID NO: 81607 - DNA, 558 bp, Triticum aestivum
  unsure (1)..(558): unsure at all n locations
  Clone ID: PAT_TA_81607
gttcatttcctcactttgatttcgactaagaacatactttcaacattatggatttgtgccctgtgtatcacctggtaaatgatatcccccattttaacttaagaaaggtagtcatcgcaatcaacagctgactctctgatacctacattccagcactctagtttttcttccatacccttcatttacttctccaagctatacttgaaaagccaagcctcttgtagcatgttctttttgctgcaaaaatttaataattacagttaaacttgcattgttattgtcatgctattatatatctcttctggttttaagttaagtgtaacatcaccaacctttantgatagctgggcttgggattgaaagatgtatatgcaatttgggttgctactgggaantgccaatcatgggccaattttttacttangtaatttgggntctaagtttttaagaacccattntnccagcgcactttaggaatgtataactaatacnnnaatctaggnggcaatancaccggtanaagcggtanttaanncgaatagcacgtccccctctgan

SEQ ID NO: 81608 - DNA, 186 bp, Triticum aestivum
  unsure (1)..(186): unsure at all n locations
  Clone ID: PAT_TA_81608
tctataaactagtgngatcccccgggctgcaggcgccgtcgacncgtcggngngnacctcttctgggtccgtngtccccggatgntgctcancntcantccacttcancctcttccagnacgcctanganttcgcctacttgttcgtggncgcnagcgatgttcggnttcanctcgtgcatcatgg

SEQ ID NO: 81609 - DNA, 565 bp, Triticum aestivum
  unsure (1)..(565): unsure at all n locations
  Clone ID: PAT_TA_81609
gctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaaggaatggaaangaaggatgttatgacgaaaaatgtttcaatctacaaagctcaagcatctgctcttgaagctcatgcagcccccaattgcaaggttctggttgttgccaaccancaaacacaatgctctcancctgaaggagtttgctccatcatccctgagaaaacacacttgtttgaccgccanacacacanggnactcgtcanattcnaaaaantgggtcaatttcgactnaaaaancatacnggggaacaccctca

SEQ ID NO: 81610 - DNA, 568 bp, Triticum aestivum
  unsure (1)..(568): unsure at all n locations
  Clone ID: PAT_TA_81610
gaggaaatcacattgggctggctgtactcatctgagactgacctctggacggagttcgcctctgttcatcgccccaatgccaattatttctctaacatggatgcgcctggcgtccttgtgggcgatgcactctacttcaacattgatggcgtcattgaatgccagcttggtacactaagcttgtcaacgttggagaagccgatcgatggcaatgggactctcatgatggcggaagatggcaggctgggatacgctgccgtggttgatgtcacagatctaaccctgtggtcgagggaggctggacccgagggagccatgggatggacaaaactcanggtaatcgatcttaagacgctactccctgatggtgccctctttatcacaacacaatatgggatcagtaggtcgccgcgttcattgatgattagtgggatccagagggcaccaagtcanttttgtaacacatgggttggtccnatatggcgatntcaagtctgggcgagcaagatgnctccgtccggcanaaatctccgtaatagatcactccacaangaacactcacggtagg

SEQ ID NO: 81611 - DNA, 519 bp, Triticum aestivum
  unsure (1)..(519): unsure at all n locations
  Clone ID: PAT_TA_81611
tttgatgctgtcatgaacaaaggctttttttcatggctactcgtttattacacttctgatgattcttaaccatgcactcagtggcattgctgtatcaatggtgatgaagtatgctgacaatattgtcaaggtgtattcaacttcagtcgcaatgcttctgacagcaatcgtatctgtcttcttgttcggcttcaatctgtcccttgcattcttccttgggtctacggtcgtttcgatatcggtgtatctgcattctgtcgggaagccacagcagcagaaatgagttccgcccccatctttctttccaagattggcaagcgagtgcctcgatgccgcgtcgcggaacggattacggatagcacaggacggcagcatcggaggagagtagacttggttctagtcatggaactgttgttgaggcaaggcgatggatngcccggtgacatatcaggtcaccgtccgtttanctgctcngtgggnatccctggttactttnccnggggatanggtggtcccgca

SEQ ID NO: 81612 - DNA, 317 bp, Triticum aestivum
  unsure (1)..(317): unsure at all n locations
  Clone ID: PAT_TA_81612
aaaacaaaacaaaggctggactgaattaatcaagcaaatgttaagtttggtgttttgacatcaagccatgcacaaagagtaagaagcgcangatcatagtaggcatgcttaaacacttaacaaagtancaataacattatttattcggcaatccaccagcttcgtgaaatacaggaacgcaaggagcgacactttggcgactccaagaaaatggcctgcaggccgctccgctctgggacgaactaaacgcagagttgacttgttcgatgatgctccggctgctcgaggagcggagctgacgttttttttttttgtct

SEQ ID NO: 81613 - DNA, 498 bp, Triticum aestivum
  Clone ID: PAT_TA_81613
ggcagctccctcacctcctccatcggcctgccgcgcttgctccacggcggcgtccacccggccaggttggccccatgcagcgagcagatgatgtctgcatgcctgctactgtgctgctgttgcttgctacttctgcccgctgcgctgccttgcaagctgatgccgctgctactctttgcaagctactgcagatgccgctgctacttgctcactgcccgtcgttgttgctcactgcgccccgctgttgctggccatggccgagtgcatcatgtcagcatgtgcgtgtggtgtgtgtgttcggctcaacaattgccaaaagaggccggccctcagagctagatcctcaagaacggcgtgctcaagctcgtccacgaccgcggcgagccgggcacggccacggccacggcggcgatcgggcgcgtgcatggttgccgggagctcgtggtgggcacatgggcaattggaagcttcaacgcccttaaagtgtttgacaaattt

SEQ ID NO: 81614 - DNA, 503 bp, Triticum aestivum
  unsure (1)..(503): unsure at all n locations
  Clone ID: PAT_TA_81614
cttcttaccatccaggaggcatgtatcatgaatctaacatcgcacctcatcacatcacccaaacatggcatcaaaatggcaagtgccctgagaacacaataccaatccgacggaccaaggaggaggatgtcttgagggccaattccatcaagaggtatggcaaaaagaggccccagagcatcgcaaacctcgattcaatcaataaaccaagtaatatccaatatatcgacggggcaccaggttgataactgccatgggaccaaagccagcttcaatttgtggaaaccaacaattgcaagggccgatgactttagcttgacacaactctggatcattgggggttcctatagtggcaacgacctcaataccattgaagctggatggcaggtatacccaggtctatatatggatagaaatactaagactcttcatctactggactccgtgatgcgtatcaaacacaggatgttacaacctacatggccaaggttcaccanacaaan

SEQ ID NO: 81615 - DNA, 495 bp, Triticum aestivum
  unsure (1)..(495): unsure at all n locations
  Clone ID: PAT_TA_81615
caatgtgcagcatccccgcaaaacaaaaggattcaatgtgcagcatcccactgggtgttgcatcgtacaaggattggacaaggaaacgtcgtctgtgcagcagaccactggaagtacattttttatctttcaaaaaatcaaatacccaggatacaactacattactgattgatctcctacaacaatttctagatggaacgatggcaaaagatcaggggggggagacatacatactgatcctacagcatttgcactgaacagttttccttacttccatgacaagattaagacggaacagaagcagaacatctccttggctcttccaactctataacgtgaacatttgtggacggttacngggctgaggacgcttcactggtgaanattatcatatttctcagagctgtcgaagaattgttcacgttagctccaaagacggnccgtggcagcgtctggggtctcatatccatcngaggtcaacagtgtgaccaacaa

SEQ ID NO: 81616 - DNA, 290 bp, Triticum aestivum
  unsure (1)..(290): unsure at all n locations
  Clone ID: PAT_TA_81616
tcttggccgtgctccncctgctcgctgggggctccncgtgcgcggccaagctgccgccgccgccgtgcagccggtcgtgcgcnatgctcaactgcgactcggtggggatccggtacggcaagttctgtggcgtgnggtggagcgggtgcaaggggangacccctacgacgacctcgatgcgtgctgccgcgagcacnanagttgcctcaanaaaaaagtgtttttgttatgcangttggtnnaaaagaagaagatccananaagatcttagnaanancgatantttttac

SEQ ID NO: 81617 - DNA, 417 bp, Triticum aestivum
  unsure (1)..(417): unsure at all n locations
  Clone ID: PAT_TA_81617
cggtgggtacctccagagagtgttctccctcttcccgcagaaggcgtacgacgtggacacgggcatccggttcgtgcagtacgcggggctcgcgtggtcggtggtcgacctggtgccggtgatcttcacgcatctgaacctgtgaagtcgatcgaattagcgaatctaaggctagcggcatttcgttaatttcttcggaggacggcggatgatccctcctccatgtctcgcaggctgttgatccattgatctcggcctcatttttgtgttgtatgtttgtctgtctagcacgtcctctaccggggtgttttcttcctgtacagttgtccaaagtancaacgaggaaagtatacacgtgatgaccttgtgttttgtttgatggaaaagctacngactgcnatgtgccaattaggctaa

SEQ ID NO: 81618 - DNA, 523 bp, Triticum aestivum
  unsure (1)..(523): unsure at all n locations
  Clone ID: PAT_TA_81618
caccctccctggacggccgccgcacagcggtgacgcccacatcttgcttccctccttgccgccccttgccacctgctccgcacggccctgctgcccatctctcttcctcgcccagctccggcaaggtctcctgctctccaccacggggagggcttgttgactgcggcaagaacacataccacactaccagtaccagtgattgatagggattcctcaggatctgttctgtcgtgctattggtgagatttgacctcccgcgccgccctgtgacgctgcctccacgaccgcaagaaccggggatggattccaagtctatccgattgatgggcggccaatcttcgtggatgaggacacgagggctccatctagaattctagaccaaactgccatcggcatgagccaaaacgaattcgctgacaagtttcnttgtgctaatcatgtcagtantgagtcacaaataaatcaagtgaattaatggactgttctcttcaagaaaaacaacaattacctgaaaaaaaaaaaa

SEQ ID NO: 81619 - DNA, 489 bp, Triticum aestivum
  unsure (1)..(489): unsure at all n locations
  Clone ID: PAT_TA_81619
ctccagcccagtcaaacttctctcgacctcgaagcatcagccgccgcaccatggcccccaaggcagccgagaagaagccggtggagaagacccccgcgggcaagaagcccaaggcggagaagaaggtgccggcgtccaaggagggcggcgacaagaaaggggaanaagaaggccaagaagagcgtggagacctacaagatctacatcttcaaggtgctcaagcaggtgcacccggacatcggcatctcctccaaggccatgtccatcatgaactccttcatcaacgacatcttcgagaagctcgccggcgagtccgccaagctcgcgcggtacaacaagaagcccancatcacgtcccgggagattcagacctccgtccgcctcgtctcccggcgagctcnccaagcacgccgtctccganggcacaangcgtcacaaattnactcggctanttctgggtctgattcttgtgtnccctnctggnctttc

SEQ ID NO: 81620 - DNA, 526 bp, Triticum aestivum
  unsure (1)..(526): unsure at all n locations
  Clone ID: PAT_TA_81620
ctttgaactgaggttagtactcatcggttatacttttgtaggtaggaggcccgtcatggacggtctctctggggaggagagactccgacacggctagcgaggcactggccaaccgtgaccttcctgccccatcactcggcgtcaccgacctcatcacccgcttcgccgccaaggggctcaaccacaccgatatggtcgccctctccggtgcgcacaccatcgggcgggcgcagtgcaagaacttcaggaccaggctctacagcgaggagaacattgacccggccttcgcgacgtcgcgcatggccacctgccctcagctaaccggctctggcgacaacaacctggccccattggacgatacgaccccggactccttcgacaacgcctacttcgtcaacctcaagctcaacaagggctcctaactccgacaagtgtctanacccttccggtggtgccaccgaagaataatgatggcttccgtcnacaagatcgttaanaacgccttgcgaaccatgggaaatgggaa

SEQ ID NO: 81621 - DNA, 529 bp, Triticum aestivum
  unsure (1)..(529): unsure at all n locations
  Clone ID: PAT_TA_81621
ggatgacctagcagtgaagattggccggcccctctgctcgtactccatgagttcctactatttggagacaagctaggaaagatggatgacctaaagattggctggccctacgccatggcagttcctccgtgaatgaggatcggggttgatggcattattagaggaaatgcatcttgagcacgggctgttttcgtctaggaactgattttcgtggtcttccagtttccactagagctctaggctggtgtatctcacatagagaaaactggagtgaccttcccgtgtgatccttcggtgtgatcctttattttaccacctcaattttcatgtgagatgtacattgactattgttctttgtttccgcgaaaacctgttcaatcaaagcctttgttctacgaaaaactctgttcattccaaactctctgtacattgacaatggtccttgtttcacagccactccgggaaccagtactcacagagcggnaatgtaatcattctaaatgaaaggtctggntggatctaaaaaaaa

SEQ ID NO: 81622 - DNA, 382 bp, Triticum aestivum
  unsure (1)..(382): unsure at all n locations
  Clone ID: PAT_TA_81622
aatcacctccgccgngtcctcgccgtagtctgggttcatcncaaaccactccggcggtacctcctcgccgtctttagaccgctcggggacgaagatgctggtgttggtgtactcggtgatcgccccagcatcnaggaggaatgcgaggcggaggatggaggtgagatggaggcaccagaaganggagtagacggccagcctcagctcgactgcgcctccancaacnagccgcgtgcgaccgagccgactgccgccggnggtgatcaagccganactacccagccggncgncccgacgccttgatgcngcnncctcctcagacnctccgaatcccgtttgctgcgtccaaanttgccccgttagctttaatntnagcnggctt

SEQ ID NO: 81623 - DNA, 584 bp, Triticum aestivum
  unsure (1)..(584): unsure at all n locations
  Clone ID: PAT_TA_81623
gcggcagctaccgctgttgtgactgtctcagctgatttcttctcaaccgcaatctcaaccttcttgtcgatgttttcttcagttaacctccatctttcctttctctcctctgtggtctcacggtaatacttcttccacatggcgcctccgacactgtgcacgcgtccatacgacggtcgagtgtccaccaagagtcctttaaatatgttcaacgcccggttgaatggagtgccccattggacctcaccaacgcctcagacggcaagtcgctttcggccgcaatcctgtgctgctctctctgcaaaagaagcaaggatcgtttacaaatatgactaaacatgcagtcaagttgatcagaaactaaaattaccagcagtctcatgaactcatcgtgaccgggtctgtctcaaaaaccttcntgactgggtccaatggtaccgggccctgangactcacgctcctgcaagacgtgaagtccgccaaggggtctgggatgccagacttacgttcgcatcctcctggncatatggactcttccgccgtaacacgnttcgaggtgtggaccatgttctcgttaagccctt

SEQ ID NO: 81624 - DNA, 599 bp, Triticum aestivum
  unsure (1)..(599): unsure at all n locations
  Clone ID: PAT_TA_81624
ccctcctgcccccgagcgccgccgccgccgccgccgccgactgcagccatgtcnctgatcgcgggtgaggagttccancacatcctgcgtgtgctcaacaccaacgtcgacggtaancanaagatcatgttcgcgctgacctccatcaagggtgtgggccgccgcttctccaacatcgtctgcaagaaggccgacatcgacatgaacaagagggccggagagctttcctcggatggagatggaccgcctgatggcggtggtgcacaanccgcgccagttcaangngccngactggttcctcaacaggaagaaggactacaacgacggnaggttntcccangtcntgtccaangccgtggncatgaagctcanggatgacttgagaggtcaagaagatcacgaaccatcgtggtctcctcactnntggggcgtcctgtccgtggtcagcacacnaagtctaccggcangaganganagactgttgggtctccangancgataacctgcttacaacgattnccaaagctttcnacnaggngttgncaattcagatcctaggatntcctgttaaacaatacttgatnactttccnaaataat

SEQ ID NO: 81625 - DNA, 590 bp, Triticum aestivum
  unsure (1)..(590): unsure at all n locations
  Clone ID: PAT_TA_81625
ctccaaaccctagcctcctcctcctctcgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgtaaggagcttggaattactgctctgcacattaactcccgtgctactgggtgggaaacaagacaaaaatccaaggtcctggtgctcaactgcgcttaaactcttgcacttctgggcatgaagattggacgcattgaggatgttacccggtccccactgacacacccgccggaanggtggaaaagaggaaggagctgtaatcatgctcgttcaggatggaaaatacaagctatcgatatctgcgtctncaactgttcgtcactcgttatggatgtaatcagatctgtggatt

SEQ ID NO: 81626 - DNA, 561 bp, Triticum aestivum
  unsure (1)..(561): unsure at all n locations
  Clone ID: PAT_TA_81626
gtaagcgctcatctttgtcgaggagtgcggactcaccagccttctcacgccggatcagttcctcaacgagcgggagagtatgctccaggggatctcttcctcctgcgcgcctggtgagaacgctttgtctgtaactccccttctaatgatactcttgtggtttgtatttgtaagtgatggtgtcaagcttcagttgtcagttgtgtggggcagctaaattgtgagtttaacatggctgtataatgtaggatcattactctttgatantcattccactgtgactgcttcaatccgctttcatgacttgctgcaacttcccttgcttatttcttaaattctccacccaattaataatgctaattccataatggacctttaatcatacttataacttcagctttcaagcattataccttgaacactgcgttcctttactcccgccttgatttgtttgaccttcgcattgactcctgatcaattagattgggcgcgtgtgtcgtgaagatataatacatgatgattacagtaattattatgactcacttgtttaanaagattttg

SEQ ID NO: 81627 - DNA, 482 bp, Triticum aestivum
  unsure (1)..(482): unsure at all n locations
  Clone ID: PAT_TA_81627
ggctagccagtggtggtttcctcggctccttcccctccagcccgtgcgacgaggtggttcattttcctggtggtgggctcctcggctccttccgaaccaacctgtgtgtcgtggtgcaaatctactgggcgtcaacacgatggacaagaagctcgatgaacaagaagcacttcatctagaggcaactattgtgtgccatcaagatagcaacgtcgatctagttcttaatgggcaatgcttgctcaagtgatgattatcatagccttggagacttaagcatacccgccatgttacgaaagtgaagcaatttcgctaacaatcctgttgatcttgtcaagttattgatagtcaatttgaatgtctcctccngttaagccccggtatgttccaatttgacatgtactaaaaaaatgtggcgtgggataaactatttgacatgcatcaaacattagtgcctataatggccatttaaaaaaaaaaaa

SEQ ID NO: 81628 - DNA, 579 bp, Triticum aestivum
  unsure (1)..(579): unsure at all n locations
  Clone ID: PAT_TA_81628
aggctaaccgtttgaagaaagaaggaaaagaacttgaaagcacaaggctctattttgaggcagccttaaaatttctgcatgtagcatcacttctggaacctcctggtattgatggtctgaaacaaggcgatgcagctcagagcatgtattctgatactgcaaaactctgcaactttgttggtcatgaatatgaaaggtgcaagaagatggccgctgctgctttagcatataaatgtgttgaagtagcttatctcaaggctgcatactacaaataccctattgcaagtanggaccggcaggtgttgcaggcagttgtacagactacaccaggcgaatcaccatcatcttcagcatcaagacattgataacttanataacaatggattatctaagatggcccttcanacaaggatgctaatcacccaagttgctgggaacatttatactggccgttcgcaatcaacacactgacaaggtactanctatcaaatgatgtcaantccgccttgaggnactcggaatcacagatgcaatgctcngctgcngaacatgaaaggatggtggcttctcagtaaaaag

SEQ ID NO: 81629 - DNA, 557 bp, Triticum aestivum
  unsure (1)..(557): unsure at all n locations
  Clone ID: PAT_TA_81629
gcagagcgtcttcacaaacttagaaaagctcctcgtcaggtacaaggaaaacttgctctgttttcttggggaaagagaaataaattagcgccagctgaaacaccaccaattgaaagcagcagcagtacccgaaatgtggtaacttatattgataggttgacaccgagaggccaccccgcaaaaaaaaagaagacaccgagaggccaatcgttcgagctggatgatctgcttcgacgatcggctgaagttctgggcganggtacagttgggacaacatacaaaacgacgcttgatggtggttatgagacggtattcaagaggctgnagggatgtggacttgccgaagtgtactttgngcagcatatgaggatgattctgccatccggaacaagcacatttgccatgnggcggtattactncannacggatganaagatgctnngttanatanatcccatgggtancctaccaaantacccanggggatgaatcccgggnagatccnctggnggggacannntttggcatcccaccctggngccttgggtggggntann

SEQ ID NO: 81630 - DNA, 568 bp, Triticum aestivum
  unsure (1)..(568): unsure at all n locations
  Clone ID: PAT_TA_81630
gccggatcccacgaactgctatgtgccaaaagggagtgcataagctcattaaattgagtaacataagctaacacagaatctatctggcgtaagtggaagagctggcgcaacagagaggagaactcgttgcgctcaaattggtcacagaccaatgaacagaaagattcccaagtcaggttacacaaggtaaaccctcctttctcgatccaaatcatcgtcggacccgaaaaatgcatagcagcagcatctacccaaagctccagatcaaggtgaaacacacagaaataggactcacaattccttttccaactgcggggcgctctccccaaaatggtggaaancaatttgggacggggaatggaaggggaacaaaaacgatgtgggatatcccgaacggggagnattccgctgacgtgagaatccccagacaatggcggctcntgatangatggactanagntcntgaacgggaaccttgagatgtacgtaccatggccggaggtggaacggggtagtactacccagatcagacccgagtcaantgtctctgnancatcgggccgtggtt

SEQ ID NO: 81631 - DNA, 175 bp, Triticum aestivum
  unsure (1)..(175): unsure at all n locations
  Clone ID: PAT_TA_81631
tttcgtttanatctgacanctgtgtccngcactgtttgggnatttagcantggtcatatttttatctgnatcaantantcatgccttgttaccgtgttgttantcacatacntgnattnaagtcaanctgggtcngcaatgntgtataacatgttcaaantaacngcacaactta

SEQ ID NO: 81632 - DNA, 479 bp, Triticum aestivum
  unsure (1)..(479): unsure at all n locations
  Clone ID: PAT_TA_81632
agcctcctcactcctcaaagcatcctctcagtccttagctcgccaccacccacccaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagatggccggcggggagaccggcggctgcgactgcaccacctgcaagtgcggcaccgcctgcggctgcgcctgctgcagctgcaactgagccggcgcccaangaggccggcggcaagaggcgaacacgaggattangaggagaacaagcacatcacaatttacaacaaccancgtatcatttggttacaaccgctgcatccccgcgccncgcgccnaatnaataaacgtcnnttccacttaattatccgttccctg

SEQ ID NO: 81633 - DNA, 191 bp, Triticum aestivum
  Clone ID: PAT_TA_81633
ccggatcgcggggatcatcacgagactgtacgagatcaaggcctcctgcccacatgtgtacttccccgtagaaaggtctcacaaaccccccgggacgccaatcgactgcgcgttggttgactaatcactaatattcatgtatgcagccttcatgtcctctggtgcaaatgtgcgtgttgaaaaaaaaaaaa

SEQ ID NO: 81634 - DNA, 220 bp, Triticum aestivum
  Clone ID: PAT_TA_81634
cacaggtttagggttttagcccccccccctaaacctgttttctgtttaatttgtattgttttatttcttttgtgctttattttaattttgaaggagtttcatatattctacggtactacatacatgcatatgaatgtacaatttcaaataaatttgaaattagaaccaaaaagaattcaagaggaatatacaatatatattcaatatcaaaaaaaaaaaa

SEQ ID NO: 81635 - DNA, 488 bp, Triticum aestivum
  Clone ID: PAT_TA_81635
cttgctcatatacatcatcgaccaaatggcctccactctcaaggtcgccatcctggttgctgccctgctcttcctgagctctggggtgcaggcggcggcagaccttacaggctgcgtcacgacgtgcgcgggcggctgcgtcgccagggccgatgtcaaggagtgccaggccaggtgcgcaagcagcagcgacatgggttgcaccacttactgcgaaaccctcttggcaggctgcttgggtcggctgcatcatcttgaactgcccctcctgctagcttaaaaagcaaatgaagatccatctcggcgtggacttcgcaagccatgtggccatcagccaagaatttattaactacctctccgtctaaatataataacaaggccgcgtgtgtgctgcctgttgtatgtaccctattatacgtgtatgtggtgtatcacatgttatgtgtcattaataatatccaacggtcgattcgttggggctgttgatt

SEQ ID NO: 81636 - DNA, 586 bp, Triticum aestivum
  unsure (1)..(586): unsure at all n locations
  Clone ID: PAT_TA_81636
tttttttttttttagcaggaatagtatgatctgtatagatggttattttttgcattacaaaacaagcactggttacattacataattctgataaatatgctctcacaccttcaccagtttactacacagcactcatggttgcttggtgcttgctcagaccaacaatggcaatggcagcctgtagagatcaggggcatgcatgtggtgctgtcacaggctaccaaaccagcattcacctctctatagtaagtttacactctgctatatgctactagggaagccaccgcgtcgcacgcgcgcacacgcagaatgacagaagcgctgctctcttcaacgagatcggtcnacgctgagccgcnagctgaccacctgcagacgtcgtcnatctcttcggggatggtgtagtggccaacccgttgtaggtcttgaatgtcagatacgagaacccgagcacgcaggaactcggtcgaacgctcnccgttcctgtagggaaaactcgtcgctctgcaangctgaacaagatgggcagggagcaggggggccggtaccaatcncctaagngagtctataccncnccatggcgtct

SEQ ID NO: 81637 - DNA, 573 bp, Triticum aestivum
  unsure (1)..(573): unsure at all n locations
  Clone ID: PAT_TA_81637
atcaccattgatattgccctgtggaagttcgagaccaccaagtactactgcaccgtcattgacgcccctggtcaccgtgacttcatcaagaacatgattactggtacctcccaggctgattgtgctgtgctcatcattgactctaccactggtggttttgaggctggtatctccaaggatggccagacccgtgagcacgccctccttgctttcactcttggagtgaagcagatgatctgctgctgcaacaagatggacgccaccactcccaagtactcaaaggcccgttacgaggaaattgtcaaggaatctcatcgtacctgaagaagttggctacaaccctgagaagttccctttgttcccatctctggggtttgagggtgacaacatgattgagaggccaccaaccttgactggtacaagggccctaccttcntgangtcttgacaagtcaatgancccaagaggcctcagacagccctgcgtctcccntcaggatttacaagatggtggcatggactgtctgttggcncttaaacgggtatnanccggatggtgtacttgnccacggnc

SEQ ID NO: 81638 - DNA, 274 bp, Triticum aestivum
  Clone ID: PAT_TA_81638
gtgattacgagtgcaaatgcaattttggacgacgggatgacggtaacaaggggtgtgaacccgtattgtccaaggctgcagtagcagttataggtgaggcattgtatgtatgccctatgtagtttcttaatgctataacatatgaaattccacattcgaaaatatatctctatttcactggattttaacacctagtagttctgtacatgtactatattattctgtgaaaagttaaaaattacaattgttctaaagtttgcgcaaaaaaaaaaaa

SEQ ID NO: 81639 - DNA, 637 bp, Triticum aestivum
  unsure (1)..(637): unsure at all n locations
  Clone ID: PAT_TA_81639
tgttctttctcatgcgaatttcattgcaaatgtagcaggccaggacttgggcgttaagttttacccctcggacgtgtacatctcatatctacctttggcacacatctacgagagaactaaccaaatatggctcgttcatcgcggtgctgccgttgggttctaccaaggggataatttgaagctgatggatgatcttaatactctgaaaccaacagtatttgcgagtgttccccggttatataacaaaatttatgctgcaattacaaatgctgtgaaggagtctggtgggttgaaagaacgattatttcatgctgcatatgatgctaagaggcaagctattatcaatggacggatccaccccagtgtgggataagttggatttancaaaatanaactangctggggtggacgagtaaggttatgtctcaagtgcttcccattgtcgcaaatgtatggatcctcagatancttgggggtgaatcttgangcacgatgacggacactgtgcatactatgattggggaaaacaatggcaagtggttccaaccgctgtagtaactggggnccgaannactacacgggtacaaccccgggaaantgcgggactaaatnnggtcaaaagnnattaaaaggatta

SEQ ID NO: 81640 - DNA, 234 bp, Triticum aestivum
  Clone ID: PAT_TA_81640
atccatgttatgtatgtaccatgccggtatcttagattatgctctataaatacatgtcttggtcagcgttctactccttcggtctcaaaatataagctcaagtgatcttatattttgggtgggaggaactaatattttgatgaaaaagaaagttgaacaacgctcagaagttgaagggcatgttctcttggaatttattgctgttaggccatctacagccagaaaaaaaaaaaa

SEQ ID NO: 81641 - DNA, 258 bp, Triticum aestivum
  unsure (1)..(258): unsure at all n locations
  Clone ID: PAT_TA_81641
ggttcctgttccctggcggagagagagaggcagggaggganaggaagganagaccnaaggccgcggtgtttttaccccgtctcttcctccgccttcgagctttactggtgaattggtgttcgttctttcgctcntcttggtccatgggangcaggagctatngnntatcattgaantcctttgcancagtggnatancattgtncnatcaaantcttcggntgaanaatgnttttcantcnattnatcnacaacagaa

SEQ ID NO: 81642 - DNA, 469 bp, Triticum aestivum
  unsure (1)..(469): unsure at all n locations
  Clone ID: PAT_TA_81642
cggggtcatcncncccatcgccatcggcttcatcgtcggngccaacatcctcgccggcggnnccttcgacggcgcntccatnaaccccgccgtctccttcggccccgctgtcntcaccggcgtctgggagaaccactgggtgtactggntcggccncttcgcnngcgccgccatcgccgccctcgtcnacnanatctgcttcatcggacancggccccacgaggagctctccacngctgactactganaantcactctcaatctcatccatccatcagcgccatgagagnttgaaatctattcaanaaattccagcaattgtactcggncgtntcatcatcagtaggccggttagtttattcnntcnccctcnctctctctccgngtcnttganaaatcangggtaaanattgtcatncagtcatncnggaaatcccntgtcttggagtagtcctannataagnctcaa

SEQ ID NO: 81643 - DNA, 592 bp, Triticum aestivum
  unsure (1)..(592): unsure at all n locations
  Clone ID: PAT_TA_81643
gcctgaaccagtataaacgtcgtgtcccttgtgtgttcttccttctagcatagattccttgcgagacttcgagacgtgagttggtaggggaaagatcttcgtgtgcaccccagacttcgaacctcaagggtctgccggaacccgaaatccgacatttggtgcgccaggtaggggtgcgccggaatccttcttccaccacctcgtgttcgtcgcccatcgcgcccatgtttaacgctcgccgagcccgcgccgagcgccgggctactctccgccgcccggagtcacccaagacggctcccgttgggcgggcgcccccgtcgttcccccgtcgcctgccgccaaacgccactaccggcccgacgaggaatgagcaacaagtgtcgtcactacaccctcngtggttgcnggaaagncgcaccgccacccgtcactgatccaaccgttctctcccatcccgtcgccccccanggacacgcanccgcgttctcctgacacnatactcctgcacaacntccgtcaacgactctacatganggcnnctcgatnacgactgtaatgccgaagggcnnccnggcctccttanngctaactn

SEQ ID NO: 81644 - DNA, 601 bp, Triticum aestivum
  unsure (1)..(601): unsure at all n locations
  Clone ID: PAT_TA_81644
tgataacttagcctgttttctgaggttgcagccgccggtgttttctagtagcaccgagcccatagtagcagatgattggctccgcaggattggaagggaattaaccactacaggatgtaccgatgctgagaagctgtgttttgccgcacattggttggatggaccagcagcctcatggtgggagaattacactatcacctaccgtatagccactgttacatgaggtcagtttcaacaagctttccgtacagcccatgtctcaactggagctatgantatgaagaagcatgagtttcacaacctacgccaaggggaactgtactgtggctcaagtacggtggatgagtttagcaagttatctcgttatgcccctgatgatgtggccacagatgcccaaaagcaggagaatttaanggnanggctgaatgatgagatgagcatgcagtttatggggggcaacattcaacaagnncaggaantgggacatangntcctttgattgaaggancanancagatnagacctnagaggantatgccaagganattaatcaggactnncaganctcgctaaccnaatcgggaggnttttatacctggcg

SEQ ID NO: 81645 - DNA, 304 bp, Triticum aestivum
  unsure (1)..(304): unsure at all n locations
  Clone ID: PAT_TA_81645
ttttttttntttttttttttttttnaactccatggcaantcttacctttanacaattgnangtancaggttcacctactgatggacaaanctttcnttttcnttatcacaccgcaccnattganctcaggtcactaaaaaaactactaanccggagntggtttcctctgccatanaantgcacanggttgccctgtgncacatagggangcctctcncttgcaaggccctgcaaaaacccagggntgccacggcgatcatcaantcggcaagtgcaangatgacatggntcttgnggaccgctg

SEQ ID NO: 81646 - DNA, 549 bp, Triticum aestivum
  unsure (1)..(549): unsure at all n locations
  Clone ID: PAT_TA_81646
ttttttttaaacaaaaataacacttataattctcataatagaggtaacaaaataagaggaaacatttgtctgtgtgaccgaaacacccgataggtttataaaatgatagatgcatgtccgacgattcaatgctttctacgttacaagatatcctttacaaaatggtagctacaagatgcattggttttgctccattacaaaagatatctagttgagcaaactgacagcttcatggtttcttcttgttcctcttgtcttccgtgcacaacgttttcttatcgataatgaaattaacaaatgttgtctttccaccaccatcagagatctcacgcaagattaacacggaggcagatgcccctgggcttgtagggttcatcttgctagatggtcatgcaatggaccttgtgacagcatcggcgacaaattgtaaaccatcatattcatanggcancgttgcatccttgngatcacaacattgacaacaacctccacgagaaatctaggaggtataaattgttgtgacccctgcgcttgccttttcctcctaag

SEQ ID NO: 81647 - DNA, 282 bp, Triticum aestivum
  unsure (1)..(282): unsure at all n locations
  Clone ID: PAT_TA_81647
tttttttttttttttttttttttttttttttaaaattanaaacacttgaattaaaaactttccatgaccncccttcatgtttttancnatgtttttggnaaaaaggaaattaaagattgttcancaggcttcttccnaaccnacaagacaaaataaaacaaantgatgttctcttgtaaaggaaaccttttatttcaagaccanatcnaanaatcaggcatgagggaacnttcagcggngcaaccactgcactctggggtngatttggntcaaanggggggg

SEQ ID NO: 81648 - DNA, 522 bp, Triticum aestivum
  unsure (1)..(522): unsure at all n locations
  Clone ID: PAT_TA_81648
ggaggatacatagagggggaaatcaccgtatcaggctatccaaagaagcaagagacctttgcacgtatatcgggatactgtgagcaaaatgatattcattctccacatgtgacaatatatgaatcactcgtattttctgcatggctgcggcttcctgcagaggttgactcagaaagaagaaagatgttcatcgaggagatcatggatcttgtagagctcacatcattgaggggggcacttgttgggctccctggagtgaatggtctatcaactgagcaacgcaagaggcttacaattgccgtggagcttgttgctaacccgtcgatcatttttatggatgagccaacatctggtcttgatgctcgtgcagctgcaattgtgatgaggactgttaggaacactgttaacactggcaggacgtttttgcaccatcaacaaccaattattgacatattttnancattnatganctttctngaaaaaanagggnanaaaanttattgggccnnttggcaaaatcag

SEQ ID NO: 81649 - DNA, 660 bp, Triticum aestivum
  unsure (1)..(660): unsure at all n locations
  Clone ID: PAT_TA_81649
acatctcaatgcggaaaataaagtgagcaatgaacataagagggaaaatacttacagagtgccgctccactaagagggagtgtgactgggcaatggtcgtggtcgtgctcgtgcactcgctcaggctcgggttggtagctcggagctatgtcactagtagaaaaaaacccattcgtcccggttggtaagggccttttgtcccggtttttgaactgggaataaagggttgttactaatgccctagccctttagtcacggttcttacacgaactgggacagatgagcctccacgtggccggtgcggcgagcccaggcaggagggcctttggttccgaatggtggcaccaaccgggactaatangcgtccacgcgtcagcatttcaagggctggggttttgtttttaaagggggggttggggntttggggggttaattaagtgttcanaaattgtgttaactaccaattaataganagaagttccnttctaagtcntgcttggtggacncactacnaatactntnagagacanacaacaacnactataacaacaaggaaaaantctctaaattttctcangaaatatttncactccctcccaanatgncanaaattccgaanaccaatcggnnattnatatanctaatnacccaattnncatn

SEQ ID NO: 81650 - DNA, 505 bp, Triticum aestivum
  unsure (1)..(505): unsure at all n locations
  Clone ID: PAT_TA_81650
ccagcgcgtcggcaccggtgcccccgtctacctcgccgccgtcctcgagtacctcgccgccgagctgctggagctcgccgggaacgccgcgaaggacaacaagaagagccgcatcatcccccgccacctgctgctcgccgtcaggaacgacgaggagctcggcaagctgctggccggcgtcaccatcgcgcacggcggcgtgatccccaatatcaacccggtgcttctccccaagaagacggcggagaaggagggcaaggcgcccaatcccccaagaaggccgccaatcgcccaagaaggccgccaccccgaagaagcttaaagagagatgcgatnctgtatcngtttangctgtgtgctgtgtaatgttcatcctgaatacaanagtgaaagtgtttcctgtctaactgttgatgtacttggtgttgttaatgttcatgggaagaattcaaaatcnctttgaatttccaatatctgcgtggctncncctggtgcaanaaaaaaa

SEQ ID NO: 81651 - DNA, 606 bp, Triticum aestivum
  unsure (1)..(606): unsure at all n locations
  Clone ID: PAT_TA_81651
gaggatacaagtctcgggtccttcttcttcccgggtcgccactgctccgacaccatggaaggtcgtgatgcgcgccatcccttcaccgtgatgcacgcgagatacatgccccaagggtcgtctctccttccaccgacgacggttgcggcagtgcactcgtccctctctcttccagtggagtttggagtttgctatgtgtcattcttctggttgaattttgcactcgatgcggtccgctctgaccgttcccgcaatttagatgggagcttgatgaggttcacattcaaaaatgcactactccgatagcggttcagcaactcatcccatgcactcnggtttgcacaanntgtgggttgttntgatntncgggaacnacaactngttgtcctgccnttgcgacgcggaggcgcatcaaccaaacnttgnctgnatccgctcccggccctatcnaaantntggaaaaacggtggtnagttggttgagtgnanaattngcaattgccgtcnaattaantttcaagtttncttgnaaattgaattcccataaaatnttttgggnngtcaatngttccnaaggcaaaggannccgngggctncatccctcang

SEQ ID NO: 81652 - DNA, 362 bp, Triticum aestivum
  unsure (1)..(362): unsure at all n locations
  Clone ID: PAT_TA_81652
ctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaaggagcaacctgcttttgacaagaagcatttactcctcacatgaagcgctacatccaagaacctcactgccaaccttgaaggggatgacctagatttttccaaagaagatgttgattctgcaacgaanaacttcc

SEQ ID NO: 81653 - DNA, 415 bp, Triticum aestivum
  unsure (1)..(415): unsure at all n locations
  Clone ID: PAT_TA_81653
gtgatccgggccgccaacgggaggaccgccacggccacggtggtggacgagtgcgactcgaagcatggctgcgacgaggagcacaacttcgagcccccgtgcgcgaacaacatcgtcgacgggtcgccggccgtgtggaaggcgctcgggctcgacacggacgatggggtggtgccggtcacgtggtccgacgcgtgacctaggtacacgagctaccaaacgcgacacgcgcactccggatccgtcatccgtgctataccactgtcgtccgtgcatttcatcacgtattagtattcagaataaataagcatcccatgcatgcatgcaactgtgtaaaccttgccgatncaatatatgtaatgttctcgctgttcacggttattacaacttcaattcatcnatttttggccaccac

SEQ ID NO: 81654 - DNA, 543 bp, Triticum aestivum
  unsure (1)..(543): unsure at all n locations
  Clone ID: PAT_TA_81654
aggcggcgaggaagtcggcgccgaccaccggcggagtgaagaagccccaccgctacaggccggggaccgtggcgctccgggagatccgcaagtaccagaagaccacggagctgctgatccgcaagctgcctttccagcgcctggtccgcgagatcgcgcaggacttcaagacggacctccgcttccagtcccacgccgtgctggccctccaggaggcggccgaggcgtacctccgtcgggctgttcgaggacaccaacctgtgcgccatccacgccaagcgcgtcaccatcatgcccaaggacatccagctcgcccgccgcatcccgttggcgaagagggctaagcttcctctccgtntaacgacggtatggttcgggatgattgattccgttgtattggtcctaatgctgtccaagtctaacttttgtgttanaagaatatggttgttagtatgatnagacgaacaacntgataagtnattccctttggttgcaatgaacaaactattcaggtnaanactcanaacattgtttcccngaaan

SEQ ID NO: 81655 - DNA, 500 bp, Triticum aestivum
  unsure (1)..(500): unsure at all n locations
  Clone ID: PAT_TA_81655
acaaagacaagtcaacctcaccgaggagaagagaagaaaagagaagcgagaagatgtcgggccgtggcaagggaggcaaggggctcggcaagggcggcgccaagcgccaccggaaggtgctgcgcgacaacatccagggcatcaccaagccggcgatccgccgtctggcgaaggaggggcggcgtgaagcgcatctcggggctcatctacgaggagacccgcggcgtgctcaagatcttcctcgagaacgtcatccgcgacgccgtcacctacaccgacaccccccggcaagacctcaccgccatggactcctctacctctcaaacgccaaggacgcaccctctacggttccggagntangccgcacaacaacaagattaggactacccatgtgtagntcgtggncctccgtgtanccatanctcgctgttgtcnctgtgtccgtagtccaatggatggatngaattaactattntcnttganctcttaaaaaaaaaaaa

SEQ ID NO: 81656 - DNA, 368 bp, Triticum aestivum
  unsure (1)..(368): unsure at all n locations
  Clone ID: PAT_TA_81656
ctggtgtccaaggtgctgccggtggtgaagaagtcgaagaagtacggtgggatcatgctgtggtcgaggttctacgacgggaagaccgggtacagcgacaaggtcaagcccagcctgtgagctggtattaattaactgctaagctcgggtcagggatcaagagcacgtgccattaacatgtcctctatcacgtgtcaagcctgatactgagcaaagacaaataaccggacagaaatgtactgtatggccgtattcaccactaggaacacttcctctatcacatgcatggncttttgtnccnaagtgaaatttgtaaatttgatcaggtttatgaaaatccacataaaacactaaaaaaaaaggggggg

SEQ ID NO: 81657 - DNA, 513 bp, Triticum aestivum
  unsure (1)..(513): unsure at all n locations
  Clone ID: PAT_TA_81657
ccctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacattcgaggtggccgccgggcaatccggcgagggtgcagtgcggcgacaactgcaagtgcaacccctgcaactgttaactgcatcaccctacttatactttgatggtgtngagagtatacgtgaataacgacntctgatctgatggatcccacaagttgctgtgtgtgtggttacttgctcctctcctccnatctctcccttgctnccctggtgtaagtgtatcangttcccggaattctcancnacccacnaggaggatggngaantntaaagaaaattactattacancctaaaaaaaaaaaa

SEQ ID NO: 81658 - DNA, 623 bp, Triticum aestivum
  unsure (1)..(623): unsure at all n locations
  Clone ID: PAT_TA_81658
ggagaattgccataagcaatctgaggaatcattggagaatcatccaaccgtcgacaataccatcaaagatatttctaaagagcataagaaattggcaaatgacttgaatcttttccagaaagagctggaaagacttaaaaacgagaattcatcccctcttcttccccttgacattaatcttattgacccgtcgctcagtggtttggaaagggcgttatcacagcttgatatggcaaatgaacatttgcgaagcattttcccttcatttaaagagcttcctggttctgggaaatgccttgggaaagagtacttgctttnggagcttggagttgggcggaagcgctgcaagcaaagaagaagacagacacgttttccaagagctcatcttgaagcaacacaacgacgaatcaacggtgtccaaagcttcaagggacatcaangagctgatacaggatacatcnagttgangagaaacaatggctgtcnanacnaattgnaggaatcaggnagtaccgggctaagctgcaattgccgangtggaagngaaggnaaaccccatacctgaaggccgncaccaggaatntaggacaagagaaaatgaaccgcatgtctcgcggggaata

SEQ ID NO: 81659 - DNA, 274 bp, Triticum aestivum
  Clone ID: PAT_TA_81659
cggagggccgtccagcggcggcggccggggctgcaacccacattatcactgcgttatccactgagtagaacggcgctacgtatgggcgtcaatgcaacctgcaagtctgcaacctcctgcacagcacagatccgtccacggagcactcacgcgttccatcgatccatgttctgttttcgtttccatttccatttggcatgtatgtcaatacgatgtcgttgctaccggaagcaacaaagatatcttgaaatataacttgcgagtaactttgttg

SEQ ID NO: 81660 - DNA, 537 bp, Triticum aestivum
  unsure (1)..(537): unsure at all n locations
  Clone ID: PAT_TA_81660
gtcaggctgccggtggacttcgacaaggaccatgccgccggcgccgtcaacgtaccctactacctcgccgttactccccaggggaaggagaagaacccaaaattcgtggaggaagtagctgcgctctatgggaaggaacatcacttggtcgtggcttgccgcactggcgtgagatccaagcttgcgaccgcggacctccgtaaatgcggggtatgagaacgcgaggagcctgcaaggtggctatgttgccttcctccaagagcgcagccgcggttaagcaaccacacctcagcattgtgaacttgacccatgccatgaatgcatgatcaaagcggnataaatcnggacttctttacatgtgcccaccatttttccctttttgnanccttcacaatgttcaatgatgatgtaaaatacggantntgtgtacgaatgggatctncacattnaacgggccgggttngggananattctgcaattncctntaggagtttcaattggttccatganatgatgtgtcccacaaaaaaaaaaaa

SEQ ID NO: 81661 - DNA, 366 bp, Triticum aestivum
  Clone ID: PAT_TA_81661
ggtcgacggcgagccggcggtggtgatcggcgggaaacagctggagaacaacctgctggtgttcgatctggagaaacaggtgctcgggttcagcatgcttctgagcgtccaattgtccggctgtcgaagctcctatttcttcagaaactaaacactagtgggtttgccggccagctcgttcttcaccttttcagcaggtgtaaaagtatgtgagtttgtcaggctgacattctacacacactgtagtcacttcaatttcacttggacgggttagaactttcactgtatctgtactgtgtacttgccaataaacacgtacttttttattttccgacctaaatgggaccctttatcaaaaaaaaaaaa

SEQ ID NO: 81662 - DNA, 250 bp, Triticum aestivum
  Clone ID: PAT_TA_81662
gatagatagatgtggtcattggttttgtttgctcctcgccacctcatcactctgttccgttctcgtcatcgttcttgtccgctgcatgctaaagtcaatcgtcggccggcaggagctgcctgcgtgtactactccggcggcgtctggtcgattgtcatattttccacggtaatggatgatgcttgtatatgtcaaagattttgtgtgatcaatgatcctgatctccctttagttctgcaaaaaaaaaaaa

SEQ ID NO: 81663 - DNA, 475 bp, Triticum aestivum
  unsure (1)..(475): unsure at all n locations
  Clone ID: PAT_TA_81663
ccaaaaatgaacaaattgctcatcgccctccccatcttggccctcctctccctcggtgccgtcttcgttctctcccaaaagaacctcgaagcctctaccatcaccattcaacaatgggaaggttgcagaaagaacgctaagatctgtgacaacatgaccaccgctgaacaaggcaaggaccaatccaacctctacgcttgttacgccgccgccggtaaggttaacgccatctacaaccccgaatctgaaaccatcaccgaatcctgcaaggctggtaaaaggttacaagagaggtattgctcaagattcctccccgacgcttactcgcctgtacaccgatgcaaccccgctgcnaacggttcgcttattctncaaaacatcttcaagccctccaaatgactgtggnggatcngaaaccngctctcaattanacttgatattngtaaaaggttcccncaanctanaaagataatat

SEQ ID NO: 81664 - DNA, 617 bp, Triticum aestivum
  unsure (1)..(617): unsure at all n locations
  Clone ID: PAT_TA_81664
cagcagcgtctcatctttgccggcaagcagcttgaggatggccgcacccttgcagactacaacatccagaaggagtccactctccacttggtgctcaggctccgtggtggtatgcagatcttcgtcaagaccctcacaggcaagaccatcaccctggaggttgagtcctcggacaccatcgacaacgtcaaggccaagatccaggacaaggagggcattcccccggaccagcagcgtcttatcttcgccggcaagcagcttgaggatggccgcacccttgcggattacaacatccagaaggaatccaccctccaccttgtcctccgccttcgtgggtggcatgcaaatctttgtcaagaccctcaacgggcaaaacatcacctnggaggttgatcctcaagacaccattgacaatgtgaaggcaaagttccangacaagganggnaccccccggacaanancgcctgatcttgccggnaaacagtccangatggccnaacctngcggatnaaaatcangaggatcacctcaattgngctaagncgtggggatcaaatattnangcctacggnaaacatcaccngaggngtnctcgaacatgaagtaagnaagttagn

SEQ ID NO: 81665 - DNA, 609 bp, Triticum aestivum
  unsure (1)..(609): unsure at all n locations
  Clone ID: PAT_TA_81665
gtccgccgtcgtccacctccagagcgccatcaagttcaacggcggcggtcatgttaaccattcaatcttctggaagaacctcaagcctatcagtgagggtggtggtgaggcacctcatggcaaacttggctgggccattgatgaggattttggttctattgagaaacttataaagaagatgaatgcagagggtgctgctttacaaggatctggatgggtgtggcttgctttggataaagaggccaaaaggctttcagttgaaactactcctaatcaggaccctcttgtgaccaaagggtcaaacctgcatcctttgtngggaattgatgtctgggagcatgcgtactacctncagtacaagaacgtgaggccggactacctgacaacatctggaagnggtnaactggaanatgctgganaagatatgaaaaattgttgcctgattnnctgatgagtnacagcatacttggtcccctganttcccncggtggatcttgtaancatnaanaaggggncnatccagncggactcntaaattaaaagggaacannttnacccanagcaatccatttggaantttaggcccgcntgcaaaaccatccaggtntt

SEQ ID NO: 81666 - DNA, 556 bp, Triticum aestivum
  unsure (1)..(556): unsure at all n locations
  Clone ID: PAT_TA_81666
agacggacgcccccgacgctgccccgccccccgccgccgacgccggggcctcctcctcctcgtcccgcaagccgggcaagcgcttcgagatcaagaagtggaacgccgtggcgctctgggcgtgggacatcgtggtggacaactgcgccatctgccgcaaccacatcatggatctatgcatcgagtgccaggccaaccaggccagcgccaccagtgaggagtgcaccgtccgcatggggtgtctgtaaccatgctttccacttccactgcatcagcaggtggtcaaagancgccaagtgtgcccactaagacaacagcgaatgggantccaagaaatacggcactaacacctcctcccgcgcgttacttgcctactaccacccaccaaaanccaagctactctttcgaaatngctactccgctatttanacattggatctaactcgttttgatatttgtataaagtcaagtatgcacnctaagcttcgtatctctcaaggatccccattaatacctgcgtggacttggcgtgctttttagctgcgggaaaaaaaaa

SEQ ID NO: 81667 - DNA, 477 bp, Triticum aestivum
  unsure (1)..(477): unsure at all n locations
  Clone ID: PAT_TA_81667
cttccttcctcccccgtcgtcgcggctccagcttagggtttctcgcccccgccctcccgcctcaccgccggccccgtacgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatctggctcaaagaagagtgggaagaaatgagtcctgcccaccttacgtaatgcccnagaaaatgataatctatctatctactacctgtgtcgcgcttcactatctgtggttgtaaagatacttcnanttgtgtttganattaacatttcgcatccggttgctgaactatggatttnacanctcttcgcttaccgttatcaatggccccnactataatgacatactgttttgtg

SEQ ID NO: 81668 - DNA, 181 bp, Triticum aestivum
  Clone ID: PAT_TA_81668
agcacctgtatattttggattgggcaacggttgcataaacagaagtgaataggtttatgacaactgaatattttggatttggcaactgttgcactgtatatttataacctgaataggtttatgtaaccagaacacttgaagagaatttcacagcgatagctggtcagagaaaaaaaaaaaa

SEQ ID NO: 81669 - DNA, 631 bp, Triticum aestivum
  unsure (1)..(631): unsure at all n locations
  Clone ID: PAT_TA_81669
gcgaggagggagaggccatggatcccgattcggtctcgaaggcgttcgtgcagcactactaccacacgttcgactccaaccgcgccgcgctggtggggctgtaccaggacggctccatgctcaccttcgagggcgagaagttcggcggccccgccgccatcgccggcaagtcggatctctccccttccagcagtgccagcacaagattcgacaccgtccgactgccancctccggggcccnanggcggctcctcctcttccgtctcccggaccatcaccaaccggccccgggnganacccctcaaantctcaacagatttccatttctgccaactggagganttctaacntgcaagacaatgttccgccctgaactatggttaaaggaaggcgaccctcctggcgnaaaactttttcaaggatttaagtttnaacaatgacatcaaatgatgatctgcaatccttgtttgtcncaacttgtcatttacccaaaaatnccanatttatagnaccacaantctctttggttgggttccaangtatgncttcttggtggganttcttgaatttatgnaactcagttaattaggtgaanccggnttttgacattagtaatttctncaaaaaaaaa

SEQ ID NO: 81670 - DNA, 475 bp, Triticum aestivum
  unsure (1)..(475): unsure at all n locations
  Clone ID: PAT_TA_81670
aatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaaccctgcaactgttaactgcatgcaccctacgtacgtgtgttgggtgtnaagagtatacgttgaataacagcgtctgatttgatggagtccacaaggtgcgttgcgtgtgcgtgtggttgcttgctcgtctccaatctctgccatgttccttgtgttagtgtgtgtcatttccctgtattcttanctancccaactatgatggagtgatatatttagaatgaaaatacctaannan

SEQ ID NO: 81671 - DNA, 524 bp, Triticum aestivum
  unsure (1)..(524): unsure at all n locations
  Clone ID: PAT_TA_81671
cacacttgaggtcgagtcctcggacacaattgacaatgtgaaggctaagatccaggacaaggaaggcatccctccggaccagcaacgtctcatctttgctggcaagcagctggaggatggccgcaccctggctgactacaacatccagaaggagtccaccctccacctgggtgctccgccttccgtgggggcatgcaaatctttgtcaagaccctcaccggcaagaccatcaccctggaggttgancctcctgacaccatccgacaatgtnaaaggcgaaatccaaagacaagganggcattccccccggaccaacaanccctgatcttccnctgggtaagaacttttaggatggcccaccttggcggctatacatccaagaagganccaccttcaattgggtgtccttctccntttgtggcaattatngcctggcaatggacgttcccntngttggntcaaaagcctgtnccttnganatcctccaatgtcctgttcgtcctcctggncttcaagntcaacct

SEQ ID NO: 81672 - DNA, 683 bp, Triticum aestivum
  unsure (1)..(683): unsure at all n locations
  Clone ID: PAT_TA_81672
ctcgagtttttttttttttttttttttgagaaacaggggggcacattattgcctcatctatccatccatatatgtgcaccaaggtacgtacgtactaggcagcaaatgcttgttcacaaggaagatgggtaactaactactccagaaacagctgataacagggagtggtacactggaaagagcggccactttgctgcaaacagctgataaactccgtcagaactgatggaggcgagatttataatttgggactccaagaaacaacagttcaaacaacctgaggtgaaccctgtcagctgttaggaagttaataaccaccttccctggaaaaactgtccaagtgcacctttgccaaggaaatccantgggttcaaagtgggtatcntgctggactatatatgggtganagcgaatgaaccgctcgcgcttccttccngntatacgtcgctcaaagaanaggattcgcacgcgnacngnacgtcctggatttaagtcctcaatccggangtcnccaaaatagtgccatctgaactctcctcccggnnctccaagattccccggccgcatgttcaacagcaccnagganaaaaacncccgnaaaccntactgntccctcactcagcaagnggttccctntttccttcccanncctaaaccatngncctatngacaaacggtccaag

SEQ ID NO: 81673 - DNA, 611 bp, Triticum aestivum
  unsure (1)..(611): unsure at all n locations
  Clone ID: PAT_TA_81673
aacagctgccttggcacccgcaagagcgggctcctcgactggggcgtctgctacttcctgaagctcctcccgtcgtcgatcaaaaggccacggcaagtggtcgtcccttcccgttcaccattcgggattttatgtgaaacaagttagcgagcagcttcccgaaagagatggaaaccaatggaacctatgatatgcacataaatcaatggaacctatccaaacatgttgccttctcaagttggctgggagttcatgtgggttattttatttgggactcctatttgccggggtcaagtcttaatgcaagtgtacaaatacatccaacagaaaactgatcacatgctcaccaataccccaagcgaggatcactacctgggtcccaattcaattggnaagaacaaacatcaaatccnggaaatattttagaaacatgaatcgactccaacaagactcaaggatttaatgggcacattaaaccgtgactccaagaaaagnattactttaaccctncanacgttnaggaaatctataaaatganactcgtaaccatatggatgtaactaangnnttaaaatgttaacccccgnacaaaatngnagactgatttcata

SEQ ID NO: 81674 - DNA, 523 bp, Triticum aestivum
  unsure (1)..(523): unsure at all n locations
  Clone ID: PAT_TA_81674
atgctgatgagtgcatggtgcttgacaatgaggctctctatgacatctgcttccgcactctgaagcttgctacacccacatttggtgatctgaaccatcttatatctgcaaccatgagtggcgtcacttgttgcctccgcttccccggccagctgaactctgacctccggaaactcgcagtcaacttgatcccgttccctcgcctccatttcttcatggttggctttgcaccactgacctcaaggggttctcaacagtaccgtgccctcactgttcctgagttgacccaacagatgtgggactcaaaagaacatgatgtgtgctgctgacccgcggcacggccggtactcaaagcctccgccatgttcccttggaagatgacacaaaggagttgatnagcaaatgctgaactccaagaacaagaancctcctactcnttnantgataccaacatgtgaatcaagctgtntanaccctcccaaaggcttaaattcgcactttgttgnaatccactcatcaagaa

SEQ ID NO: 81675 - DNA, 610 bp, Triticum aestivum
  unsure (1)..(610): unsure at all n locations
  Clone ID: PAT_TA_81675
gctagattcaatttggagcgtcgcgggaaggagcaggcagcagcggcaatacactgagggtggagcagcagagtcacctgatctaccagtatgtctgattgatgctgcccactgctccatcagcttgcatccagcatctctaaattagcattatgtcaggttctcgatatatttgcaatggattaaacaatgggcctctcttgattcacacatgttcacatttcaagctatttgatggtaaatcttgaatttattttcttatatttttttagcggattaattagaactgatttggttcctgatttgtttggggcgagtgcaacagcttgcgaactttaccactaatccacagtccactatgtaacaattaaaaggtgactggatactccaatagatgcatatttaatattattccgcacatcattagacaagtggtccatttgatacatttaggaanatacggctttccgactttagtaataccanatggttcttgcaaaatagcangctggaacacatgcnataaagntnaatnccatgtntgctataacagccanttgggcangttattcaanggtgcaaaaaacgnggaccgcagtggtaaatctaa

SEQ ID NO: 81676 - DNA, 654 bp, Triticum aestivum
  unsure (1)..(654): unsure at all n locations
  Clone ID: PAT_TA_81676
ctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaattcaactctgcaaggtcaggtctgtccattcggccagaagggcatcccctacctgaacacctatgatggccgcaccatccgctacccaaacctctcatcaaaggccaatgacactatcaantccnacctgggagaccaacaaattgttgacttcatcaattcgacgttggnaacgtggcatggtgactggcngnccaacactgggcgttttgtgtgatncaagaacaaggagaacataaggaacttccagacaccacttnaggatccaaggcacaatcncaccgtctggnaattttcacattggaaaggcacaaacanggtaactcccaaggcaggtanaactacaacatnaggacaaaggaacggatccctncagtgtgcaagctnatcnanggttatctttcaacanttctcagtanaanagttctacactttatttcnagtgtnttcaccgtcccaa

SEQ ID NO: 81677 - DNA, 309 bp, Triticum aestivum
  Clone ID: PAT_TA_81677
ggcgcaagtcgacccgcatcggctgcgcgcgcgtggtctgcgccgggaaccggggcgtcttcatcacctgcaactacaaccccccgggcaacttcaacggcgagcgcccgttcgcgttccttacccttggcgccgaagccaagtagtacgtacgtgtgaatgtgatcatgcatgtgtacgtacgtgcgtgtctttatgtgtgtgtggtttgaatatttatacgtctacaaacgctacgtgcgtacgtaaataagcacacatcccggcctgcatgtatccatgcggtctgtggagcgtgtaaatgtaatc

SEQ ID NO: 81678 - DNA, 497 bp, Triticum aestivum
  unsure (1)..(497): unsure at all n locations
  Clone ID: PAT_TA_81678
ccgtggcctcgccttcgacgacgaggccaagctgccgttcctgcggtacctgcaggaccagtgcgggctcgacgtcgagcagtacgtcgcggcgctcggggtggcgcggcacaggacgaggcgggcgcgcagatggtgtggggacttgatacttcacttcctcccgtcgccctgggtgtccgtctcgctcgccgccgtggttgcgctcatcattgtgccggcgatgttgcagacaatctacgccattttgggctaccaaaagtagacgatttccgagaaccaacatccaacatataggaggatgattgtttgttgtccaagtgtccatggtaacttggtcaaccttgaaacttcgcccaaacactgtccgtggtaattgcgtgtgtgctgtacttgattttctcaaaacaaaaaagaggttagtgtctcaatgttaaaaggaaatctagtctcnaatgcatcacgtttgtaatcaatnggctggtattaaaaaaaaa

SEQ ID NO: 81679 - DNA, 551 bp, Triticum aestivum
  unsure (1)..(551): unsure at all n locations
  Clone ID: PAT_TA_81679
gaagcatccaaaccctagactcctccccccaccagctccgatggcccgcacgaagcagacggcgcgcaagtccaccggcggcaaggcgccgcggaagcagctggccaccaaggcggcgcgcaagtcggccccggccaccggcggcgtgaagaagccccaccgcttccgcccggggaccgtcgcgctccgggagatccgcaagtaccaagaagagcacggagctgctcatccgcaactccccttccaagcgcctcgtccgcgagatntcgcangacttcaaagaccgacctgaggtccaagagtccgccgtctccgccctgcaaggaggcgcccgaggcgtactggtccggcgttccaaggacacaaccgtncgcatcaagccaaangcgtcacatcatcccaaggaatcaactcgccgccgcatccgccgggacgccctaagtttcngncacgccngtgatatgcgaatancgtcctgtcnggttctcgtcgttggtgttatatgctgtctctgtcnagtactgatctggatgaatgaagaaantantaan

SEQ ID NO: 81680 - DNA, 216 bp, Triticum aestivum
  unsure (1)..(216): unsure at all n locations
  Clone ID: PAT_TA_81680
gcaatgaataatgacaacataattcggaattccgattccataagaatagcacatgatgatacaagttgatgaataatgtagcaacgtgagtgtatgatgtattgccattcattcactacgatanccaaacagacagntcgctttccttcatgaaagtnncttaggaccagcgctatagctaaggttcacanatancanaccggncaacatgttata

SEQ ID NO: 81681 - DNA, 170 bp, Triticum aestivum
  Clone ID: PAT_TA_81681
ggcatgcaggagatgggccgctagatcgtccaactctgccgtacgtgtgaatggaggatcggtcgagcaagttttcgtcgtacttggtattattgcatagtatagtacgtactagctttgttaagttctgcacgtggaggagtgttgtatatggtggcgtgatgagtggt

SEQ ID NO: 81682 - DNA, 475 bp, Triticum aestivum
  unsure (1)..(475): unsure at all n locations
  Clone ID: PAT_TA_81682
cggtgatcgtgcgcgtgttcgaggagggcacccgcgaccgcccctacgggcactgcctcgtcgccggcctggccaagtacccgaagaaggtgatccgcaaggactcggccaagaagacggccaagaagtcgcgcgtcaaggtgttcctcaagctcgtcaattcacccacctcatgcccaccccgctacaccctccgacgtcgacctcaaggaggtggctccggggcgcccgatccctcacctccnaaggacaagaangtgggcccgccaaggccgccaaagccaactccgaggagaggtcaaagacccggcaaaaangtgntcttcaacnaantcccttncnagcctgcagccgaccgcgcaagctttctctgcgttacactgaccgtttaattttaactgcttcccttggacctcccgttttggatnccatnaanccgtttaagtggttctaatnaaatatggttcaagtgtnn

SEQ ID NO: 81683 - DNA, 612 bp, Triticum aestivum
  unsure (1)..(612): unsure at all n locations
  Clone ID: PAT_TA_81683
gcctctcccacttcttccccacactcgcccctcttcccgatctgaaggagaccaccgccaccgtcgccatggccggcgtcttcctcgcgcccaccgaccaccccttggcctaggaccttgttcaggagaccggctgcgtccctctgcttcgtccgcgccgaagaacgcgagcaccgcgccaccgcatcgactgaatcgacctcatcctccccacggctgctgctggcgatcttcttcggatccggcgatgcctgatgctcctaaactatcgacgggtcctcgtgtgcctacacaatgttggagcccaggagccagacgccaccttcgacaacgactcctactacaccggangtgcctactactacgtgctgcccgctgtcgacgaccagnaatagtttatgaggatccaagcangaggctgcactcttcgatntgtatcccaatttgtgttancctctaaggnaaactgttaacttagtcgtaccanaattgttgcttcggctgatcancttgatcagtctgaatcaaccttnaggcctgatntaaaaaagctgttatttaaaaaaanaanagcnaaaaaagggggccggacaatnnccaaangattntntg

SEQ ID NO: 81684 - DNA, 235 bp, Triticum aestivum
  unsure (1)..(235): unsure at all n locations
  Clone ID: PAT_TA_81684
ttttttttttttttttttttttttttttttttttttttttttttttttgggganggganggntttgcntgggggangggacaagaaatanattaagantaagaaanaagaggaaaagatctanaaatacatacngganaaacgaacanaggaaaagagnccnacaangactaagaaagaaaggaaacggcngntccctggngcgcncgcgccanggncacntggtcgggcggang

SEQ ID NO: 81685 - DNA, 657 bp, Triticum aestivum
  unsure (1)..(657): unsure at all n locations
  Clone ID: PAT_TA_81685
tgttagctttctgaaatagcattaagaacatgctcacatatgaataaactgtttgactctaatagattggtgtcccttccaagttatgttgcatgtttctgcttcattctatgtttttattgatggtagatcattagtcccatggttatggatgtttatctagtttattggtgtcttttctgcagttttgttggttaggtttactcttttctttattaccatgcgagtaatattgttgatgagccagtagtttcaaggcatttgcagtagcttccgttgtgatttatgatagtcagctaaggttcacctgacttcaaaatattgtctgttttaatgtgctgattccagctgttttacttgtgtgaaatctagatatgagatgtattgtctctaatgtttaatccggggtgcatcangcgctccttccaagatcgtcgattttccatggngggaacccaaaagcangaatnaancagtcnatttccaaggnggaacccaaagcaggatnaacaagttacggtcccgatcctcantaantaagaagccggcccttattcccagaaaccnaaagttgcgggggaantaccnccagggttggtnaaggcctaaggnaccnntaagcnatttaaggaacagaactnantgncagatgtccgg

SEQ ID NO: 81686 - DNA, 630 bp, Triticum aestivum
  unsure (1)..(630): unsure at all n locations
  Clone ID: PAT_TA_81686
gcgaaaccaaaccccagcccgccgcaccgtcagcacccatggcgcccaaggccgagaagaagccggcggcgaagaagcccgcggaggaggagcccgcggcggagaaggcggagaagacgcccgccgggaagaagcccaaggcggagaagcggctgccggcggggaagtccgccgccaaggagggcggcgacaagaagggcaagaagaaggccaagaagagcgtggagacgtacaagatctacatcttcaaggtgctgaagcaggttcaccccgacatcggcatctcctccaaggccatgtccatcatgaactccttcatcaacgacatcttcgagaagctcgccggcgangccgccaagctggcgcggtacaacaagaagccaacatcactcccgggagattcagacctccgtccgctctcctcccggggagtcncaagcagccgttcgaggcacaaggcctcacaagtcactctcgtaaatgtctgtctgttccctnttacttccggtggttgtgcgttacctgtaaatccacgtatnttcggntccaaatatacgnctctaatttcgtaaaaaaaaagattgttctcactgtanatgctgtctcgtnaaaaagnctntcggacgaacg

SEQ ID NO: 81687 - DNA, 602 bp, Triticum aestivum
  unsure (1)..(602): unsure at all n locations
  Clone ID: PAT_TA_81687
ccgcacccttgcggattacaacatccagaaggaatccaccctccaccttgtcctccgccttcgtggtggcatgcaaatctttgtcaagaccctcaccggcaaaaccatcaccctggaggttgagtcctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaagctccgtggtggcatgcaagatatttgtgaagacctcactgggaaagacatcaccctnggangtgggagtcntctgacacattgacaacgtgaangcgaagatcaagacaaggagggnatccccccgggttaagaacgtctcatctttgccggtaacagttnaggatggcgcacttggggggctaaactcaananggnccacctcacttggtgtccctctccgtggnggcaataaagtcctgnaaggagtcncttcggcccnggtcgaatccgcttgtccngacgtcatnagnngttcgttggactaantncggggg

SEQ ID NO: 81688 - DNA, 633 bp, Triticum aestivum
  unsure (1)..(633): unsure at all n locations
  Clone ID: PAT_TA_81688
cgggagcccaaagacgcatttctctcaaggtggcactttgagaagaagttgcaccaaggtatatccctaggtatggatgaagcattcgcaatgttctccgaggggtgcatgccttacgatcctttctgggatcgctatctcgagtactggaaagaaagtttggcgagaccacgagaggtgatgtttctgaggtatgaggagattatgtcagacacacccaaggttattaggaagctagcaagcttcctcggcgtcccgttcacccgtgaggaggaaagcggcggagtcgtggagcangtagctgatttatgcggcttcacttcacttagcagcgtcnacccaatccgggtaaatctgttgaagttgagcatgcangagttaactcngttggtaancctccttcgctgtttaagaaaggggaaggtnggagatgggtgaccacatgagcaangncatgganctagaaggacaactnttnctganaatcaaaggataaggccactccgnaagtgatgttgaccngacgggncatgtcctaaattgaccagngtngcagattccttnncccaaaaaanaaaaaaanccggggccggacaatcccaaggccatanggnaagctcttaacgntggaan

SEQ ID NO: 81689 - DNA, 579 bp, Triticum aestivum
  unsure (1)..(579): unsure at all n locations
  Clone ID: PAT_TA_81689
gctttcccagcagatcccattgtgctcatcacatgataatggatcaggcaaagggggcggttgggcctttattgctgatttgtgagcattgttattcctaaacacctagcttttgatagaagatgctcaaaagcaagtggacctcttcttttgctctgttgcagagtatctgattccatctggctggaaggtcctacctgttttcagtgctgttcatttgaacccctcgcttcatggaaatgcccaacagtttcagccttgcagatgggaggtatgtctgatttccataccatgtgcacgggcatctatatttgtagtcaagtaatgaatacatcttagnttaancagattanctttaatataatatgcttgttanggaagcctaactttgacataatatgctttttaagaactatttatacaatgaaaagtgagaacaaatcagaagagctatccggngctttgagagaatctctttaaggtgcncggtaacnattgngccttaattaggagttcaactanccatgcataanattctgaacatccgggactcanatcaaacagctttgctgaggccaa

SEQ ID NO: 81690 - DNA, 542 bp, Triticum aestivum
  unsure (1)..(542): unsure at all n locations
  Clone ID: PAT_TA_81690
tttgagtgaaacataatatatttttagtgataaatgtatatgaaaacaagagtggcttctttcatgtttgtagacatgtattattctactttggcatatgttatttgtatcttccacaatgggggaatatactatatatcatggttgattacttttatgtggttgatccttttgtttgctactcttttgtattgtcatcgtaataaactataggataacccacactttattgtgacaccttgttgaaaaatataattgacgctagaaanaacatatgaagcatgtggaaaaatgatatataaaangaggaaaaatatttggattgaagtagcggtatgccacttttttaacaaaaatgtgaacttgaactacatatatttccccaaagcaccaacacctatactaancaatgactacaaaattgatgggaaaaaattacttagnataactngcangctgcctnaggggaatatgcangntagattaagcatacatataataggtacatgcatggntacggaggtgcatggaggggaancagg

SEQ ID NO: 81691 - DNA, 512 bp, Triticum aestivum
  unsure (1)..(512): unsure at all n locations
  Clone ID: PAT_TA_81691
ggtggatcaggaggcggacgagttcatcaagaagttctacgaccaactgcgcaggcagcagaacctcgccgccgccaccccggagtacggctacgcgggtcgggccgccggcgtcgcgtactaggagctacactcgcctacgtgccgatcgaaacgtccatgcatataggtgttagctacttcccgcgcgcatgcatctttccgttccaagtgtgaagtgtgaacctgcctgctccaagtacatatatggttgtgatcttgtgcatagaccaagcatgtttgtacgtaagagagtcacttactatcatccaataatttccttgggagctagtgtgaattttccgtgttggattaagttgctgtagatccatatgcatgtactatatcactaagtcaacgactactatangtaacaagattgcacaacctgccatgtatatgcgctgtgtatggganactanccgtncagttggggtttggactngccgtcaaccaatnaaacaaggtggtca

SEQ ID NO: 81692 - DNA, 649 bp, Triticum aestivum
  unsure (1)..(649): unsure at all n locations
  Clone ID: PAT_TA_81692
cctcgagcacggccatctccagccgccttcaacagccgcgacccaccggatccggcggatgctcacgcgtgggagcggtgctgctcaggcaggctctttcgtcctcgagcacgacgcgtcgacaacggcctccttcctctcgttccctcttccattcccgagcacaactccgacgagcctgtcgacaggctagcctgctgtcactggatgctactgttgtttaccatcaaagtggcataagagcatccatgggcaggtccgagtaaaatctcatggcantccgagtaaaaatggcagcgagagaattggaactgagggtaagatagtttccgggagcatgttttatgtttgctgggaccctaagtgaattgacattgtttactttggtgaaaanctgaacgtggtgtttggatgagntctgatgttcnagtggttgggtaactgaaattcaaagacancttcctaattgacaggtctacgacatgggnacgtgggtgctcntgcancgccgatcggcaaacataagaggagtnaacaaatgttacgtcganaggccaaaggcctcatcatgctctgnaangattaantttactcataggntcaaactgttcgcacttcntatagccgcataggggtttgnaattaggaa

SEQ ID NO: 81693 - DNA, 567 bp, Triticum aestivum
  unsure (1)..(567): unsure at all n locations
  Clone ID: PAT_TA_81693
gggtctctgccgatgggcctccccgctcgactcatccgcggctggtgcggcttggcagtcctttgcctgcgcctgtgcgcaacatcctgcaacccagacgttgcgccgatagagcctctgccctcgaggtcactgcagtgctttgaggacggccaggtgtacgggtgctgcgagggcgcgctccggctggacgcgtcgggggtgatcggcgtgccgctgggggcggtggactactactgcggcggggcgtgcgtgggtggagacggaggacgtgctcaaatgcgtggcagcgcgctggacggttcaacttccgcaacgggcctccgttggagggcgcgccgctacccctcaaggaaggggtgcaaccacacatcnaagagagggactcaacctttggaccacccacggcaactacccggaatctacgggatacgcggcatggtgcaaggctacacgctcctcncanaacanaactgctccgttcaaagtgcccctgctgtgtaatcaaggtcctnaaatatatancctcaanacaaatgaatgntcancatcacngttaatttgang

SEQ ID NO: 81694 - DNA, 450 bp, Triticum aestivum
  unsure (1)..(450): unsure at all n locations
  Clone ID: PAT_TA_81694
gcgatacggatattgtatacgtttccggaaccaatttttgcatcttgaattctgttggtttgttagggtaaaagattgaaattttcgtatgttcgtcttatttgagcttgtgaatgtgttgattccttgcagggttgctcatacgcatacaaatgatcagcgtgatcggtatagttgccctcttcaagggaaacttcagtgtgaagttactctgttttttttttccttttttctttttcctgttcttgtgtgntgctgggccgccactgttagccatggtgtgatgttggngggnanaacgtacagttcactggnaatatatacngtactgtgtggtacnattcgcaccttttaaaaaatcccaatagagcaaaacactatngggtggtaaacnnaaaaaaaaatcccnnggggggcccggnaccatncgccctaaaggggncatntacc

SEQ ID NO: 81695 - DNA, 517 bp, Triticum aestivum
  unsure (1)..(517): unsure at all n locations
  Clone ID: PAT_TA_81695
gaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaangcanganagaagaccctctctgatcagtttgaggccaagcgcgccaagagcaaggcanncaggganangaagcatgccaaggaagggaggagagattgntcatggccccaagagtcatgcaccancacaagcgggctgcagtccagtcaagtcnggnagaagcggnacanatcaaggccaaggccaaganntgatggccgaaatnaacttnaatttcnnggaattttgaaggttacctgatttgggcatcngatcnaaacngtttntggaaaanctggtccccnnctgaatacttaannccattccggnngtnggtggnntttaa

SEQ ID NO: 81696 - DNA, 416 bp, Triticum aestivum
  unsure (1)..(416): unsure at all n locations
  Clone ID: PAT_TA_81696
ccgggtcgccggggacagcgacgccgtgtccgaggccgtcaaggcggccgcgccatacctgctgggcacctgcagccccgggcacggccgggagaagatgctcagcttctcctcctcgcagcagccgccctcctgcccctccgccgccgccgccgctcaggccgcgctgccgctctactacggcacgcccgcttcttgcttaggtgggactgcagcccgtgctcccgaagctttgctcctctttgatttgatttatgctggcgattgggaaagttgctatttcttcctgaagtagaatcatttttgctgtttgattcattcctagtaccactttctgtgggntttgggnagatttatttcggctgtttttgttgccatccatcacgcatttttctcatagattaaatgggagttca

SEQ ID NO: 81697 - DNA, 520 bp, Triticum aestivum
  unsure (1)..(520): unsure at all n locations
  Clone ID: PAT_TA_81697
ctcgagttttttttttttttttttttttttttttgctaagaatcactggcagatagaagtacgcaataatcaagctccatagaaagcaagttgcatatcagtggctaccgtgtgaagcattgctctacaagaatttcaagaggcaacggttgccagagttcaggctgctgccagcttcaatgaacttcttcagagcagaaacatcaaagccttgttgtgaacaacgagtcctcccatggcttgaacacaagcacaaatgcacccaaactaattgtgtcaacttgtttggaagcaagtgctcctccttggggaacctcacctgctcccttaaaggggggttcccttaagttccatatcttgagcaagaaaccgatgcattaaccangtgttgggcgcggcaganccttttagccacgagacattttanagaactgccaatgaatgacngacggaagtgggtcctgattgncccttaatggctttcaagacgttgagaacatcatgcacaatggcatgataa

SEQ ID NO: 81698 - DNA, 217 bp, Triticum aestivum
  unsure (1)..(217): unsure at all n locations
  Clone ID: PAT_TA_81698
ccgcanccggggagcatcgncantgcccgtgtgacataggntatggctaggatggngtctgcanatataatgtgtgttgactcaaangctgtcaangaaaagttcactggcatgataangcagcatnatgttcgtgnaactgagatcgacaaggtggatatataccagtcatatcgacctggcgatattgttagagctctggntcnctctcttggtg

SEQ ID NO: 81699 - DNA, 493 bp, Triticum aestivum
  unsure (1)..(493): unsure at all n locations
  Clone ID: PAT_TA_81699
gtctgacgctggttcacgccttccatgcgttattgagggagggagaggagagcgcatgcatcgcgtgagtaacccggagatggggatgccccgaagatccgcctccctcttcgccctcgccttcttcgccctgctgctctccacctccctggcanggagacagcggtcgagcttcatagtagatcaggagtctcctgntcaanaaangaaaaggtcaaccggggacgaaagctatggnacanctggtgnactcccggatgctcaagggtcatgacgaccagtgactacggnacctangacccaaaccccgtcaatgcagaagccccacttcaagctcatacccaattgaanacaccctngctatacntgatatgatcatctatatatcnacntcatctgaattatatcanatcaanatattgatccaagtattttancnagtcnggtaaagtgataactgatattgtagttgtngtnacgtnactgantactt

SEQ ID NO: 81700 - DNA, 626 bp, Triticum aestivum
  unsure (1)..(626): unsure at all n locations
  Clone ID: PAT_TA_81700
ctcttgttcaacttcttgtaggaaatcagaagaaggccagtgctgctgcccttaacttgatgagtgaactaacctgccttaacagaacaagccagacggtagagttcctcaaggagctgaaaagtggtggctgcttaaatacaatgcaagttctattggtgtatctccagcaggctcctcctgtccaacatccattagcagctgtcatgctacttcagcttgatctcctgggagatcctttgcagtacagcgtttaccgagaggaagcggttgatgctatcatggctgccttgggagcatagttcaagagagcgcaaaggtgcaagaacaaggcgctcganctccngttgctccctggcaagggcnggtttcaacctcgggaagaaccatagcaagaagcatggctactgaagagagcaagcgtagatggctccctgtcggnatcatttagaagaacagagatttcaaaaataagggtgcacaacggnagaagagaaggtggttgaagagcggctgaagaaactnccctcgtgctggnaaaacgggaacagcggttctcgcggngctgtcaacgtaatcgatggaaccacttggccgacttgctcgnacgtacgtggtnagantcc

SEQ ID NO: 81701 - DNA, 597 bp, Triticum aestivum
  unsure (1)..(597): unsure at all n locations
  Clone ID: PAT_TA_81701
gtttcggtgtctcatggctcgagaatggagattgcgcatgaagcacggtccggaattatggttcgtagtgctccacccacacccacaatgtggcaagattctagcaccgacaataagagatctagagggtcgagagcagaggggagaagcagcggcagcagtgccgatcaggatcccagtagcccgagatcgaagcattccgctactgagcagcgacggaggaccaagataaatgacaggcttgacatactccgagacctcctgccgaactgtgatcagaagagggataaagttctttccttctcgaggttattgaatacataaggtcttgcaagagaaatgccaaaattatgatcaaggattcctgaacaagaacaacgtcnatgcaaactgcatgcaatgggacaaagtgtactacagntaacttggggggaacacacagacnatcattcaanccaaggnggaggttananctccacagnggacatgancaagggcatacantccaagggatncaatgaactgcggttccctnaaaaanaancgaaggattanaaancctggtcnccanaaatnaagaaatngctcaacagtccg

SEQ ID NO: 81702 - DNA, 381 bp, Triticum aestivum
  unsure (1)..(381): unsure at all n locations
  Clone ID: PAT_TA_81702
gctcgccaccgtcatcatgctcgcctacctcctcaccggcggcttctacgtccacaacgtgcccatcttcatgatctgggccaagtactcctccttcacctactactgctaccgcctgctcatcgccgtgcagtacagcggccacctcgcccagctgctcccgctcgactccacgcacggcgaggccggcacctggacctgcgtcggagcctcgtcgccatgttcttcgcctacggctgctcgcgtacttcgccctgcgccgggtcaaggacgtgatcacacacacacacatctctctctctctaggggagcaagcgtcnaagnaattaacaattccggcaaggcaanagnnaggtattaagtaacggctantccnggcaa

SEQ ID NO: 81703 - DNA, 554 bp, Triticum aestivum
  unsure (1)..(554): unsure at all n locations
  Clone ID: PAT_TA_81703
nctcggcctctccgaccccggntgccaggccaccgacgacgacgatgccgcgctctactactancctagcccttccccgtttcaccctcctcgttcggctgccatggagggcgtgattggaaatttgccccctggcgaaggcaaatcggtgaaccancanagcagagccaattgccagctgatggtttctgaccgatctgcccctgcgtggatgatgtaaatagggaggtctgattgggttggtggagggtangatggggattcctccgcattttcaactgcagctcaacaattttangacctgctgtaaggctgtagtaatttctttttcttcttccntgagtgttcctgtanctagctctggtanctgcaatggagcttcttcttcctctttnttggtaaggattttgnggtcatgacanacacatcaatttagccgcaagctcgnctttgctcaagttagtganatgntaatttgcactgcganagctgtccaatnaaaaaaaaacnaanaaaantcanggggggcgggnccaattgcctangngagtcga

SEQ ID NO: 81704 - DNA, 525 bp, Triticum aestivum
  unsure (1)..(525): unsure at all n locations
  Clone ID: PAT_TA_81704
ccccaaatctcctcagcctcccgcgcatctcctccgacatggcccgcaccaagcagacggcgaggaagtccaccggcggcaaggcgccgaggaagcagctggccaccaaggccgcccgcaagtccgccccggccacaggcggcgtcaagaagccccaccgcttccgccccggcaccgtcgccctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaggcctacctggtgggcctcttcgaggacaccaacctctgcgccatccacgccaagcgcgtcancatcatgccaaggacatccagctcgcccgccgcatccgtggagaaagggctaagctctgttcgtcgtcntctgttatcgcctcttanctgatgtgtcacnggtgggaattgcgtgcantgtttgtnctgtc

SEQ ID NO: 81705 - DNA, 322 bp, Triticum aestivum
  Clone ID: PAT_TA_81705
cgaccatagaggctaatacaatatatggagctattcgcggactagaggtatgacaatggtttgcagaatttgagattcgaaggacccccatttgtatatatctatgttaatagccctgctgcttgtacacctgttttaccatctttgaagggctagttagagctcatagaatctcctgtgttagaatattggtcataagcactcacttgaagatgcctttggtctgatttgtccattcactaaccagcattacgatttccccccttgttgaattatttgacagacattcagtcagttatgtgtgttaactacgacacaaaaa

SEQ ID NO: 81706 - DNA, 632 bp, Triticum aestivum
  unsure (1)..(632): unsure at all n locations
  Clone ID: PAT_TA_81706
ccgcccagcccaaacccaaccccgccgccgcactgccgtcgccgccgcagcgcgcggaggcgaccaccccaccgccgcgaagatgcagatcttcgtgaagaccctgacgggcaagaccatcacgctggaggtggagtcgtcggacaccatcgacaacgtcaaggccaagatccaggacaaggagggcatcccgccggaccagcagcgcctcatcttcgccggcaagcagctcgaggacggccgcaccctcgccgactacaacatccagaaggagtccaccctgcacctgggtgctccgcctccgcggtgggcgccaagaagcgcaagaagaagacctacaccaagcccaagaagcaaaagcacaagcacaagaaggtgaactcgccgtcctccaattctacaaggtcgacgacgccaccgggaaagtcacaagntcaagaaggagtgcccaacgccgagncggtgccgggactcatggcaacactcgacgtactacggggcaatgcggctgacatantcacacagaggtaaagngnttcgttgtggtcttactacaggtagatataatggcctgttgattgaactaacctgggatagtncanatatntcctgtgcnaatttcngntaaaaaa

SEQ ID NO: 81707 - DNA, 182 bp, Triticum aestivum
  Clone ID: PAT_TA_81707
gtgaagctcgtgttctccagcaagctcaacggcaagaacatcatggacgccatgaagatcaattgatactttggtagcaatactgtcatggtcatcgactcatcgttgtggtgtctactaaagtctgttgatgtcttaatgatgattgaattgaggcccgattgacagttaaaaaaaaaaaa

SEQ ID NO: 81708 - DNA, 570 bp, Triticum aestivum
  unsure (1)..(570): unsure at all n locations
  Clone ID: PAT_TA_81708
tatgcctgaagtttatgctaggattccatcggtttgccctgcattgattgctggaccagtgtggcgaaagggagaagatgacaaggatgaggaagaggaagacgatgaagaagaagacgaggatgaagggcacgaacagtggctgcaccttgactctccatcgagggatggatgctcaggaggccctgtgatgtgcgcgcgtggtgtcattggagtcgttgctcaggctgccctacagattactgcgtccgttagcactgaatcagtacatgaagtgctgaaacggtggctcggcattcattggaggatgacaggagtgtgcangcgatcatcgatacattactgtgatcgcgccttgacgctgctactcgctgtggatcaggctgtgaattgtgaactttgacatgtcgccttttaagggcataccgtgtcattttgtcccaagagaaccagaagaanaatgtcgttangtaaaactgtgactttggngtaatttncaaanccaanccaacaatagtccataatagtcctgnggccaagtacaagttccanccggttcctncgtactaa

SEQ ID NO: 81709 - DNA, 647 bp, Triticum aestivum
  unsure (1)..(647): unsure at all n locations
  Clone ID: PAT_TA_81709
tgaacaccgatgttgcccgtgcaaagccagtagactatgcaaaagatacaatgtcgggtgcttcagcagagaatacccaagcaagtgaacgtagttccaccgatgaagaaatgaccgagcagcaggacggtggtaccagaattgaagggggcactcaagacttagagtgcaccagtccagaaaggacaatagagaaaatcggatctgattctcatggtgaccacactgcaacagctcctgagcaagagaccgagcaagttctggagactgaaagccaaatcggtaatgttggctgcaatgatcataattccattaacagcgttatggggggagagactttgcagctagaggatgaaatgcaggcacaacaagaaaccgaggaatctaacttgattccaaaagagggagggcggccactagttaatgaggaacagaatccctaancctcaaagatggattggtcagtgtctgaaggaaacatgaggngacgntctcnanaaactgacacaccaggtggactatcganactgattgtgcccaaattccgtactggcatggaaaagcctctcatgggaatanccctgtgncgaaactgggggccctaggncntttncaggaaaanaaangtccncattggancgngccng

SEQ ID NO: 81710 - DNA, 651 bp, Triticum aestivum
  unsure (1)..(651): unsure at all n locations
  Clone ID: PAT_TA_81710
accgccccaatcagattggacggcgagaattttcgtatcgaattgacgttcaacaagtgcttgaaaattttgaaaaacttggaaaatgtcagaacgttttttgagaagataaatccaagtgtacttactaaaatcatctatgaaactaacatagtaagtatgacgtccaacagacataggggcaggaccccaaacatcagaaaagacaagttgtaatggtctagtagaaacactagtagaaattggatatggtagctgatgagattttgctttctgacaagaatcacatatagtttcangactacgctcaccancacatgggagctgattatttctaagcacttgctgaacgataacaaaagatggatgtcctaatcttgcatgccaccgctccgaagagagttgatgacaccaaaaacttgtttattgaancttgaaaattggggattaatggatagagccatgcacgatctacctcgtanaaaagtccncggactgatccnaatcaaaanaaatagggtgaatccananacttgntgcaagggaatacataaaaaanangtttttccgtttgnaaancaaatttcaaaaggtatgccanggttgnatgatgccatggtacccaactcaatcatgggattttggnaggnn

SEQ ID NO: 81711 - DNA, 605 bp, Triticum aestivum
  unsure (1)..(605): unsure at all n locations
  Clone ID: PAT_TA_81711
cattccaattttcgagcaggtaatcaacagcgcacgactaacaggacagaacaaatcttaataacaactcgaagcacgactagactagactaacagggcagaacagatccgtcggcgggatcaaccgagaaggaaccgtggcggcgggcgggaggcagagagacctaggcgcgctccccacggatgcggcgggcgagctggatgtccttggggcatgatggtgacgcgcttggcgtggatggcgcagaggttggtgtcctcgaacaggcccaccaggtatgcctcggcggctcctgcagcgccgacacggcggagctctggaaccggaggtccgtcttgaagtcctgcgcgatctccccgcacaaggcgctggaangggacttgcngatgagcactccgtgctcntctgggnacttgcggatctccgcancgcaacgtgcccgggccnaaacggtgcggttctcaagccgcggtggcggcgccgacttcggggggcccggtaccattcgcctatagganctatagcgcgtcatggcctcgttaaactccngacnggaaacctgggtaccaataacccctgagaaacccttccantgggtatacaa

SEQ ID NO: 81712 - DNA, 656 bp, Triticum aestivum
  unsure (1)..(656): unsure at all n locations
  Clone ID: PAT_TA_81712
ctagtctcagttttttttttttttttttttttttttttttatcttctttaagcattcatgaacatatacaggtaacaactcatttaaaacacaccctacaccccggtattccttaaaaaaaacatttccttcaaaagaaacaccccgtatatattgactctctgcacagttaattcttttcagatatatctcccgtccaacatggtgtgtaggggaaaacacttcctacacactgtacacgtaactgggcccaagtcttgtactttcaatctactgaaatcataagcaactaccctcgcttgtgttcgtaggaagacaactctttgtatggatgaaatccaaaggaaataaanactcccaaattcatatcgtcaagattcaaccttatcttcaagccacaaaggataataccattgncgaancccatcatagttaccttgcacggggctccttaaatttcancaaaatcactttctggtaggtccacgncctgggtttaacnnnagaaacanggaatttgcaacggcggcgggagtnntgcatcttggaccatccaantncantgatangaagcaccaatctgagtcccccaggatcatngtnacaaggnancacccctcctgntccnnaaagatggggactcattctccgngggg

SEQ ID NO: 81713 - DNA, 431 bp, Triticum aestivum
  unsure (1)..(431): unsure at all n locations
  Clone ID: PAT_TA_81713
aacatccccaacaccggcgccatggcccgcaccaaacagacggcgaggaagtccaccggcggcaaggcgccgaggaagcagctggcgaccaaggccgcccgcaagtccgccccggccaccggcggcgtcaagaagccccaccgcttccgccccggcaccgtcgcgctccgcgagatccgcaagtaccagaagagcaccgagctgctcatccgcaagtccccttccagcgcctcgtccgggagatcgcccaggacttcaagaccgacctccgcttccaatcctccgccgtctccggcctgcaggaggcgccgaggctactggtggggctgttcnnaggacaccaactctgcgccatccacgccaaacgcgtcacatcatgcccaaagacatccaantcgcccgccgatccggtggcnaaagggctaagcccc

SEQ ID NO: 81714 - DNA, 593 bp, Triticum aestivum
  unsure (1)..(593): unsure at all n locations
  Clone ID: PAT_TA_81714
ttacataagcgtgatctagtacacatttttttatcattccatgaaaccatcatttttgcatctttttcatctatactcatttttctactttaattgccatccaactttacttcccccgagttgattccttccgttggactttgttctgcgtcagcaatctctttgaaacagttaatttcttcaattcaaggagttatgttcctcaaaatcaagtcaacaagttaacatcaaatctggcaatcaacatgggcacccttttgaagtcttctggatccatatacaagaatgtcgagaaattgagtgcatttcgcctgagaactaccccagcagancaacctccacaattgtgcactctatgctattatgtacatggatatctgggatgggaagaacatgnagaacattgacgatgaaattatcctcanttctgggaggtgncanttacannctcggaaaagtctgacatcaaggaagatccttcaggaggtnaagangtgttcancncgangagaantgtgcnntactaagttacaagaaatgntaacgcacaagtgnacgttcacaacgagngtgcttanaggtatgcactgaac

SEQ ID NO: 81715 - DNA, 422 bp, Triticum aestivum
  unsure (1)..(422): unsure at all n locations
  Clone ID: PAT_TA_81715
gcatggcgtcctgttgcgcctcgttgaatgccaggacccgcgcggagcgacgtctgacctcgtgacggaggaccgcttcggctccgtagaccaggaagaacggggtctccctagtcggcttggtcgcggttgtgcggatggaccacaacatggactgaagtccgtccgtaccaacctctgccgcaaggctccagttcttcttgaacgtcctggtcttgaggcccccnaggacctcccgcattggtcgctccggctggccgttgctttcgggggtgcgcactaaagcgtnatacatatttttgaanaagttactgggtgaactgccaactgttgcctgtgatngatccattccggaccttgaaccggtcaaacatccctntnataacttnacnnggggacccccnagaatggggngggnaact

SEQ ID NO: 81716 - DNA, 257 bp, Triticum aestivum
  unsure (1)..(257): unsure at all n locations
  Clone ID: PAT_TA_81716
cttgatctttcctcctcaagtcctcactccttccaactcaatacagagattagtttccgaagcagatatggcttttgctctaagatcaataagcttgccttcaaggcatcacaccactgaggcggaagtacaagaagatctgcacagcctagagacaagtgtctcttcatccatcaccatcgnagacgatgtgtgatggcctgcgggnggtttggganantccnaaaggtgttntngnggagatcccnaagtgccaa

SEQ ID NO: 81717 - DNA, 328 bp, Triticum aestivum
  unsure (1)..(328): unsure at all n locations
  Clone ID: PAT_TA_81717
cacagggaccttaaagctaataatattcttctcgacgaggagatggatcctaaaatcgcagactttggattggcaaggctgctacaagaaggtcacactcatactcaaacaactagagctgccggaacactcggttatatggcaccggagtacgcggtacacggaagtgtgtcacccaagatcgatattttcagttttgggtgtactagccctgggaatttataaccaggngaaggaatgcatttcgggttaatggggnataccgtgaccccnattangnggtgngtgatttccnnggnacaaangggcaatatccaaatntgtgggg

SEQ ID NO: 81718 - DNA, 414 bp, Triticum aestivum
  unsure (1)..(414): unsure at all n locations
  Clone ID: PAT_TA_81718
gtagctttccgatgatattcttcaccgattgaagaggaattgacatggnttgccgactagtccgcgtttcatgttattcgcactgtgcatactacaagcacatgctagttataacaggataatagtagcatctagtcatacttgcatgcttattaatcgtgatgtgaaatttctgaacctgctggtgctgcttcttggcaccaagatgctgatcactaaatanagagcgtgctaaactgacatacatacgataaaatgccggaaaggagatttgttgagcctgtgatggtaaaaccttgttgtccgggtaaggatgccatgtccaaggtngtgaacctgtatcccttaaccaagttnnaagcgccatnttantggnaanatttacntgncggnttctcaanattcttcggggat

SEQ ID NO: 81719 - DNA, 429 bp, Triticum aestivum
  unsure (1)..(429): unsure at all n locations
  Clone ID: PAT_TA_81719
agagccccaagcagacagagcgtgtcagctgcgagaacatcccggtgcaagtcgcggagccggaaacgatcgcgccgccgtcaccgccgacgccgaggctgagcgcggcggcgatgagcccgatgttccagggcgcgttctgccgcgacatggcggtggtcgggacgctgctgtcccgccggccggttcgaccggccgcccatggcggtcaagtgcgaggcgatgagctgctgatcagccgtcaacgtcaaccatcccggcgatgccgcgacggaaacaacagcaccaggcaagcagcgggaaaacagagaggaattcaaagattcatatcnaaacccaacattcngaggactgggaggaccggtgaaaccccgggtgccggcnatcccntggnacagtgtanatctgaaaggcnntttccattgggaa

SEQ ID NO: 81720 - DNA, 271 bp, Triticum aestivum
  unsure (1)..(271): unsure at all n locations
  Clone ID: PAT_TA_81720
agcacacaaccctctccacccccagcaatccatccatccaccccacccncacccccctttcccctctcctcaccngnggtttctctccttgnggtcggtataggtacttgcttcatcagganctgtnatctangatgactgnatgctgaagttcgnggagntcangtccangaggangcaccgcttcantggnctacangctgnaganagnagatngaggtcattgatgttatgcntganggagtgtagagggcagcctangnttgtttca

SEQ ID NO: 81721 - DNA, 601 bp, Triticum aestivum
  unsure (1)..(601): unsure at all n locations
  Clone ID: PAT_TA_81721
gtttgatggtgctctgaatgttgatgtgaacgagtttcagaccaacctggtgccctacccgaggatccacttcatgctttcctcctatgccccagtgatctcagctgagaaggcttaccatgagcagctctctgtcgctgagatcaccaacagcgccttcgagccttcctccatgatggccaagtgtgacccccgccacggcaagtacatgggcctgctgcctcatgtaccgtggtgatgttgtgcccaaggatgtcaacgctgctgtggccaccatcaaagacgaagcgcaccatccatttgtggactgggtgccccactgggttcaaagtgtggtatcaaactaccaaccacccaagcgtcntcccnaagcggcgactcgccaaaggccaanaagggcctgtgcatgnttcccaatccaacaacgttgtcgaggcttctcccggancgacanaaatncgactgaagtagctagctgcttctccactggactgggtnaggaaggnggaggtaatctctaagccnttaggattgctgccngnaaagctanaaaaatngnctattcacaggcaagacgnataggggatggtcaanaattatt

SEQ ID NO: 81722 - DNA, 195 bp, Triticum aestivum
  unsure (1)..(195): unsure at all n locations
  Clone ID: PAT_TA_81722
ccaaagcgcangnaaagaggngaggaatgctggncatctctgccccttttctttggnctttgcccgcngnaggcgtacgttcancattgnnggcagtgctgtngccggncggctgtgcncctttctgcagccttggctcatggngganatctttggttanccgctantagtctctgtnantatgcttttactgta

SEQ ID NO: 81723 - DNA, 590 bp, Triticum aestivum
  unsure (1)..(590): unsure at all n locations
  Clone ID: PAT_TA_81723
tttgcaatttgtgtcgtcttggggaaggattgggcaccgacttcttccactgcatgaaatgcaactgttgcctcggcttgaaactgaaagaacacaaatgtcgggagaagatgctcgagatgaattgtccaatctgttgcgacttcctattcacgtcgagtgcagcagttagaggtcttccatgtgggcatttcatgcattcaagcatgctttcaggcatacacttgcagtcactatacctgtccaatctgcagcaatccttggggagnatatgacgggtctttggnatgctcgacgcttgctggctgcgggaagacttcctgaggaataccgggaaccggtgccangntatactccggtancnactgcggaagaaaggntttccccggtccaactggctgtatcacaaaatgcggcgcctgcggtcgtacaacaccagagtttcaaagaccgaggacaagntgtccaacgccgaattaacaagcgatcctttcngttcctctccgcccatctttgggaatcccccgggnacatncctataaggngacatgcatnntaacccngtctaaaaancantcgnganaaaaaaa

SEQ ID NO: 81724 - DNA, 645 bp, Triticum aestivum
  unsure (1)..(645): unsure at all n locations
  Clone ID: PAT_TA_81724
ctccttaggttaggttaggctaggggcttcacagagctcgcggaaatggtggccttcaggttccatcagtaccaggtggtgggtcgtgcgctgccgacgcccggcgatgagcagccgaagatctaccgcatgaagctctgggccaccaatgaggtccgcgccaagagcaagttctgggtatttcctgaggaagctgaagaaggtgaagaagagcaacggccaagatgctccgccatcaacgagatctttggagaagaaccaaccacgatcaaagaactatggcatttgggctgcgttaccaagagcaagactgggtaccacaacatgtacaaggagtaccgtgacaccacactaaatgggtgccgttgggagcaaatgtacactgagatggctctccccaaccggtgtgaatccccctgcattcagttaaccaagacgcgacgtcaactttaagctatgcaagagagacacacaagcantccaaatccaaagtnaatcccccttgggacaaaagncangcacaacaagaactgaacactaaaggaacaggcgactgtnagtattgacntggggtcgtaaatgatgttctcaagttgnttcgagagannaanttgtgctattacgtaaaaggtnggncctcnattt

SEQ ID NO: 81725 - DNA, 500 bp, Triticum aestivum
  unsure (1)..(500): unsure at all n locations
  Clone ID: PAT_TA_81725
cgacggcggcggcatgggcgacgaccacggcgccatgcacccgctcgaccaggccttctgccgccccatgggctcccagcagcagcacttcctcagcgacgccgccgcctctcaggttggggccttctggcaggatctgcagagcgtggttcagatggacatggggcagagccaggagatcgccacctcctccaacagctacgacggctcgttgcagacggtccacatgaaaatggagctttgacatgatgatcgccggggagaaagcttgatccgactaccaccggaccgccctcgacgacccccgctgttcatanggggagangcaaaggcaggcaggcagcatcaaagcttgcaattgnaccatcatggnaacgntctgngatcagctacagtgttgggccttccgngggaangntcctttggaaaataaaggaccgggcgngaaaagtacttagtagctancntatctcatatcacatcatcatcacnccttctgg

SEQ ID NO: 81726 - DNA, 644 bp, Triticum aestivum
  unsure (1)..(644): unsure at all n locations
  Clone ID: PAT_TA_81726
tttgtgattgattaaattttcgagcaccatactcccatgatgtaggtctaccgtattccattgctggactatgccttctaccggcagccccagaacaaatctcaagtctcatacttgttcctattttttgcaggatgcagcaaaaagcaagattcacaagttcatcttctggatgcttttcagtacatctacttcccgttgtgcaaatgtggagggccggtaagttctactaccagtctacgccaagttcaggggcattgccactaatggaaaggacaatgaaccaacgacgtcggatcataggtcgaaggaggccgggtcaaggcaccatgactggttgttgttgtatcttagtgtcgtgcttgttgatgtgttgactagcagatcaatatatatgcatgttgtttgcttttgacatggtaaaaataactattggnacaaattccagttctatatgacaaagtcattgagaaaaaatcattcaatggatacttgtacngttacaataacttgcnaaagantaaangtcttccttcgggaatacagngatatcattctttgggcaanaacacataccatagggtgaggggantcttattccgaacggagnacttgtgaaacctgnaacaaaatttttnggggag

SEQ ID NO: 81727 - DNA, 381 bp, Triticum aestivum
  unsure (1)..(381): unsure at all n locations
  Clone ID: PAT_TA_81727
gtacatgggcaacggcggcggcgccaactcggtggcgccggggtacaccaagggggacggcctcggggcggagatcgtggggacctttgtgctcgtgtacaccgtcttctccgccaccgacgccaagcgcagcgccagagactcccacgtccccatcttggcgccgctgccgatcgggttcgcggtgttcctggngnacctggcgaacattcccataacggggaacgggaataaaccgggngggttccctcgggggcgggaaatantctaaanaanaaanaatcnggggacaacaagggttntncgggggngcccntttaaacgggggnggttttgggggaanatnnaaaagnggggggntnaaaggggcnccccttaaaa

SEQ ID NO: 81728 - DNA, 620 bp, Triticum aestivum
  unsure (1)..(620): unsure at all n locations
  Clone ID: PAT_TA_81728
cggaaccaacgaatccccagccaatctcgtctccgatcgaccccaggctcgtcgaatcctcctcccccgccgcctcaagatgcagatctttgtgaagaccctcaccggcaagaccatcaccctcgaggttgagagctccgacaccatcgacaacgtcaaggccaagatccaggacaaggagggcattcccccggaccagcagcgccttatctttgctgggcaagcagctggaggatggccgcaccctttgctgactacaacatcccagaaggagccaccctccacctttgtcctgcggctgcgttggtggcatgcagtcttcngtcnaagaccctcaactgggcaagaccatcaccttgaggntngagagtcccgacaccattgacaacgtcaaaggcaaagttcnaggacaaggaggnattcctcccgggacaagcangctcacnttggctggcaagaactggaggatggtcgacctcggctgatacaaatcaagagnnccacctcaacttgcctgntccgctgggggatnanttccggaaactaacggaagacgtanattagngatctcgaacatnaaattcaggaagtcagnagggggatcccggcaaagcttnttn

SEQ ID NO: 81729 - DNA, 300 bp, Triticum aestivum
  unsure (1)..(300): unsure at all n locations
  Clone ID: PAT_TA_81729
ctcgtgttctcgtggaaagggctggaggtgttcgacgggagcaactcagtgtggcacacacacgacacggagtcggacgacaacaacttcctcaagaccctgcagctggttgacgagggtgacatgcgcatcctcgacaagggcggcgagctcgcgtggaaggctagcgacgagccgcgcgcgggcgcaacactgcgggatgcccgggctcgcccgggctggtctccggnaatgccgcccttcngcgggagccgggctggggatgggaagcagaacntgcaattttggncaaggaaccaa

SEQ ID NO: 81730 - DNA, 568 bp, Triticum aestivum
  unsure (1)..(568): unsure at all n locations
  Clone ID: PAT_TA_81730
gtattagcacccttggatcagtcgtcgtgcaagggtcggctatccaagtgtcgtccataaagtagtttcgttaatttagtactcctttcgtttctaaatataagaccttttaaaagtttcacaatgaactacacacgaaacaaaatgaatgaatatacactctaaaatatgtctgtatacatcaattttagaaatggatgtctatatacatcaatatatagtccgtattgaaatctctaaaagatcttatatttaaaaacagaggaagaactagtatacacgtatcattttcaccgacatcctctagatgagcagctcaaaagcttgcatctgtgacaacgagaaatacttccaatatggagagagagatggtcatggatgtggacgatcctcttctccntcttgtttatttactgcatggccggcgccttcatacgtaacgtacagtttattcctcaaggtacccatgcnggcttcttnactttcangtaaagggttccttgacttgngccnacattnggnaaagcaaaaaggggtgatnccccggtaacaagaantttcancgnan

SEQ ID NO: 81731 - DNA, 610 bp, Triticum aestivum
  unsure (1)..(610): unsure at all n locations
  Clone ID: PAT_TA_81731
ggacatcaggagtgggaactgggctcgcaggttcagcggcgtcgcccagatcaaacagctagattggagcctgagttatggatttcacaagagcgtgcttatctggcatatagcaacaagcaccttcctcaataaccctgccgccaaattggagctggtcgacaaggacatggctgaagcagtcaatactctctctgattacatgatgtacctcctcatccgagcaccctggacattctgccaatgaaaccagctgctaaggacatgtttcaaggaaacctgcctcctgttatgggtccggatatggtatggcccgggnctatgtnatgaaaccaagtgggggacaagagctaagtggntgatttccacaagcaattcctgatttacactcccggtgtcttgaagtgggtaagaaactaatgctgactttatggaaatggtgggatgattacccgggcaagnatgtctggggaaanatgcacctggtcaaanatgtcganaggacttggggtcnaaataaagggatatgggaantgtggcgaattttgcnccagaacatgaaccgggggatcatcaggaantacaacgggganttcgccaancggcccaa

SEQ ID NO: 81732 - DNA, 493 bp, Triticum aestivum
  unsure (1)..(493): unsure at all n locations
  Clone ID: PAT_TA_81732
agcgcgtcggctccggcgcccccgtctacctcgccgccgtcctcgagtacctcgccgccgaggtgctggagctcgccggcaacgcggccaaggataacaagaagacccgcatcatcccgcgccacctgctgctcgccgtccgcaacgaccaggagctcggcaggctgctcgccggcgtgaccatcgcccacggcggcgtgatccccaacatcaactccgtgctgctccccaaagaatcccccgccgccgccggagaaggaggccaatcgcccaaagaagaagagcaccaccaatccccaaaagaagaaggtcgccgccaaaggataccgtccccatagcctancagtgttgcttagattcaattctcaatggactaagatgagatcctgtatgtatgcctgggtatctgtagtcccgtcagatcctcnanaagtttgaatttgtaccngtatttcngtgacatgtcaaagatnatcattcatcctggtatgcg

SEQ ID NO: 81733 - DNA, 162 bp, Triticum aestivum
  unsure (1)..(162): unsure at all n locations
  Clone ID: PAT_TA_81733
cctgcttccgagggaagatgagcaccaaggaggtggacgagcagatgctcaacgtccagaacaaganctcgtccgtacttttgtggagnggtttcccaaaaaanttaanttcaannttttgcaaantnnccccaagggggttgaaanngggggcaactttcg

SEQ ID NO: 81734 - DNA, 505 bp, Triticum aestivum
  unsure (1)..(505): unsure at all n locations
  Clone ID: PAT_TA_81734
gcccatcgccatcggcttcatcgtgggcgccaacatcctggtgggcggcgccttctccggcgcgtccatgaaccccgccgtctccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactgagcagcgagctcagcgcagccagcctgcttgcttgcgtgcaagccgccgcctgcctgcccgtccgtccgtgtgatctatgatcgcgtcgtctccttccttgccatcaccatgatcntttaatttgcttcctgggcnatcatttgtggtgattccctggactgtaaacgttggacacactgtcatttctnccggtaaaatggtgatcnccgcccgcccgataattcaantgnttgattcnacaaanaaaaaaaagggggccggnccaatncccca

SEQ ID NO: 81735 - DNA, 627 bp, Triticum aestivum
  unsure (1)..(627): unsure at all n locations
  Clone ID: PAT_TA_81735
gctttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaaccctttggccaggtgccagctttgcaggatgggtgacttggtactcttcgaatcacgtgctatttgcaagtatgcntgccgcaaagaacaancagactgttgaaggagggcgacacaaaggancagcatgggtggatgtgtggtccnaggtgggagccatcaagtacaccgccgtcctgaccccattctcttcgnatgccttaccaccctatgcttgggggaccactgaccanaagcattgacgacacttgttaagnnaagaactgctggnangtacnagcgacttaacaatccaatactggtggaancctaatctgcggcttacattgtctgtaccttgntggggtaaacctagatctnttcaccgtcccattaagcctgngatnctttgnagcctctcaaggcctcctaaaaatnt

SEQ ID NO: 81736 - DNA, 202 bp, Triticum aestivum
  Clone ID: PAT_TA_81736
ctggaccgaggtagctgtctggggggatggggattggttgttgctagctagtagtagtttcatagtgagtagtataagatgttcagttttagacaacgagtgaacgagatgtgtagcttctgatcaagcctttatttcccttagaaaaatgtaaagaaaatttgttggcttctcttttatgggaaggatcaaaaaaaaaaaa

SEQ ID NO: 81737 - DNA, 538 bp, Triticum aestivum
  unsure (1)..(538): unsure at all n locations
  Clone ID: PAT_TA_81737
gcgcattggcggattggagggcccagggtttgttgctgggggcattcagcttgttgtgatctacgtggatttcaagttggacaagagctacacaccgagcaagatctccattggggcgggcgacgggttccacaatctcaagagaatcattcattcacacatctatgctccgaatcgtggtgttggccaatcacctgaacgggagggacacccatgtcctacagaccaagatatgcgggccatgaccttatatatgcagatcactttgggtttgctaccaaggtcaatttgcaattgctctgcacacattgctgattgcgtgccaacgcaactatgcnggtgaggcatatatggccgggaacaagcgcaactctncanataagactacgatccttacctaggatacttacccaatgcaantatggtcaagatattttgnttccatccttggtttgaccanncncaatggggtnaccccnaaanttcnctaaancacaancnttttggtnacccgtctcggggnattccccanaaggaa

SEQ ID NO: 81738 - DNA, 319 bp, Triticum aestivum
  unsure (1)..(319): unsure at all n locations
  Clone ID: PAT_TA_81738
gttctttggccccaaacatccaaggctaccagacattatattgctgcaaccatccgggactcatatactcttcaaaggttcctaattattacagtattattttagttttacacataataaagatagctatgttcttgcgtactatcattgatgtatcatcttgtcagccttctcttctttccttgtaacaccatttggtacgcaatcttgaatgtcaaatggaaattgagatcatcgatcagtaatttgattgcccttatttagatggaaatttagaccatcgaccagtacanaaanacaaaaaaaanccnaggggggg

SEQ ID NO: 81739 - DNA, 638 bp, Triticum aestivum
  unsure (1)..(638): unsure at all n locations
  Clone ID: PAT_TA_81739
tttcaatgctactaaatctgggaaaagctcattggtattcaagggattaaataatataaacaatgagttccaaaggcgtagagagaatgtagtcccaccatctgcaagatctcaacagccattggtgatgaaaaactggtctgcttgcaatgacatttccaacaagcaatacaatgttgctgatgggtcagttcctcggagaaatgccactgacaatgcatcgtcatctcagttggcgttgtcaactgcaaagcattacaattccaatgttagagagctaaacgatagagtgtatgcagcacctgctcgtaantatgacaacaggatanttggtacctcnggctatgggcaaagcatcgactgggagagtgccttgacaaatnacaagtgccacctgggccttattatgacaagatgctggtactcctctangaatgcagcttctacatctggaatcgggaaatcgcagagaagacctcataatgatccgggaaaaggccatcaatcagattgaggggacttccaaaatgccaagnttntccnaaanggatacacaaggaatgtggatatncacaatgttcacccgtcaagaaagccnctgnaatctggnagcaggaaannaaantttccaccagtgg

SEQ ID NO: 81740 - DNA, 152 bp, Triticum aestivum
  unsure (1)..(152): unsure at all n locations
  Clone ID: PAT_TA_81740
atcaanttcccccttgtgtancaaaaggncaggccancaaccaggaagctgaagaccacctanaaggcgacaaggccgaacctgttcatgtgattgggcngtggtggatgctggnatttttgttgggcagnagcananaagttgaaatgttc

SEQ ID NO: 81741 - DNA, 629 bp, Triticum aestivum
  unsure (1)..(629): unsure at all n locations
  Clone ID: PAT_TA_81741
aaccagtcaagctctcattgccgacttgctatcccatcgtccaggtggctgccacgtcagttccccgtctctacggtgctgccagccactgccattccattgccttggatttggttgtggcgtgggctgggaaccgtaaggcgttgtctgatgtgtcgtccacactgggaggtttggtcagtgagcagctcctgagactgagactagtcatagtgggagtaacttaggttttagttcaacaaattgaactaaaaccacggcagtaattatggaacggagggagtagtaacatgcatgccacataggcaaaaaagattatgtgacaagtaattaaagaggatggatggatggatgtgtgcatgcctgtaatgggatatcatggatgcgacaagttacttaccactacgacaacctgatggatggatgatgtatgcatgctacgtgtgatgaagaatggagtcttacaagggcatgatgatgacgtggtgaataacattctnagcaataagcancttggccaagggtacaaatnaananaccttactcctncaccgtcaatcacgcaagtggngtctcccttgcggcatcgtaatgtacagcagtcttancnatggnatttcacaggattg

SEQ ID NO: 81742 - DNA, 637 bp, Triticum aestivum
  unsure (1)..(637): unsure at all n locations
  Clone ID: PAT_TA_81742
gcaccgcccggacacaggcaccgccggtcctccacactgcaggaggtttgtctcctgcgttgtgtcagatgcaacatgtactgaagccgcaggacacccttgaacagcgggatctgccgcctcccttggacttcgccggcaaggcgtgatccgtcgtcgccacccactcctcccatgggaggatgcggctgctatcatcaacctccgctccatgggcgtgctcccaaattcaatatgttagatttgcagagactgatgttgcatgacgcaagaagaaacatgtggttctgttgcgaatcaccgcagcgatgcagtgccatggaagctggagaattttatctactatacttgttcgttgcctgcatcatattgcagtccaaagtccacataaggaatttaaataatacataatcattggcgtgtactctgtcataagatgttgcttacattttgggcgcacaagttttactganaagnaattgttggncagtngagtcaaagaggccttcaccnaggtgtgtcaaaatcagcaagngctcgggggtaacggtggtcctaataccncncatcgggtcactacaacccagcatgganaaacaccgangttccggttacgctgnaaacnggctttgaatta

SEQ ID NO: 81743 - DNA, 641 bp, Triticum aestivum
  unsure (1)..(641): unsure at all n locations
  Clone ID: PAT_TA_81743
aagcagctcgccaccaaggcggcgaggaagtcggcgccgaccacgggcggagtgaagaagccccaccgctacaggccgggcaccgtggccctccgggagatccgcaagtaccagaagagcacggagctgctgatccgcaagctgcccttccagcgcctggtccgcgagatcgcgcaggacttcaagacggacctccgcttccagtcccacgccgtgctggccctccaggaggccgccgaggcgtacctcgtgggactcttcgaggacaccaacctgtgcgccatccacgccaagcgcgtcaccatcatgcccaaggacatccagctcgcccgccgcatccgcggggancgcgcctaaacgagcgaagccaatccagcccctgccgccgtcgtcgccgcattcggcaatcgggggngcatcnaacgttgccaacatttgtntanttgattanctcccttgtcgaatatgcatcttgtggtnntgtanaaaacatgttggttggtacgttagtaanaaggtctgcctgctaattgtttggttcggngatcaaacgtctacgtganaaatgtggtaanaaacgttatnanaaaaagggggccggtaccatngcnaaatagtcttanccgtanggntngttaang

SEQ ID NO: 81744 - DNA, 552 bp, Triticum aestivum
  unsure (1)..(552): unsure at all n locations
  Clone ID: PAT_TA_81744
ccgcttccacgccaccatctccgcgcacaaggccacctccagctggctgcaaatcctatccaaccagcgcatcaacgacagcctcgtgctcaagttcgtgccgcatgccgcgcacccgccgctccctcgcgacctcctaaggttcagtgctaatgttctccgacatttggaattgcattgctgttgccttgaccctcaacttggagtaaccctgcctttgcatagcctgcattatctacacttgtccaatgtggtgattcccgagacatcgttgcactctaagatcgccggctgtctagccctgcggaagctacagctcttcanagtccataanctttngncggctcgtcccttgctcaacgtaatctcgtccnangtgtaatcaaggcacacgtccacttnaaaaggctctttnaacgggacacctaacctgaaagcattgtgctcctatatgcnggcatatggnggntattccgaatcttgtaaagagccctctcccaangccggaaggtgtcnaaactncaaggngatcnccaacttnggntaccccaa

SEQ ID NO: 81745 - DNA, 163 bp, Triticum aestivum
  Clone ID: PAT_TA_81745
aagaatagaatggtcttgcatctttgctgtatcaatgacatgtgggaccacgtgccatggtgatgttagctatgtgccggggaactcgtagtgcggagcagcaacgttcagttccgtaaaccgtaatatagctttgagcgagtaatctgttaaaaaaaaaaaa

SEQ ID NO: 81746 - DNA, 632 bp, Triticum aestivum
  unsure (1)..(632): unsure at all n locations
  Clone ID: PAT_TA_81746
gcccagcccaaacccaaccccgccgccgcactgccgtcgccgccgcagcgcgcggaggcgaccaccccaccgccgcgaagatgcagatcttcgtgaagaccctgacgggcaagaccatcacgctggaggtggagtcgtcggacaccatcgacaacgtcaaggccaagatccaggacaaggagggcatccccgcccggaccagcagcgcctcatcttccgccggcaagcagtccgaggacggccgcaccctccgccgactacaacatccaagaagganccaccctgcactgggtgtccgctcccgccggtggcgccaaagaangcaagaagaaacctacaccaanccaaagaanaaaanacaanacaagaagtgactcgcctcctccaattctacaagtcnacgagccaccggnaagtcacaagtcaaggaaggangcccaacccgatgcgngccggacttcatggcaacattgaccncatacgcggaangcgctgaattttaaacaagaggtaaagnggntcgttgtcngncttactacaggaagaanataattncctgttgattgaaatgaancntggtatantaccaaaattatctgtcnaagcatcagcttantttgntctaaaaaaaa

SEQ ID NO: 81747 - DNA, 631 bp, Triticum aestivum
  unsure (1)..(631): unsure at all n locations
  Clone ID: PAT_TA_81747
cgagaccgtctccgtcgtcgccggctcctatggctacatcgcgccggagtacgggtacactctgaaggttgaccagaagagcgacatctacagcttcggagtggtgctcatggagctgctcacggggcggcggcccatcgagccggagtacggcgagagcaacatcgacatcgtcgggtggatcagggagcggctgcgcaccaacaccggcgtggaggagctgctccgacgccggcgtccggggggcgcgtccgacacgtccgggaggagatgctgctgggtgctgcggtncgcggcctgtgcacggcaanccccccaaggacaggccgaccatgccgacgtgggtgaccatctcnccggaggcaaccccccccggaagacacacncaccgttngncccacgtcgtcnacaagacancgttttaacactcgccgntccgntactggnattaattactgttanaactaccggagtccgaactgacaagtcaacgactatattttgtaactacgtactantatctatacaanctacttttnatagttgaattgggtaaattggtanttggggacaggacattanatttaactaanttagttaggantgccctattancattcttaaaaaaaaa

SEQ ID NO: 81748 - DNA, 290 bp, Triticum aestivum
  unsure (1)..(290): unsure at all n locations
  Clone ID: PAT_TA_81748
tttttttttttgaaaccaatcgcatgaaacctcatttataaagtcactgggttcagcataaaaactgccaagctagtacaaatgatgcgcgggcgaatagctagtcgagaaaagattctaccatagcattgtaagcaaacacatatgctcaaagtccgtatcccaggcaggggtgcaatggggcctaaggcccttactgatcatttggatgagctgcagtaccttgccaatactatgaatgactcccatttaccttgctgatgttgctcaagcaanagaaaaaaaaaaaa

SEQ ID NO: 81749 - DNA, 610 bp, Triticum aestivum
  unsure (1)..(610): unsure at all n locations
  Clone ID: PAT_TA_81749
gcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgtggtctttgttgcaacaagaaggattgtgaggccacccaagaagggtctgctgttcagcgcctcgcaccaggaccctgacagtgttcatgatggtatcttggaggatgtcctgtacccagctgagattgtggggaagcgtgtccanataccgtttgggatggggcnaaggcacaaatctacttgggnccaaaaggagcgcaacaacactgaatacaactggaacttctctgcatctaccgcaagttttttgggaaanactttctttgatacctgtgactgaacncctgaaatcatgctngatgcncattaaacttccgatcaaagttggttaagctgggtaattggcacaatgttcaaaaatatttgtaacnacgggttagaattgtnaatgnatnactaanagtaagtttgnattaatananctagccntttcttaaaaaaaaaaaa

SEQ ID NO: 81750 - DNA, 378 bp, Triticum aestivum
  unsure (1)..(378): unsure at all n locations
  Clone ID: PAT_TA_81750
gggggttaggagccctcctaaccggtgcacatacttgggctggcccgtggacagcatatgggctgggctgggctgggctgtgcacacgttgaagcgttgctggctataagtaagtggagaggaggcaacaaggagggtatccagtgcatcaacgaaacccggcggcggcagctcttctcctacctccagctctctcccttcctctttcccagttctctgtaatcaaatcctctatgtgtaatgagtaatcaagagatccttaagtgtgtccctaacatagcattgaaagtgtcaagggaaagggaaatgattcatacattgaagggataaaaagatagaacatcatcaattaattnaaggcaaaanaaaaaaaaaaaa

SEQ ID NO: 81751 - DNA, 518 bp, Triticum aestivum
  unsure (1)..(518): unsure at all n locations
  Clone ID: PAT_TA_81751
cgccgagccgcgatgaggggcctctccgggggaggagctgcgttcctgcatcaacctcgatgttcgagggatggggacggtgaggcaactcgaagagcggcggcacacgcagtgcgggggaggcagagatgaccacagctggtgtgcaggagccgagccgtcggaagtagagtcaagcagctgggagaggcaggcaaatcaaacccgatgctgccggcaacgttgtctacgctgctctgaaggttaaccccgatgtgcttngatccttgatcctccttgatcctgatgttgttataaaatatcaaatatgcatcctgttngagttngaacatganacctgggcacttccaatagggacatgatcaattttgtgttgtatttcctcctcctttccttgaaatagacaancttngtggctggaacaanctggttgaacaatcccttcctattaattnnagataaccaatgccctaaatatccttttcngtggcccaacttcaaactaatttaagtaatcc

SEQ ID NO: 81752 - DNA, 604 bp, Triticum aestivum
  unsure (1)..(604): unsure at all n locations
  Clone ID: PAT_TA_81752
ggacgatgacgctaaacagcagtagcagctcaaggcggtggtgctgattagatttgatcctcaaggacacccatgggtcttgctgcatgtggtgggttttggagaaccaacttgagatgcaggaagtgggttcttgagctgtgctctgctcgagcaggaggggtttgctccttttctcctagggcgaccaagaggcttgccctgagctgaagcacgtccatgccaacccaccatgacaggtgccgtccttccatgggacgaaggaggacaatgacctgaacctccgacggtgatgttgtcaaccccgcacaatgctgaatgaggcatgatgcttaccttgcctggagcgcatcaacccccnacaatgggaccacatncaancctgaggtacctgctgcaactaataacgctacttcccgggctaaataatctgcggcnnccattactttttttggtacttggccaatnaccatgatanattggttgatcccangnatcaaaactatgggttgtttgancgttgnaatgattaaaagttgntaaataggtaaaannactgtaccaatnatcggcgnccaagacctcagttgtcaaaaaaaaaaaa

SEQ ID NO: 81753 - DNA, 626 bp, Triticum aestivum
  unsure (1)..(626): unsure at all n locations
  Clone ID: PAT_TA_81753
ctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttggatcgatgccgcatttccacttctcaaagggagtttgttgcaacaactggatgttgtccgaggctgcactgggtgtgaatgttgcggtatggtgggtggatccccaaggaaggaagaatggaaagaagatgttatgacgaaaatgttcaatctacaaantcaaanactgctccttgaactcaagcaccccaactgcaagtttgggtgttgcaaccaacaaacacaatntctcacccngaaggantgtccactaccctgagaagaanaattgttgaccgcctagacanaacaggnacggtnagatctgananactggtcaagttcgctaanatgcatattgggaanaccgcatatacctntgtacagcantaaantcatgnaaaccgtcgantttannataaggaanggaa

SEQ ID NO: 81754 - DNA, 576 bp, Triticum aestivum
  unsure (1)..(576): unsure at all n locations
  Clone ID: PAT_TA_81754
accacccgctctcctgcttccacagtcccctgttgagagagagagagagagagagaggcggctatggcgaganacttcctgctcaatangggagcgaagatnccctcggtggggctcggcacctggcaggctgaacccggcgtcttcggcgccgccgtctacgccgccgtcaaggccggttacnggcacatcgattgcnccagagaataccanaatnagaagganatcngcttggcnctnaaaaagctatttttcgaggaggtantaaagcgtgaagatctgtttatnacctctannctatngaatgactgtnaagctcctgaagatgtntcanaagcactnaatgaaaanctgaatgatttaaagcttgatacttngatcttnatcttatcnactgccnattaagtgtcaataanggaataaacacatcctnaaaanaanttntactnacaccaggtacttgggggaatgaaaaattaatnanctggcaanttcccnaatgnggtgannattttaaaanaanttggtgnttctttngantcaaatcctncnttattagngnancatcttttgaat

SEQ ID NO: 81755 - DNA, 463 bp, Triticum aestivum
  unsure (1)..(463): unsure at all n locations
  Clone ID: PAT_TA_81755
gcgcagcgtcctccccgcgactccgatggccagcaagtgggtcaggcccgaggtgtacccgctgttcgcggcgacgggcgtcgccatcggcatctgcgccttcagcctcctccgcaacatcaccggcaacccagaagtcagggtcaacaagatggggaagggcagcgggagtgcttgagaacatgaggagggcaggcgctacgcccgagcatggctcaagagctatgtgcaaggacaagaccccgagatcatgccaggaatcaaacaantcttcaccancccgaaatgaacatttacctgtcaagtggtccctattaataactgttgtggcaaantgcaactattccaanattcaatatgttgtcgctccatattccagaggtatcancnaangctccttattgaaagacattgatgtttggatggttgcaaanagtgatggttgaatggttcctaaaaaaaa

SEQ ID NO: 81756 - DNA, 642 bp, Triticum aestivum
  unsure (1)..(642): unsure at all n locations
  Clone ID: PAT_TA_81756
aagaagcacaaaagaagccaacaccaatcaaggcctccatccaatcccaagcaacctcgaagatgtcttgctgcggaggaagctgcggctgcggcagcgcctgcaagtgcggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatcattgatcatcgatcatgcatgcaccgcgcgcatgcatcatatctatgatcgatcatccatccatctagtacatgtaacgctacctgatcganggtctttgtatgtatgtaagcaactgncagcatgagcagagcagtgcatcccatgcatgtaaacganccctaaataatctcccgtggntaacctataaaaaanantaaaactccagggggggccggtaccaatcgcctataggatctattncccgtcatggcgtcgtttnaagtcngacgggaaacctgggtaccaattacgcttganaatccctttccagtgggtaacnaaagccgacgtgcctcca

SEQ ID NO: 81757 - DNA, 512 bp, Triticum aestivum
  unsure (1)..(512): unsure at all n locations
  Clone ID: PAT_TA_81757
gagaagactcacatcaacatcgtggtcattggccacgtcgactctggcaagtcgacgaccactggccacctgatctacaagcttggaggcattgacaagcgtgtgatcgagaggttcgagaaggaagccgctgaaatgaacaagaggtctttcaagtacgcctgggtgcttgacaagctcaaggccgagcgtgagagaggtatcaccatcgatattgccctctggaagtttgagacaaccaagtactactgcaccgtcattgatgcccctgggtcaccgtgacttcatcaagaacatgatcaccggtacctcccaggctgactgtgctgttctcatcatcgactccaccactgggtggttttgaggctggtatctccaaggatggccaaacacgtgagcangcctccttgcttcaacncttggagtgaancaagatatttgctgctgaacaaagatggncgcaacaatccaagtatcaaaggtcgtacaagaattgtaagnggcnctcgacc

SEQ ID NO: 81758 - DNA, 449 bp, Triticum aestivum
  unsure (1)..(449): unsure at all n locations
  Clone ID: PAT_TA_81758
tctgggcgcggcaagggaggcaagggtctcggcaagggcggcgccaagcgccaccggaaggtgctgcgcgacaacatccagggcatcaccaagccggccatccggcgcctggctcggagaggcggcgtgaagcgcatctcggggctcatctacgaggagacccgcggcgtgctcaagatcttcctccgagaacgtcatccgcgacgccgtcacctacacggagcacgcccgccgcaagaccgtcaccgccatggacgtcctctacgcgctcaaagcgccaanggccgcacctctacggttccngcggctaagcnccacttcctcccgcaantcctcgccgctcctcctcaatcaacactccgccccgcttgtggcccccggnccaaagaaactgcatncttaanttcaataactnttacccgganatttactgttccccattttcnacg

SEQ ID NO: 81759 - DNA, 654 bp, Triticum aestivum
  unsure (1)..(654): unsure at all n locations
  Clone ID: PAT_TA_81759
cccttctcttcggtgagaaggaggttgctgtgtttggctgcaggaaccctgaggagatcccatgggctgctgctggtgctgagtacgttgttgagtccaccggtgttttcaccgacaaggacaaggctgcagctcacattaagggtggtgccaagaaggtcatcatttctgctcccagcaaggatgctcccatgtttgtctgtggtgtcaatgagaaggaatacaatctgacatcgacattgtctccaaacgctagctgcaccactaactgccttgctcctccttgctaaggttatcaaatgacaagtttggcattgttgagggttttgatgacacagtcatgccatgactgcaacccanaaactgttgatggccttccaacaaagactggagagttgnaaaggctgcaacttcaacacatccnaagcanactggtgcncaaaggtgttngnaaagngtcccaaaacttaacggaanttacgggaaggctccctgtccacngtgangttccgtgttgatcgacgtaaactncnancagaactatataaattagntgtacangaggatcnaggaacccangcatttggtacttatagggcctgttcatnctttagtaaaaggcanattnctcagcggnttnctanaattncantt

SEQ ID NO: 81760 - DNA, 387 bp, Triticum aestivum
  unsure (1)..(387): unsure at all n locations
  Clone ID: PAT_TA_81760
tggcggccggcggcggctgatgtgggggacccggccgcggagtcttcgagggggactgcggtgcggtgcgtttctttctggaaaaaaaaatatggaatgcgtcgttgcgtttccttcgggcggaccggagaatatccggtagctttcaggctaaggaaaatggaaaatgggatcagaacgcccatatcttccatttgagagcaagcaacttttttttatgcatgtttttaggatcaccattttatgcattttaattttgtttggtttgaaaacggtcgacatgcttatccttaaaaaatctggagatgctgaggaccacacaanagataaaanatccctacaannaanttcccnnaaccccnagggnnggcccgggaccaattcccc

SEQ ID NO: 81761 - DNA, 356 bp, Triticum aestivum
  unsure (1)..(356): unsure at all n locations
  Clone ID: PAT_TA_81761
cccctacaaaaattggcataataaaataaaatggtttagtatttttattaaaccaaacaaatgtcagaaaattagaaaagaaaacagagaaggggagagagacttacctgggccacttacccgatcggcccagtagctcggcccagctgactggccgacgccagtcgtccccctcctccgcgccagagggacagggcgcgttggtccgccgcacaccgcgcgcatgcgcgccacggcagctgcctgcgtgcctccccctccgacgccctgggctcgccaagaagcnccagcaccgcccggtctctccctccgtctctncgnttctctccctcccctgnactctccctctccccggg

SEQ ID NO: 81762 - DNA, 490 bp, Triticum aestivum
  unsure (1)..(490): unsure at all n locations
  Clone ID: PAT_TA_81762
gcggcgtgaagaagccgcaccgcttccgccccggcaccgtcgcgctccgcgagatccgcaagtaccagaagagcacggagctgctcatccgcaagctgcccttccagcgcctggtgcgggagatcgcgcaggacttcaagaccgacctccgcttccagagctccgccgtgtccgcgctccaggaggccgccgaggcctacctcgtggggctgttcgaggacaccaacctctgcgccatccacgccaagcgcgtcaccatcatgcccaaggacatccagctcgcccgccgcatccgtggcgagagggcctagattttgcttcgtgggtgcctgatctgacgtgtagagatggtaacttcgtcttaacatgtgttgagtggtggatgtcttgtanctggtaggaggaacctcgttcgtgctacatggtttgtaagtcctgggtacgtttgatgttacctcctgttcatcagaatgtgaaagttgctacagaa

SEQ ID NO: 81763 - DNA, 343 bp, Triticum aestivum
  unsure (1)..(343): unsure at all n locations
  Clone ID: PAT_TA_81763
atcgcctcgcgcccgcaccccaggaaggtaagctcaagaggctgtcctgagaagctcaaatggctcccaaagttgctgttgccaagaagggcgatgccaaggcccaggctgccaaggttgccaaggctgtgaagtccgggtcaatcaagaagaccgcaaagaagatccgcacgtctgtgacatttcaccgccccaagaccctgtccaaggncanggaccccaagtacccangatnagcaaccctgnnaagaacaagttntaccaattncaaatatccaatacccgctnacaatgatccgcgatnaanaaaatttnncaanaaaacctttctttatctncacct

SEQ ID NO: 81764 - DNA, 421 bp, Triticum aestivum
  unsure (1)..(421): unsure at all n locations
  Clone ID: PAT_TA_81764
gcgagctagatggcgatgagcaccgangcggcggcgtgttcgttatcccatcccatgcgtgcttcaggagccacaatccaggggtagcatacggggcgagatcccctgtcgttccggtggaaaatgattgcatgtagtggatctggtggatcctattcctgtctaataagctcggtctgttgctgtactatgattttaggtgatttcgtatgaatacgactacactttctcggaaaaaaaatcaacgagcttgacttggctgtaatttgtgtttgtttcattatccttttccttgtggctgtaatttatgtttgtgtaatttttaatttaaacatatganaagcaatctttaaaaaatagtatgtgctcaatgttaacacancaggtattgatctanggtataattanngggcaangataa

SEQ ID NO: 81765 - DNA, 659 bp, Triticum aestivum
  unsure (1)..(659): unsure at all n locations
  Clone ID: PAT_TA_81765
tcgagttttttttttttttttttacgcacgagaggaagaaatcctatattggaaaaaattgtgagattacaattgttgatattacaggaggaataacatccaaatgtaatgcataatctaaatattctcttgacagcgaaacttaaactaaaagcatccacgacatccctacaacttaactaaaacttaaccaagaaacatcatctancaggaacaacatccctgcaacttaactaaaactggaaaacagcatcataactacaactgaaaatagcatcatcgtcatcctccgtgaactgggaacatcatcatcaaccatttgnatacttggccacacactccatataagcgnccatatatattttngnatccnacaanaggaaataccaantgaaccgtnantacacaatgcattngacatgatgcaaatantgccggttgccanncatttacgaatattantcctaaaaaggncattactccctaacggnacgagggggggcccggaccaatcccccnaaangatccgataccncgcnatggccgcgtttaaacgccnnnggaaaacctgggtacccaattacccttgaaaaaccccttnccagngggnaancaaangccnccgttncctcaaanttgcacctganggaaggcccccc

SEQ ID NO: 81766 - DNA, 331 bp, Triticum aestivum
  unsure (1)..(331): unsure at all n locations
  Clone ID: PAT_TA_81766
gtttgctctcgcgtccgccgcgcccatcctcgtccgcgcctgcgcccggcccgtgctcgctcgctcgccgcctccctcgcctcgatccaccgcgccggcggcatggcggatcagctcaccgacgaccagatcgccgagttcaaggaggccttcagcctcttcganaaggacggagatggttgcatcaccaccaaggagtgggaacattatgcgttngctgggggcaagaacccaacgggaggctgactcccaaggacatgattcaatgaatcccatgctgatggcaacggacattgacttccaaagattccttnaacntgtatgcccccaa

SEQ ID NO: 81767 - DNA, 645 bp, Triticum aestivum
  unsure (1)..(645): unsure at all n locations
  Clone ID: PAT_TA_81767
gtcgtgccaagcttcaagttcccccgccacttctttcgtcggaaccggacgggacnaaccggatctgctcttccccgcctcgatcngcngcntccttgccggagttcattccaantccggccgtcgccnagcctctgnancgtgtnctgcctcccctgtttctgcatgtgaannangacgatcatgcacacctcctacctgcgttgaccgaagccgngccangtcanatatcgccagcgncctccncgcccgtgngcanccaaaggcnaancncggtctgccanctcctcntctaaccgtncatgaagcctgnttcngttcannttccgggagtngtgacgatcnntcngactacgtctgttctcctcctcaatgnaccgtcttccttccgaactggattcaaagttttgacattgctgatcctcatgatcaanantacaccaatacatncaangtgccatnatacaacgcaagtgatgtactnatcaatgggagtcgacatnaccttggccttacaagttcntccctgnngacaatantgnnccaatcggacattgggtcnanattggggtaactcctcattggnttgctaancgtcaaggnnatttgtacgttgatantagnntgtagggnattacannttta

SEQ ID NO: 81768 - DNA, 488 bp, Triticum aestivum
  unsure (1)..(488): unsure at all n locations
  Clone ID: PAT_TA_81768
cccaggaagagcaccagaccgaggtgccacagattcccaaggtagagcttccatcgttcccggaagtacaccttccacctaagcctgagcttcccaaagtggagttgccgccggtcccggaggtgcacctgccatctaagcctgagcttcccaaggtggagctgccaccggtccctgaggtgcacttgccacccaagcctgagctgcccaaggtggagctgccgatgttcccggaggtcacttgccacccaaagccggagatgcccaaggtggagtcccgccgaagcccgagatccaaaggtggagttctaccaaaagcgggagatccactgttcccgtgttcactttccaaagcaataggcaagccatgagattgcttcncaaacancgctcgtcnattccncgtanagtaccnatgtntttgctcaacggcggatggttatcaggccacanattgggangaaagttaaaaaaanaaatttgttaan

SEQ ID NO: 81769 - DNA, 371 bp, Triticum aestivum
  unsure (1)..(371): unsure at all n locations
  Clone ID: PAT_TA_81769
atgcaatcaggcagtacgatggggataagatgatgttgtcattgacaaaagcttcatagtctgtttaactttcttacttctttcataaaattcttggatgagaatttcagcagccagagcttggatggtgttttggctctgaaatctgcagaaaacttgggccacttctcaagcaaatagctgtttttaaggtattccgttttgcatgatgagcacgacaatgtggctggacaatgcgttacggggcactcctagaagaccatgaggaatgacatattcatatttggacaaactttancgcactggtatttaagtttgaaaggatttnggcaaaagagattccgaaaaaanntttttntgggaaaaaaaaa

SEQ ID NO: 81770 - DNA, 510 bp, Triticum aestivum
  unsure (1)..(510): unsure at all n locations
  Clone ID: PAT_TA_81770
acttgcagggaacttggcattggaattgtggcgtacagcccgttgggcagagggttcttctctagtgggccaaagctggtcgacacgctgtctgaacaagactttcgcaaggacttaccaagattccaagctgaaaaccttgagaagaacaccatgggtatttggagcgggttagcacgatggcggcgaggaaggggtgcacggcgtccgcagttgcacttgcctggggtcaccatcaaggggaatgatgtgtgccccataccaaggaaccacaaaggtccgacaacttcaaacccagaatggtggcgggctgtcccgtngagntcgccccaagaggagatggccgacttnganccctacgctcccgcggagttgccgggtgatcgtacangattcccctgacacttnggaagttcctgaaccctcccangtcacccnggnaagccnangaantttcccgggggaacggggaaaaaattcttgtcctaattccccgggcaaaggaaggtt

SEQ ID NO: 81771 - DNA, 200 bp, Triticum aestivum
  unsure (1)..(200): unsure at all n locations
  Clone ID: PAT_TA_81771
ggcacttgnncctggntaangcctgatggnaaaacccacntcacggttgantacctcaacnagggaggtgccatggttcctgtacntgtgcacactgttctgatctccanccagcatgatgagactgtcaccantganganattnctgcggacctcatggagcatgtcatcangccggntanccctaagaagtaccttga

SEQ ID NO: 81772 - DNA, 675 bp, Triticum aestivum
  unsure (1)..(675): unsure at all n locations
  Clone ID: PAT_TA_81772
ggtttcagttctcctccgcctccggtctcgagagctcgccagaatggtcgcccacaggttccaccagtaccaggtggtgggtcgcgcgctgccgacccccggcgatgagcagcccaagatctaccgcatgaagctctgggccaccaatgaggtccgcgccaagtccaagttctgggtacttcctgaggaagctcaaagaaggtgaagaaggcaacggccaagatgctccgccatcaaacgagatctttggagaaagaacccaccaccatcaaagaatacggcatctgggctggaggtaccaagagcaagaccgggtaccacaacatgtacaaggagtaccgtggacacgacctcnaacggcgggttggagcaagtgtacacggagatggctcnccggaccgcctgctgcccctgcaccaagtnatcaaagatgcgacgtggcttnaactgtgcaaagagggacaacacaagcantcaacacncgaagtcagttcccgctggntacaaaaggtcgccaccaccgcaagtaagacactaaaggcacaggncaactctangtagcggtccantcacggccggtgttacgtgagatttanttttgagtgantttgnaacttnagtttcgccagtcccgcttagaacctacttttgaaaaganattacangncccaaaaa

SEQ ID NO: 81773 - DNA, 178 bp, Triticum aestivum
  unsure (1)..(178): unsure at all n locations
  Clone ID: PAT_TA_81773
cgagttttttttttttttttttttttttttttttttttttttttttttttttttacatggcataatttttctgcagctcttgncgggaaatttatttagcaggtaaaaacacatagataancgatatccaggcatttcatggatctgncagananttcacanggcattaacnatcatg

SEQ ID NO: 81774 - DNA, 654 bp, Triticum aestivum
  unsure (1)..(654): unsure at all n locations
  Clone ID: PAT_TA_81774
ctatggttggcctccctggagtggacgggttatcgaccgaacaaagaaagagactgacaattgccgtggagctggtagcaaatccttcaatcatattcatggatgagccaacttctggacttgatgctagagccgcagccattgtaatgcgggcagtgagaaatacagtcaacactggggcgaactgtgggtttgcactatccatcaaacccaagcattggatatatccgagcttttggatgacttcctgcttatgaaaagaggaggacaagttattaatgctgggtgaactgggccncatccttaataaactaagtggaatatttgggaggaatccaaggtgttggaaaagataacacaaggatataaccccgcaacatggagctggaagtancccctttaaccggagtccnctgaacgtaacttgctgaattaagcatcccaactttataggaaacacactattaaggataacgtctcggcaagctcaggttccatcctacaatatccagattcaaacaatgaatgaacttcggacatcaacatttgagatcgccaacgcatggcttccagcagtangcctnattgacggtttgaagncaatngcccanagttgtaccattgcataggggctttcctgcnatgaaagnacnt

SEQ ID NO: 81775 - DNA, 524 bp, Triticum aestivum
  unsure (1)..(524): unsure at all n locations
  Clone ID: PAT_TA_81775
gttggcttcaacgtcaagaacgttgctgtgaaggatctgaagcgtgggtttgttgcatccaactccaaggatgaccctgccaaggaggcggccaacttcacctcccaggtcatcatcatgaaccaccctggtcagatcggcaatggctacgccccagtgctggactgccacacctcccacattgctgtcaagtttgctgagctgggtgaccaagatcgacaggcgatctgggtaaggagtgggaggcgctgcccaaantcctggaagaacgggtgacgctgggtatccgtcaaagatgatcccaccaaanccatggttgtggaacttccgccactacctcctcctgggccnttcnctgtgccgtgacatgagacaaacggttgctgttgggtgtcancaaaggcgttggagaagaagacccaaccggcgccaaggtacaaagctgccancaagaagaatagngtgcttcaacagatgttttgtcacggcatgctttggtgctcanatctaaccgancgacatga

SEQ ID NO: 81776 - DNA, 571 bp, Triticum aestivum
  unsure (1)..(571): unsure at all n locations
  Clone ID: PAT_TA_81776
gattgatccacaggcgtcctcggtgcagttcgatcacatgggtggttttctgcgagcaagggtgtccattgatgtgaacaagcctccgagaaggtggattgtaattgattcggcgaaaaggaagaagcaagatgcatatgatattcagtacgagaatgttcctcacttttgtttctcctgcggccaattgggccatgctgacccgttttgccctactcctagccaacatggatgcgaatgggagagtccccgtttgggttcgaagctgagggcgtctgatgagcgtaagaggactgcatccaagtgactttgccgggaaggaatacatgttgatccgagcatcatagggatcaaanatccaacaacatatcggnagtgggacgaggtgaatccctacaaagaagnaccacttnnacaagagaaagaggcncaaacangtttacgctgtgtcnanatgaaccccctccnctgacacaacggcgagggttgaaacctgagcgggctcctaagaaangggatgggaantntngacgaggggggtcttagnttcncaaaaaaanaccccntgatt

SEQ ID NO: 81777 - DNA, 621 bp, Triticum aestivum
  unsure (1)..(621): unsure at all n locations
  Clone ID: PAT_TA_81777
gccgaccccgccaagttcctgcacctctatgagctgagcatcaaggtggccagcggtgacgagaagataatggcgaactggttccccatggccctcaatgacggtgcacgttctcctgaatctccccgtgggattgggtctcttcctgggagaagatgcgcggccgctttatccgccaacttccaagggcactcaacgaccatccgccggcgcgggtgacctgcgaaagtgtcaaagcaacagcaaggagagaccctgcaagaanacatccagcgttcnaacaacatcccctcaaagatctcnaaggtgtccngacgangcacatttcaagggttaactggatggcgttccgtgncctccaagatgaaggaggantccncttttcaatgaagactcctgcacacttgggagatgttcaatatggcgaacaagtgtgcaangctaaggagcgggncctcctcctnaagnccccgatgtgaccaanaagacaagaaggaangcaaggtgagaaccaaggggcggtctgctctggccgancanaataatnggactggacaaccgagtatcaagnnaacgncaatttggcttcaatgtcaagcaannatatgagcagacgaggcc

SEQ ID NO: 81778 - DNA, 605 bp, Triticum aestivum
  unsure (1)..(605): unsure at all n locations
  Clone ID: PAT_TA_81778
gcaccaccgccgccagctccacacctcgagagggacgcctcgtcgccggagaagcagcaagaagaagatggccggaaggaagggcggcgataggaagaaggcggtgacccgctccgtgaaggccgggctccagttccccgtgggccgcatcgggcgctacctcaagaanggccgctacncncagcgcgtccggtccngcgcccccgtctacctcnccgccgtcctccgagtacctcgccgccnaangtcctgggagcttggncggcaangcggccaanggacaacaagaagacccgcatcatccncgcgccacctgctgctggccgttccgcaaacgaccaagagtccggaagctgtcncgggttatccccaacatcaatccctgctgtcccaagaaatccccgccgccgccganaaggangcacaaattcccaagaagaaacgccgcaaatccccaagaanaagacgcancacaaggatacgtcccgtccatactancatgtnctgtccgtcaatctatggnaaatnatanatccttgntgaantngtagttgctgaanccatnnccttccaatttcagaaaggggnattncccnttngggaaa

SEQ ID NO: 81779 - DNA, 679 bp, Triticum aestivum
  unsure (1)..(679): unsure at all n locations
  Clone ID: PAT_TA_81779
gccaacttggcttgacgcttggcccattcatcaggatagtcctcaccgcgcttgaggctggtgggatcagcgatttggctaggtgccaatggaggtcttgggcatggaggattgagtgcgaatttcttcatgtacttaggagtgacatatctgtattccctccactctcttgcccatctcctctctatcttctgaatgcgcactttgcgctcattttgggttccctcaagtaggtgttgcagtacccaagcatatattcatccagggatctcaaaacgctgtattacctccaggctcctttcctcccntcctgtggttccttaacancaaccatttcttcaatttgaggaattttgaacatttgattcncctgaagaantagcacttttcctttgnaggaacctgcaaaagatttaattggatgaaacctagtgatcaacaactgacagtgtacctgtgaacatantatattgccaggattgganangcatagcgtccaaaaggttgtaaaagacaattanggaattgccaaataatctganaattacccggtcttgctaagtcanaaagttgntaaanncaccattagaacctaaaancatgttaaaacatnagaaantcccttagggttagggaaccataaaaccctttaatttaaacctccanaaggggaannttt

SEQ ID NO: 81780 - DNA, 487 bp, Triticum aestivum
  unsure (1)..(487): unsure at all n locations
  Clone ID: PAT_TA_81780
ttcgtttcctccatgcgtgcatctctttcgctggctgattcacccgatgcatgctgccgctcactctttcttgccgcttggtgccggagcagatgcggttcttgatcagcgtgctgcgcaccatcatcggctactacttttgccttctcttcgttattcaagcccccgtcatgggttacgtgcggaactgcctcaccttctcctgtgtcttgctcctcgtcgcattcctcaactgccccagtaatgggcgctaacgacgacgtccgacgactccgccaccgccgcctcctacgtcctgggcgcctgaccgtgtttgaaatccatgccgtgtgggattgtcaagcccacaacgaatatttgggcgangcctgtcactgtacaaaattgattgaccacttaaatcaactccttaatgggctcctggggtttttttacaaaaagggtgaatccaacttaaaaacggagatgaaatgatatcaattagcaa

SEQ ID NO: 81781 - DNA, 639 bp, Triticum aestivum
  unsure (1)..(639): unsure at all n locations
  Clone ID: PAT_TA_81781
gattcggtggccttctcacctgctataacctgtaaggccgccggctaagccaagtgccttagttactttttaaaaagcaaaaagtaaaggccttccctactgttcatgtgaaaattaagcaaaatgagacacccctgattgcaatgagcacctttatatcaaaatgttgccttctctcgtaatagtgtttgttcttgcttttatctgtgcatgatgtggttgcatattctgagaacaggaagatttcataatgctacagaaacactgtttattatgttcctgactgcttcacacatgcaaagtaacaccttatgttggatctaataataatgttaggctttccnagtgcttgctcatttgggacttgcaaagttantnccctncatttacanaatatggantaattggagcagacattcatgctctggnaacaatctcaattctaagaatattccactataatattctggnaagcaaattagactcctgggcactgatggaaananaaancagacacaatnttagnaagcagatactataacntanacgaantacncccatagnaagttaancgatcnatntgtccttgaggggcnataaattncgttggcactgacaaaaataccgtggcaccatatt

SEQ ID NO: 81782 - DNA, 341 bp, Triticum aestivum
  unsure (1)..(341): unsure at all n locations
  Clone ID: PAT_TA_81782
ctcnagttttttttttttttttttanctnanctgcagtggcacacacagtanantanattttgcactcgataatgtgggtacacttaatgcaaggaaaacaaaacacactcgatggatcggttctggtgatagacacagatgcatattggcacccacgcatgcacaggggtaggaatagggaaggagcagctggatggtanncnggtgaatgaggancanngctggaggntgtanacggtgcantccnccttgggcacgaaggtggncatgtngaccgnctcgtcncacncgtgggtgcgtttgcgcntggattggacgnctganactananagcgcgatg

SEQ ID NO: 81783 - DNA, 268 bp, Triticum aestivum
  unsure (1)..(268): unsure at all n locations
  Clone ID: PAT_TA_81783
ggcaanatgancaccanggaggtggaccagcagatgatcaacgtgcagaacaagaactcgtcctacttcgtggcgnngctccccaacaccgtcaagtcttcgcctgtgcganatcccgcccaggggactgtccattgcgtccaccttcatcggnaantcnacaatccatccaaagatatnttccgncncgtgnacgangcanttcacngccatgttccgntgnaaggcttcctgcacngtcacantnaccanaggnattgcacgaaat

SEQ ID NO: 81784 - DNA, 385 bp, Triticum aestivum
  unsure (1)..(385): unsure at all n locations
  Clone ID: PAT_TA_81784
cganatcgtcccccacggccccagggtcttcttcttctacacccagtggacctttttattagtcaccatatattttgcggttgcgactgctatatcagctcatggatgttggtcatactcaaagaaaagcttgagaaaagctgatgaatatggcgatgttgaaaatcgtgacctctcagcttctatttctggagataggaaaaacggtgagatagacaagatgngcangctattatgaacanatagcaaatgananaagagctgctttctgggggacgtttgnangcanatcatctaccaaggctaatgcaggagcgacaatggttgacngatgtcanattttgggggactcnttgtgccattcttttacngngntaagtttggg

SEQ ID NO: 81785 - DNA, 499 bp, Triticum aestivum
  unsure (1)..(499): unsure at all n locations
  Clone ID: PAT_TA_81785
ccgaccgacccaccggacgcggngagggggagggaaagagggagantggtctatagatanatacanctgaaatcccactgcnccaagaaagaacttcttcccttcttcctcgtctcatctcctccttcctcctcgtcctccaagccaagaaactcctcatctccacngtccgcccntgaaggaangaggcgatctngccatggggaagatgtgctgcagcnaggangaggactaaggcggggttcaacctgctgccgctggngatggccgccttcgtcatcatgctgctctncgtcntctgntcacngcngcccnggtncatgcgctgcgtcgactcacgtgnaactnacctgacctgactaatggngnccgttgatnngagcctcnattgngcgcngctgcatgcacnaaantggtgcagntgtcaaaagcnattgntgnttgganttgattttctaaagatgnntttgggagaagatanacatttagatnctcattg

SEQ ID NO: 81786 - DNA, 477 bp, Triticum aestivum
  unsure (1)..(477): unsure at all n locations
  Clone ID: PAT_TA_81786
ctactgccaggacggctggcggttcccgcaggggttccccgccgaatgctcccgcgactgatgaccgactgattcgtcgccgtcgtccctacgtaccgattgttctaattgacctgtggtttcttgggttcaccactgattgcctctggatctgatctgccattttgcctcccatggtgttctttatctcctaccgggcacctccacatgggtgtaacattcccaaaagaaaaaaactgcacatgatgtcnanctccggccaaggttacaaaccgaagcataaacaatacaagtgggtgntcgattgacccttggattctggaacaatacagatgatatatagtaagatgctggtaaacttgttcccggcgattttttcaacacgtatttttcnaccccggtggttaagttncccccgggggnacaataccctaacttccancattttaaaaaagacatgtcttatttgcaangggc

SEQ ID NO: 81787 - DNA, 666 bp, Triticum aestivum
  unsure (1)..(666): unsure at all n locations
  Clone ID: PAT_TA_81787
ctgatctataagcttggaggcattgacaagcgtgtgatcgagaggttcgagaaggaagccgctgaaatgaacaagaggtctttcaagtacgcctgggtgcttgacaagctcaaggccgagcgtgagaggggtatcaccatcgatattgccctctggaagttcgagaccaccaagtactactgcaccgtcattgatgcccctggtcaccgtgacttcatcaagaacatgatcaccggtacctcccaggctgactgtgctgttctcatcatcgactccaccactgggtgggttttgaggctggtatctccaaggatggccagacacgtgagcacgctctccttgctttcactcttgggagtgaagcagatgatctgctgctgcaacaagatggacgccaccactcccaagtactcaaaggcgcgttacgaagaaattgtgaaggagtccctcctacctgaagaaggcggctacaacctgaaaaggtccttcgcccatctctgggtcaaggtgacaacatgattgagagncaacaacctgacggtaaaggccaacctgctnagngctgacagtaatganccaaagcctaaaaaccctcgtctcctcaagacntaanatggggattgaagtccgtgctttaacgggcacaccngaaggttcttgccccgg

SEQ ID NO: 81788 - DNA, 650 bp, Triticum aestivum
  unsure (1)..(650): unsure at all n locations
  Clone ID: PAT_TA_81788
atttcgaacatgagtgggctggactcactccaaacaatcccagaattcaaagtaagtcctttagaagggcaggaggcaaagcagttgaggtacctaaacaggctcagcggcaaactgattatctctggtctcgatagtattaaaaggagagaggaagctgttgaagtcgacctagctgccaagaaacttctcacggatctaacactccgaattcaatggaagttcaaaagttgcagcagaggtacttgagggctttgtcctcccgtggggcttgaagagctgggcaatccgatggctacgaaggtttgggtatacccaaagtgggatgggtggggtaaggcaaaatgggtggaccaagagaactgcagaaacttngaactcngcaagatggaggaaccaagactgctcctgaactgggtgggagttcnatccaccttcgntcgctcnaactgtataactgaattggacnctngcaagccatatgganactcaactcgctcnnaaaactaggtncaagtggttgattncggcncttcaaagctcaaatctcccaaaattgtgccccnactgnacatgattanagtctntcaaaatgaatcaacngaaagntnaaatcgaggaanntttccgattaaccacccctttnttnn

SEQ ID NO: 81789 - DNA, 576 bp, Triticum aestivum
  unsure (1)..(576): unsure at all n locations
  Clone ID: PAT_TA_81789
ggcggacgcaggggagaggatggcggggtcagaagccgtgccggtggtggctgtggctgccgggaagcagcccgtcaatggatcagccatggcaggtatcgacaagcttgtgacctcaactgttgggaaatcgacaaacgttctttggcatgactgtccaataggtcagtttgagaggcaggaactgctaaatcaagaagggttgtgttgtgtggataacagggttaagtggtcaagggaaaanacactagcatgcgcgctaatcgcgactgcaccccagaggcatctgacctacattcctagacggtgacatctaaagcatgggtttaaccgaaactccgtttcccaagcaaagaccgtgcctgaaatatacncaaaatagnagaattacaactgtttgcaangcnggccgatcngattgcaacttgaacacctacanaatgaaccaanctgccgcaattacngacattcanatcanccaggttttgatncccttaatttgtaactggatcaaaagntgtnaactgccgtcagaaaatnaaggttacggattgtgtcctataacacctcgatgca

SEQ ID NO: 81790 - DNA, 270 bp, Triticum aestivum
  unsure (1)..(270): unsure at all n locations
  Clone ID: PAT_TA_81790
gaccagcagcgcacacacacacaccagccaagccaagggaaggtcgccggagagagaagcgccagagatgtccggccgcgaaagggagggaaggggctgggcaagggnngcgccaagcgncaccgnaangtgctgcttnacaacatncagggcatcantangccggccatccggaggntgnngcggtngggcagcgtnatagcgtatctcggtgctcatcttcnatggttaccctcggngtgctcantatcttcctgnatancatcatcc

SEQ ID NO: 81791 - DNA, 545 bp, Triticum aestivum
  unsure (1)..(545): unsure at all n locations
  Clone ID: PAT_TA_81791
ctcancaagggctgcgacgggttgacaaattttacacccacccaccccccacacaatcaaccttctgtacctccgncaatgaagtgaaatctgaccaatccagagagctctatctacgagttgtacanttttgatcccttcaagggatcactctgtccanccatgcacacttctcacatgagggtcttgtggcatcctctgcctgtacataaatctgggactctatcctgnnaattatacatttttgtatacntgtagtatncagtcnaacacttatacgattcctaaaanngttatgatctgatgtnngatctctacaagtttcgctataangaaatgggatcataantactacagcagcacgaattctcacanatcacatgtgacattttgaattctgctcatcncaatnaanattctgaagtttcncacnatangaangtctgggaacaccatnaaggttaaaagctgcaaacnnttanttcaaanatcccactatnatgggggatgcatataacnnggaaagtngccngggttaaganctg

SEQ ID NO: 81792 - DNA, 414 bp, Triticum aestivum
  Clone ID: PAT_TA_81792
gtcgattctgcggatcggaaatgaggtggagatggtgaaggacgccgccgagaccgcggcggaggtcgtggaggaggtggccacggtggccgagaaggtgtcgtccgaggtggccgggcatctgccggaggacggcaggctgagacgcgccgcggtggtggtcgagcacgcctccaaggaagtcgcggaggaggctcatcttgcacgagacatcatccacaaggttgacgaaattgaggaggacgtcaaggcaattattgaaccgattatggatcatgggaagcaccaaaggaagcatttagaaaagtagatttttttttctttgtagcctaaattcatccgggccgctcatgggaccgcggagacaacagagaagcatctataaaactgcattatcatgtcaaaaaaaaaaaa

SEQ ID NO: 81793 - DNA, 301 bp, Triticum aestivum
  unsure (1)..(301): unsure at all n locations
  Clone ID: PAT_TA_81793
cagaaaagcatcgtctctcgtctcgtcgaggaatcaacaaccatgggcggtggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcacgcccgaggcgaagcatccgaagagcactcctccaatgttcccccacctcnaagcgttgatatctgccaaatcnngacggagagaa

SEQ ID NO: 81794 - DNA, 399 bp, Triticum aestivum
  unsure (1)..(399): unsure at all n locations
  Clone ID: PAT_TA_81794
gcgcatcgcaccggggtcacctgagatcacacacacaatggtgaaggctgtggctgtgcttactggcagtgagggtgtcaagggcaccatcttcttcacaaggaaggcagaaggggcccgaccaccgtgacgggaagtgtcaccggactcaaggaagggctccacngcttccangtgcacgctcttggcgacaccaccaatggctgcatgtcaactggaccanacttcaancccgctnggtcatgtncatggngcacctgaagatgaaatcccccatgctggtgatctnggnaatgttacaactggagttgatgtganttccaancatcaatattactgaatggcatatcccccttctggnccaaattnatgttggccttctnttcctccaagggtacc

SEQ ID NO: 81795 - DNA, 561 bp, Triticum aestivum
  unsure (1)..(561): unsure at all n locations
  Clone ID: PAT_TA_81795
cagagctcctactacgtgcggtacggcggtggcgccaacgagctcagcgcaggctactccaagggcaccgggctcgcggccgagatcatcggcaccttcgtgctcgtctacaccgtcttctccgccaccgaccccaagcgcaacgcccgtgactcccacatcccggtgctggctcctctcccaatccggattcgccgtgttcatgggccacctgggcaccatccccatcaccgggcaccggcatcaacccaagcgaagaacttggggagctgctgtcatctacaacactgacaagcctggggatgaccatggttttctgggttgggcactgttttggggccgcattnccgcggctacaacnattactncttgagggcaacgcccccaactttgggcctaaaaggngaactaatcaccgncctccnggccggatgaattgtaatattgcnaaaaaaangtgctccaaaaaatcctangttcccaacaanacttttcctgttaatgccccgtcttgaanaaaagtgnaacgtcccnggtnggaaattncaangccctcattca

SEQ ID NO: 81796 - DNA, 594 bp, Triticum aestivum
  unsure (1)..(594): unsure at all n locations
  Clone ID: PAT_TA_81796
gtccttcaactgaaggacatgtctggttgcagtgtggaaatgaccttttggggtaacttctgtgatgctgaaggtcagcagctgcagtcgctgtgcgattctggtttgaatcctatacttgcgctgaaatctggccgagttgggtgaattcaatggcaaaacagtgagtacaactagctcaanttgttaaaaataaaccagattccctgaagctgaaaggctgagcagtggtacataactgaaggaaaantgctgcctgcacttctttatctgggggaaatgtcaagcatggggcaagactgattccggaaaaaatgcacagttcaaggatgaacccctggggatcaanaaacctgattggttaaccttcaaaggngcattttcanaacctacacngaattttnttacccaacagcacaaggaggttatggaaaantgaacaaaaaggccaaatatgggatggaaggngtttttaaaaatgcataaaacctnaaacggnaanaaaaaccngggccggcaaaacannataaangggtaacaagaattttcaaagggggcanaaaaaccncccaaaaatttttagnaanaaaagaa

SEQ ID NO: 81797 - DNA, 611 bp, Triticum aestivum
  unsure (1)..(611): unsure at all n locations
  Clone ID: PAT_TA_81797
gtcttgtacaggcccaggcccatagttcagagtgaggcccaggcccatgtaaccttgtatatctctctctcgtcctcaatacagaaaactgttcggtcattctctcttcttcacgttttctaacaatcatcactagagttatgctgactanttaaagattactgtaccaactctggtgtactgaaattgttcattcataggcctttctttgttaacaggaaattgcccactcataggtcctcctaaaagactcgaaaatataacatttgctgttacttgtttactgctgtttaccggtagccattaccttatgatgcactgatgtttgatgggcatgtttttanttcntccaagttacagttaagttnagacgcaacaaggagaggaatgttttgggttgntgcaatgtcanatccgttnaacctgtgtgcctacagtataanccatcnggtctngtgttaagnaanacaactaaggaaccnaatngngatcgtatgtgngatctttgggattatggctatcgntctaactcantgccnaattcatgttacttctaaagtaangttccgnagnantcatggnncaccanatgctggagttctttcatggta

SEQ ID NO: 81798 - DNA, 503 bp, Triticum aestivum
  unsure (1)..(503): unsure at all n locations
  Clone ID: PAT_TA_81798
ccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgttggtcgtcctcggcgtggcgcctgaagaacaaggcggggcattccgaggttggccgccgggnatccggcaagggtgcactgcggcgacaatgcaagtgcaacccctgcaactggttaactgcatcacccctactacgttgttggggtganatatacnttnaataacgagcnctnatntgatggatccacaaggtgcctntgcnttncctgtgtttctgcccctcccccaagctctgccaagggtgccttgggtgaagtgtgtgtcaagtgccccngaatgcttaantacccaacnaggtggntgtgaatatttagatgaaagtttcctaaaaaaaaaaaa

SEQ ID NO: 81799 - DNA, 542 bp, Triticum aestivum
  unsure (1)..(542): unsure at all n locations
  Clone ID: PAT_TA_81799
agaccaagcaaacccgatggcccgcacgaagcagacggcgaggaagtccaccggcggcaaggcgccgaggaagcagctggccaccaaggcggcgcgcaagtcggcgccggccaccggcggcgtgaagaagccgcaccgcttccgccccggcaccgtggcgctccgggagatccgcaagtaccagaagagcaccgagctgctcatccgcaagctgcccttccagcgcctcgtcagggagatcgcgcaggacttcaagaccgacctgaggttccagtcctccgctgtgtcggcgctgcangaggccgccgaggatacctggtggggctgttcnaaggacacaacctctgcgcatcacgccaagcgcgtcacatcatgcccaaggacatcaagctcgcaagacntcagggananaagnggcctaaatcntccggctccttccantgtcgtatctgattgcagttaaantcttgtgtatcccgttcaaataatttagtcattcgattacatctgtttatcacatctataaattgtcnctgtctaan

SEQ ID NO: 81800 - DNA, 225 bp, Triticum aestivum
  Clone ID: PAT_TA_81800
gccgccacagcccgccggccctccaccccgccgtcgtgccgtcctacccgcccccggagtccgacaacgacgagtcctgggtctggtcccagatcaaggccgaggcgcgccgcgacgccgacgccgagccggcgctcgcctccttcctctacgccaccgtgctctcccacccgtccctcgagcgctccctctccttccacctcgccaacaagctctggggggggg

SEQ ID NO: 81801 - DNA, 253 bp, Triticum aestivum
  Clone ID: PAT_TA_81801
gtgcgccgccgacatcgagaccggcagcgacaaggtgttccggagcatcctgcacaccagggtcgcgctcctcaacatccagacccagacctactgctgatccaactcaatgccctagctagtgtagtagcgtagtctagtctttttttggaggatcattctgatcctgtccaaaccctcaagtgtacatacaccaatcgatcaacggattaatgcaaagcaaagcaaaggcttttgttccaaaaaaaaaaaa

SEQ ID NO: 81802 - DNA, 617 bp, Triticum aestivum
  unsure (1)..(617): unsure at all n locations
  Clone ID: PAT_TA_81802
acaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaaggattgaaactgagctcagcaagatctgtgatggatcctcaagcttctggactcccaccttgtcccctctgccactgcagcagagtccaaggtgttctatctgaaaatgaagggtgactaccacangtaccttgcggagttcaagcaagcgctgagangaaagaacagctgagaacaccctggnncatacaagtaagccaagacatcncccttctgactncctacaacaaccgataagntggacttcatcaactccaatgtcacataattctgancccaaacgtctgaacttcaacaagattntaacatgcnacggcccc

SEQ ID NO: 81803 - DNA, 632 bp, Triticum aestivum
  unsure (1)..(632): unsure at all n locations
  Clone ID: PAT_TA_81803
cacacatatatattacaacctaggttggtgaggcagagtattatatataacaaagctttgtgttgtcatacgaatttctattgtgttctttgtttgtggtgacataaatgagactagcatgaaaagctttattacaggcagcatagcttgttgcttgccaaagtgaagaatggcgtgtgaagaagtgaagaaactgcaggcactaagtttacagcaaaccacacatgaaaatactctgcataccaaataggattttggttgggccctgccgaaaataaagtgagtgctgagacaaactcatttcagtcggggaagtatgagtttgcttgatcgtcatgttttgacttgctagtacaacgttgggctgtcaacgatatatgcccatatacacatatgggtttgcacaagggcatgattacttttaaatggcatgtgctccccaaagaagaactnggngaaagaacngcaggcccngcaattaatncactcaacacaacactactaaaaccgtgcataaanctnagtggcaggatagaaacaaaactanataattggacggngtgtcaccacnctatcacgngaacccatttnaaanttgttntcattacgcacattanactgacagaacancn

SEQ ID NO: 81804 - DNA, 528 bp, Triticum aestivum
  unsure (1)..(528): unsure at all n locations
  Clone ID: PAT_TA_81804
agcccccacctcccctccctccagcaaactcacgcatcccaccaccgaagctcccaaccccacccgaagcggcagccatggcccccaaggcagacaagaagccggccgccgagaacaaggtcgagaaggcggcggagaagacccccgcgggcaagaagcccaaggccgagaagcggctgccggcgggcaagacggcgtccaaggaggccggcggcgagggcaagacccggggccgcaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaactcgccggggagtcggcaagctcgcccgctacaacaagaaccacatcactccggganatcagactcgtcgctcgtctcccgggaagtgcaagcagcgttccaggnacaaggctcacaagttactctcctnatgaatcccctttngcaat

SEQ ID NO: 81805 - DNA, 511 bp, Triticum aestivum
  unsure (1)..(511): unsure at all n locations
  Clone ID: PAT_TA_81805
ggaagaggtgacatacagcatagtcgtctcctccatcgaggcgacggtcaccgccctatgggtcatggactgatcatggctgaacggattccaatgccggttcactgtctacagcgccagcatgggtcaggaggaagtcttgttgccgccgatggcgcgattcaagctctcacgccgtgttgtttccgttgaaagttccgagcagctggtggtttccgtggtggcgtggcgcggtggcgaccgggttgcgacgaggagggtgttcttgacgcctgaggatgccggtaggagatatggtgagcttgacatgggcttctagatgaagtcaccgtcgcttggtcgctgttcctcccttgtttcctgagaaaagatcttcctgcagacaagtgcctggcgangctggtgccagcactgggatagtacaggagtatggattatggaagttgctctaaaatggcgtgttcggaactcacngttanagtaananattcctttcnggaaaaaaaaaaaa

SEQ ID NO: 81806 - DNA, 250 bp, Triticum aestivum
  unsure (1)..(250): unsure at all n locations
  Clone ID: PAT_TA_81806
agtgaaggagattctacctcctttgtcatacacgtgtgtagattcatcatccccacgttgtattttcctcttttgttttggttgtagagagtaaagttgatcagatacaaaagcacggaccttgtcgccataatgctcatgcacgtggagtaggagcctacatgtaattgagcatgtttatgtatgcnaatgttgtaatgagtttgctattcctgcttgaatagaaacattttgatgcaaaaaaaaaaaa

SEQ ID NO: 81807 - DNA, 409 bp, Triticum aestivum
  unsure (1)..(409): unsure at all n locations
  Clone ID: PAT_TA_81807
gccaccgtcatcgccccacactcaccggagccgagcaaaccttgtggtagtagacttttcagaaagtcgtcatgctaagggctcaaaggaccagcgcaccagagcagcaaccatcgctgatgaagagattcataaattggaaagatcaaacatgtaaccacacaaacaaagccgaccgaaaactagatccaccaaagaccagcaccgattgtatcccgcgagatccgatggagacacacctctggacgccctccgacgacgctagacgcaccaccgggacggggatcggacgtaggagacattatcctactgaggncaatcgccaactgacacacancctgnataacccacaagttatagaggatatttgtancctttttcgataagtaagngtgtcnaaccaacgagg

SEQ ID NO: 81808 - DNA, 224 bp, Triticum aestivum
  unsure (1)..(224): unsure at all n locations
  Clone ID: PAT_TA_81808
ctccccggccatcgtcttcatcttggacaaggttgcgcctttcgtccccgcgcccaaggaggagcccaaggccgagcccgaggccgccgccccggnagaggagacnaccacccgcgaggtcgccgttggaggagaaggaggaggaggccgagccntccgccgnaccggnagaagccgngccggtggaggcagccgcgcctgctgctgaggtagtganggaaatt

SEQ ID NO: 81809 - DNA, 612 bp, Triticum aestivum
  unsure (1)..(612): unsure at all n locations
  Clone ID: PAT_TA_81809
aancggnttaaaancaagtacttgggtgagctttcnaaagagganaggtangttnggaataaactatatnggcgtgatggaanaaggaagaattcgaaagaagctttggatgnaatgatgaaccttgaccccactttggaagtagttaaatgtttactagacaagcataatgaggaacaccatcttttcgaggatcttgcatatgaagtcaagcaggttgtgagttacaaagctcattttccggaaaacgattctcaatatgaatgcaggtccttctcacatttaaatgtgcttgcaaaaagaggattgaatgacaaccaaaacttctcttcattgaaatcacatgcacagatggtgaatttgaggagtatgcgcttacttgtctttgggcggttcgtccgatgataatggtgagtgctgtgaatgtggtgatgatgtgaagcatccactggtgtggatacaaaaanggtgaagcaaanccatggtcatgcaaagtgcattacaggctaccagagaacattacaagttatggtgggctgatagatcccngagcgagagcaggtancgatcaggtccactcaatgcatgacagggaatnactncggaacggga

SEQ ID NO: 81810 - DNA, 634 bp, Triticum aestivum
  unsure (1)..(634): unsure at all n locations
  Clone ID: PAT_TA_81810
ctcatgcaactgcccacacgtcctcatcagcaccttcctagtgaatcccaaaggcatcgagatcttgcattcaacctgccgccggttagacatgctgccaaacaattttgatttggcacacagctatgaatattgctttctacaggcgtgtgaggaggactacaaccaagggaaacaggcaatgctgcctgtggaagatccaatcaaggcccacattgtggaacttcccgagacaatgctccgcttgttgcaaggaaattttatttgggaacgcatttcccgggatgtgtttgtgcttngaggaacctgctatcccgaaccaacaaagntctctacatcgtttgccaantggtctcattcaattgtcctataagactgaaattggtgaatgggaaggttaaaacaagttgtcatgacacctcctgggacagctttcaactactggaaattccaactactgggtggactactgagacattatacctgctggtganatgtcatgtgttggccgacgtcanacagatccaatgggacttcttgtncaaccatcancatgctactcancacacaagatgcatcagtgttaactggtataaccatggaaatcattnaggcantacgntcttctangtnt

SEQ ID NO: 81811 - DNA, 642 bp, Triticum aestivum
  unsure (1)..(642): unsure at all n locations
  Clone ID: PAT_TA_81811
agagtttcttccatggtgtgtgtttgatataaaccacaagagagaaggttgagctgtgagagacagccaagaagaaggagaaggcgctgcgaggagaggcagcgttggcatcagagccttgtcaatccgtggctgaggcgacggctgcggcaacaaagacggcgatgcggcggatccatgtgaggtggaggacgtccggcgcgaggttggaggcgtccggcggcgagatgccgctggtggccggtnccggtgtgatgccgctaagaaaggagacggcggtgcgatgctgccacgacgattgtgcgatccctcattaaggaacaccgtgcgacgctgctaagaagatgtacggcgggccatcctcaccccatttntggtgcgatgcccaacgacgggattgngcgatccatcctccatgatggaaantttgtgccaaacccaacaaatattgccgngcgatccacaagatgatgaggcgtgatgnnaacaccccnaagngtgtcaactcaagtggagcntngtanccggacacccatggtacggtctacatggngtntcacacaagatggtcatgcggtggttgcgttcatgctctcacaaaatgncccgtgtntngaattcatagtcatcatanagtcgcat

SEQ ID NO: 81812 - DNA, 500 bp, Triticum aestivum
  unsure (1)..(500): unsure at all n locations
  Clone ID: PAT_TA_81812
cggcacgaggcggcacggcggcgacggcggcggcggctgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaatctcggcgactccgtcaccgtcacgcgcgacaagagcaaggtcaccgtcacctccgacggcgccttctccaagaggtacctcaaanacttggacaaagaatacttngaagaacacaacgtgcggactggttcntgtgatcgcagcaaacaaggacgcaacgtgtacgactcccggtacttcaacatcgctggaaacgagggcgaggaggagatttagaggcattgttatattgtatcttgttgantttgaacttgatcnganactcctantaccaactacctaagttgtctccgttgaacatgatggttattngaagaccttaat

SEQ ID NO: 81813 - DNA, 169 bp, Triticum aestivum
  Clone ID: PAT_TA_81813
tgccgaggtagtacgtacgtgccgtggggcctggctatcccagtatcctgtaatatggttttgaactactactgatctgatggggatgcgaagggctagctatggacactgtaaggcaccggcgatgatgctatgagcgactgatggtctatgaaggaaaaaaaaaaaa

SEQ ID NO: 81814 - DNA, 500 bp, Triticum aestivum
  unsure (1)..(500): unsure at all n locations
  Clone ID: PAT_TA_81814
aaggactggaagggcctccgcgtcaccgtcaagctcaccgtccagaatcgccaggccaaggtgtccgtcgtcccctccgccgcagccctcgtcatcaaggcgctcaaggagcccgagagggaccgcaagaaggtcaagaacatcaagcacaacggcaacatcagcctcgacgacgtcatcgagatcgccaagatcatgaaggtccgctccatggccaaggagatggccggcaccgtcaaaggagatcctccggcacctgcgtcaagcgtccggctgcaccgtccgacggcaaggaccccaaaggatttggcagacggagattcgacgacggcgaggttggagattccccgcttaaagaaggtttggttttgggggaggtttgttaatgttnaggttgctgaataantttnccccctaatccnaaatgcttcccnggatgcaattttnananatggatgtgatgtccttccacttttttcanaccctttgggnagnagaaa

SEQ ID NO: 81815 - DNA, 580 bp, Triticum aestivum
  unsure (1)..(580): unsure at all n locations
  Clone ID: PAT_TA_81815
gttcgttcttcttcttcgagttgggtagtttagctctacccaccagccatgggtaaggagaagactcacatcaacatcgtggtcattggccacgtcgactctggcaagtcgacgaccactggccacctgatctacaagcttgggaggcattgacaagcgtgtcatcgagaggttccgagaaggaagccgctgagatgaacaagaggctttcaaagtacgcgtgggtgctttgacaaagctcnaaggcccgagccgttgagagaggtatcaccatccgatattgctctcctgggaaanttttgagaccaccaaagtactactggcacccgtccatttgatgccccctgggnccaccgttgactttccaatccaaagaacattgatcaccnggtacctcccccaagcttgactggtgctgttcctcnatcnatcgactcccaccactggnggttttttttaaggctnggtacctcccccaaaggacngccaaacaacgttagatgcctcccttggcttttnactccccttgggagttaagcaagatgatttntggctggctngcaacaagatgncgccacca

SEQ ID NO: 81816 - DNA, 534 bp, Triticum aestivum
  unsure (1)..(534): unsure at all n locations
  Clone ID: PAT_TA_81816
gagtcctcggacaccatcgacaacgtcaaggccaagatccaggacaaggagggcatccccccggaccagcagcgcctcatcttcgccggcaagcagctcgaggatggccgtacccttgctgactacaacatccagaaggagtccaccctccacctggtgctccgccttcgcggtggtatgcagatcttccgtgaagaccctggacgggcaagaccatcacgctggaggtggagcctccggacaccatccgacaacgtcaaaggccaaagatccaaggacaaaggagggcatcccccccggaccaagcagcgcctccacttttgcccggcaagcagtccgaggatggcgtacctttgctggacttacaacatcccaagaagganccaccctcccacctgggggtccgctttccntgggtggtatgcaatcttttgtccaaacccttgacgggcaaaccatcacgctggagttggagcctcnggacaccatcngacaacgtgaagnaaagttccaagacaaggagnatccctcccn

SEQ ID NO: 81817 - DNA, 365 bp, Triticum aestivum
  unsure (1)..(365): unsure at all n locations
  Clone ID: PAT_TA_81817
gtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtccgagcaagggtgcgtgtgcgtgtgcgtgtggtttgcttgctccgctctcccatgctctgcccatggtgtccttggtgtgtatgttgtgtgttgcatgtgtccctggtaattgcttcaatctatccccnactatggatggagtgatgaatatgtnaagaatgaaagatttaccct

SEQ ID NO: 81818 - DNA, 542 bp, Triticum aestivum
  unsure (1)..(542): unsure at all n locations
  Clone ID: PAT_TA_81818
cttgaccgttataagggccatgtaaatggggctggcatgaacgtatctaccgactccagcgaggataaggagtcaaacaactcagacgagaagcctagtgaatttacatctgttgagtcggaggacacggtgtcaggtatgctgtatgatatgctgcaaaaggaggtcgttgctctaaggaaggcttgtcatgaaaaggaccaaagcttgaaagacaaggacgacgcaagttgagatgttggctaaagaaagtccgacacttttaacaaaaggcgatggagtccagaggctaaagaagatggagaccgggatggttagctggccatgggaaaaggaggtgggtgggctatggcgatttagagaaagagcaaggattaccaaaggcaaagaagttcccgcanttccgagtgcttcctgccaacagntccacaagtccacctgggaagctctgcctccgagcngttnnaacacgcaacatgttatgctngtatgaanaccctccccngtattagttnaaccatggntcccaagacctccttttt

SEQ ID NO: 81819 - DNA, 482 bp, Triticum aestivum
  unsure (1)..(482): unsure at all n locations
  Clone ID: PAT_TA_81819
gccaaggacaacaagaagagccgcatcgtgcccaggcacctgctgctggccatccgcaacgacnaggagctcgggaggctgctgtccggcgtcacnatcgcccacggcggcgtcatccccaacatcaacccggtgctgctcccnaagaaggccgccgaanaaggctgagaaggccgagaaagaccgccaccaagtccgcccaaagaaggccaccaagtcccccaaagaaggccaccaaaggcgtagttctgggtcccgagcgcccttcccggtngaacttggactggatggtgtcccgttcagcctcccgttttcctnagtgtctcccggtgtttaanttactgttngtgttnttcccanagtgttgtttnaactttgttcctttttgcttttgcccccgccaatgttacccgtttaacgaaagaggaannnccttgcttncctccnggttccnggctaaaacnancccgggttttcccctn

SEQ ID NO: 81820 - DNA, 556 bp, Triticum aestivum
  unsure (1)..(556): unsure at all n locations
  Clone ID: PAT_TA_81820
ggagttcaaactcaaaacgatccgtcggctcactgagattgaagacgattcttatgtcgttgtgcacgttatggatgttaccgatggaatcgtgtacctgcgcactgcctatgacgggtatactgaagttcctcagctgctcctatccttttgtctcgagacagcggagctgaaaaagatctgtgagtatgatcacaagctccatccctacgtcatgggcatgggcctccttctttgggtaaggaagtacatggataagggccccaaatggatctactctgtctaccccnaagctccccgaaaggaagccgattgttgaatgctgggaggtggcccaaccagagcctggcatccggcccccaaaagcaattaatangattcacttttagagactcccngtgagataactgttgggtgtttttttggcnatgccgggtnnnatggatgacccccaagcaatatgttaagggcaataccttttnaaaggtttnaaccccttaaanncccccaaacggggctggtgggaaaccctttnggacccnaatgccccccnttt

SEQ ID NO: 81821 - DNA, 511 bp, Triticum aestivum
  unsure (1)..(511): unsure at all n locations
  Clone ID: PAT_TA_81821
ccgaacccagacccaaaaccaacaccggcggcggctgcagcgatggcggcggcggcgatgaacacggacgtggaggcggtcgacttcgactccgacgacgacgatctcatggacgaggagggtgccatcgaaccctcgccggcccccgctccccgcctccgatctaccatccgcaagggggccggcggcggcgacgacgatgcccccgccgtaaagactaaaggggcgccggcttcccgcgaaggacccccaatccctcccgtcccgccgcaccgccgactccgccggtttagcttggcgcnaagccgctccttggtttccgacgcccttccgccttccccgaatggcggcccttggaccccgttccgctcccaattntaagggttggatttggtactgggttnactnggagtttcaaatgaagaactcccaggaagganggcctcccaataaaattttttccccggaatttatgggccaaggtcaaaaatttcnattttaattttgngtt

SEQ ID NO: 81822 - DNA, 495 bp, Triticum aestivum
  unsure (1)..(495): unsure at all n locations
  Clone ID: PAT_TA_81822
ctgctgctcgtccctgtggcgctcatgctcgcgctgctcgccctcgccttcctcgtccccaaccgtgacgtcgccgccgcccgcggagcgccgtggtctgaccatttcctgcggtgaatcggtcgatgagagagtgtcctcattcgcggaagcagcaaggggagggaccgacgccgatgtggatcgaagatcgatcatgcgcagctaagctctctctccacgagcagtaagtaagcttttgcatccggaatcctcgatgatcgcggtttattatccggggttaattcttcctagaaatattttgaagggtccgatgcgcatctgccaaggaaagaactgaccgtggatnatttttgagccagacgaagattcaattaaggcaaagttacgctcccaaaatgggggncaatttttcnagcaaattnttagagagttttttttncaaacaaggttacaacnttagnggaannttttcccgnanaacccaaaatggaa

SEQ ID NO: 81823 - DNA, 542 bp, Triticum aestivum
  unsure (1)..(542): unsure at all n locations
  Clone ID: PAT_TA_81823
agcggctttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctccgccaaggaacccctttggccaggtgccagctttgccaggatgggtgacttngtacgtcctccgaatccacctggctattttgcaaagtatgcctgcccgccaaagaacaagcccagagctgttnnaagganggcgacatccaaaggagtccaagcaatgggtggatgttttggcncccaagggttgaggccanaccagtaaaaccgncgtccttagncccattttcctttccnagngcccntatncaaacccnanaccntttggggagaccacttggccaaaangggcannttcgacaaccctttttttaaattttaaaaaatngttgggaaagtt

SEQ ID NO: 81824 - DNA, 559 bp, Triticum aestivum
  unsure (1)..(559): unsure at all n locations
  Clone ID: PAT_TA_81824
cggactacaacatccagaaggagtccaccctccacctggttctcaggctccgtggtggtatgcagatatttgtcaagaccctcactggcaagaccatcaccctggaggttgagtcctcagacaccattgacaatgtgaaggccaagatccaggacaaggagggtatcccaccggattcagcagcgtctcatctttgccggcaagcagcttggaggatggcccgcaccctttgccagactacaacatcccaagaagganccactctccacttngggtgctccaagctcccgttggtgggtatgcaagattcttcccgtcaaagaccctccaacaggcaaagaccatcaccccttggaggttttaagcccctccngggacaccatcccgacaaccgttcnaaggcccaagatttccnangaccaagganggatttccccccccnggaccaagcagcgtcctttatcctttccnccccggcaagcagctttttaaggatggccgcacccctttttccngatttacaaacatcccaagaaggatccaacccttccaacctttt

SEQ ID NO: 81825 - DNA, 514 bp, Triticum aestivum
  unsure (1)..(514): unsure at all n locations
  Clone ID: PAT_TA_81825
cgcggacgctgcagctcggcgccatgatcctcgtctggtacctcctcaacatctacttcaacatctacaacaagctggttctgaaagcagtgcccttcccctacaccatcaccaccttccagttcgcatccggctccttcttcatcactctcatgtggctgctcaatctgcatcccaagccaaggctctcccttcaacagtacgcaaagatcctgcctttgggccttaatacacatgatgggcaacgtcttcaccaacatgagtttggggcaaggtggctgtctccttcacgcacaccatcaaaggccatggagccttcttctctgttccgttctcaatcttggctcctccgggcagacaccttcctttactgggcagtangtctcctccgtgccggttntccngtgggagtngtngtttggcatctaangactgaagttccttncaaactgggattggnttttgggagtgccatggcttcccaaaggtttacaaaccatcccccaaatgtttt

SEQ ID NO: 81826 - DNA, 596 bp, Triticum aestivum
  unsure (1)..(596): unsure at all n locations
  Clone ID: PAT_TA_81826
cgagttttttttttttttgtgtttcatccgtagacggatgttgttctcctgtatgatgtagtgatgtattcttgtggcatttgtatgcccttgcatgtatccccagctattatgtaatggnacaatgtaatgatatccaccttgcaaaagtgtcttcaatatgcggctctatcctaggtgggaccttcgagttcctctcaagataggatcacatattgggtcntgacatagctagatggctcttctctcttttgatcttcaatacaatgtcgagatctatttgatgtcacgacttttcgcngtgtgttttttgggatcccgatgaatgcgagttatgatcaagtctctccaatgaanatatttgagctctctaaacacttttagcatgatctttaaaacctcgtatcctctccaggaaactntggttgggttggccaatagattgatttcctgcaacgggaagagggtttgtgataactcgtcttgccgnatatccagtgacagaggaaataccccattatgngcataaggtanaagagggccatccacaaaatnantgcaatannnactctatgatacaattcaaactagaacaa

SEQ ID NO: 81827 - DNA, 645 bp, Triticum aestivum
  unsure (1)..(645): unsure at all n locations
  Clone ID: PAT_TA_81827
cttggttcgggtgcggtgcagagagagagagagccagagaggggaatggaatggggggaaagtatcctatactccaatggattgggtgctccggctgcaccgtacgcagctcatccatcagatacagaatacaaggttaggatgaaacccgaacgccccgctcttanaattttgccaaaaggcgccccacataagcacaaaaggcgcccccgttacttaggtgtgccacagtttgggaacagaaagaacaaaaagcatcaggggctggcggcggtctcgccgtggggctgcgctgccacaccgggtgggaacaantcgctgcaatacggacgtactctgctccgacgtccaacggaanttcnncccaactctgcccgccattatcaacttcgaagcaacccctcnacancaacatcctgcctactccgccatctacgacccngagaaanatccngacctnaacatggnangangatcaatggnaanatgctnaagttcggtanctanaanaatggactgaaatgtgcaaaanttcatgngaagnattcaaaagttgagaagtatcantacaattgccngnaccaaangggttaattnccctnntaaaaattanattgancnccaaantttnttaacccattancc

SEQ ID NO: 81828 - DNA, 304 bp, Triticum aestivum
  unsure (1)..(304): unsure at all n locations
  Clone ID: PAT_TA_81828
aaaaaaccttggatgctgcaaagtgcatggntaactcgctactttgattgcttgcttgattgcattcgttcgtacatacatataatcgtgcttaattaacttgacccgtgatatatttacacgcatatatttcttttatcggtgtattcactggtggctagtatgtttgtaactgatattgattgaagatgccgctttatttcttgtttttatttccattttaagggggtgttcagttcatcatgtattggcatcatgtaacgataacgangtaacganataaacattttctccgtanctaaaa

SEQ ID NO: 81829 - DNA, 245 bp, Triticum aestivum
  Clone ID: PAT_TA_81829
gtacggtcaagtgcgtacgggcgcaagatggtcgtcggcaggcaggctagcaggtacccgtgcgttgtgttagcgtgcatgcacggcatggccgtaggccatagccaatcgtgtttgagttgtcggcatgcttcctttttctgcgtgtagcaataaagagacagagatttcgatcgtcgttgcatctcatcttgatgaactttgtggtgtttactgcttgttggggcacggtcaaaaaaaaaaaa

SEQ ID NO: 81830 - DNA, 649 bp, Triticum aestivum
  unsure (1)..(649): unsure at all n locations
  Clone ID: PAT_TA_81830
gattaccattacaaagnanntcccacaattatcanaaagttttcaagacactcaacatctgacagttactgacaccaacattggcnagtcgactgacaaccatagataagagcaaaaatactgaagacagcatacattttagcatacagtgcgattagcacttgacctctttcagcccatgtgcaaagtacangaaagtggntcagcagctccctccttgtnatacgcgancaccacgccgccatcatcatgcatgctctcgccaacaaagaactgaaggtccttgagcttgctaagaagatactttgtggcggactcaaacattcttcttgganagcatctaggcatccccttcaagcttgggcananaggtcttgatgtagcgcttcatntganagataaacgcttcttgtcaaaagcagttgctcctntaagacggangngtcaacaatgtcaacacttganggcctgncatcaagactcacncacaacacctcagcaaaggattggtccaagtcaataacgcnctttaagaccaaggcacanttccagnnagcgtctcacccttanggacatctcgggggccgtacaatccctaaggnctatccggncatgggctttacgctncngaaccgngtacactacctng

SEQ ID NO: 81831 - DNA, 439 bp, Triticum aestivum
  unsure (1)..(439): unsure at all n locations
  Clone ID: PAT_TA_81831
ggcggccgggtacacgtccaggttcgggctctacttcgnggactacaacgatangctcaagagataccccaagagctccgtgcagtggttcaagancctcctcagctccagttgagatcgagctactatcactttgctaggtcatttttttttaagaaaaaaagcttgctaggtcattcctttgcagctccgtgtgcatgtntgtgactgcatgtatttgtcatccnngtctgttgctgccaagtatgtgttaggatgatatatatacacgtctgggggattcaagagttagaaggtgttgtcctcaatggattggtatacttccacctggtgttccttngggcgttccttccggatatatcacacacaanggcagacttntaccnatgggaattttaatggtntacacacgggtcccggggggttccctggnaattgc

SEQ ID NO: 81832 - DNA, 640 bp, Triticum aestivum
  unsure (1)..(640): unsure at all n locations
  Clone ID: PAT_TA_81832
attcaaacgaaaacaaataagaaaggatatattgattatattacataatcttatttgattttccagtgaagttcaaacttgagaacttattcgagtatttagtgcaaagataattaaatgaagttcccaaaatgcctctgtcggttttagttgcatttgaatttttttatttgggatccttgtacattcaagcagttctgtttcaaaagcaaacaactggagagaagataagatgctgaagcaacaccctaacagtggttgcagtggtctctctctttctctctctctctctctctctctcatctctttccatttgggtgacatccttccttttccttaagcctccgatccgcttcctcctgcaacgaagctgacatgatctccctacatgtgttgccctgtcccctgaanacctctctctccaagntccaatcctttcggtccgggtttaactagctaagatgccttctgcctatatcatcgcataccaatcacggnggtgcaacggaatatttgcataacagtanataaagattctgactgatcnctcatggtacaaataagncantctcatcggtaaaccaagtaagcctattatananaaccgtgttccaaaagacatgatncgaccattntcagc

SEQ ID NO: 81833 - DNA, 381 bp, Triticum aestivum
  unsure (1)..(381): unsure at all n locations
  Clone ID: PAT_TA_81833
tgaaggtgctattcaagccgctctggacaggtccatcatgctgctgctacagcgcaccctgaagccacacggcccgccactatgggcgatgcagaccgccgtgttgctggacctgctgggcctactgggcgcctacgccgccggcagctgcagggactgggagacgtcgccgttgtggtcctcttcatcgcgctgcacgtgctgctgtcattcgacgtcgtatttaagaaggccaagaagctcatgcccaacaagtgctttcaaagtcggatgataatcantgacaagttgaccattgcatagtaacgtcattatttttcaacgggtctgtttgtnttanatagtaacgtcacttttccttgggttggtgttagatcacag

SEQ ID NO: 81834 - DNA, 397 bp, Triticum aestivum
  unsure (1)..(397): unsure at all n locations
  Clone ID: PAT_TA_81834
cgacaggngaagcagggcgtggnggtttgatattcatctaagctactgtcgctgttctaaatctctctcatgtgtatattgttgatgctgctccatctctctttctgttgntgtttgttgcccaagtccagcactatcacgggatgaattgcttctacttttcttctaaaatcttgatgccatgtcttgttttgcataanggntgattgtgttctttntattcttgatcatttttctnaattttttgccctgtgcattcatgtgttctcaaacctgtattctgtctccanagtaacgccnnnacattctcnggactgggtccggcgctcgacgcctctgcngcaactccctgctcncanaggggagattcatcacatactatcgggtttcatcgaga

SEQ ID NO: 81835 - DNA, 586 bp, Triticum aestivum
  unsure (1)..(586): unsure at all n locations
  Clone ID: PAT_TA_81835
gttttttttttttttttttaactctcaacatattctttattttgccttgtttcagaaagaaagataacattgggtcggtaagatttattgagacagactaattcttgaactgtgcgaggccgacccagcccccgacagttccagctaagcattttcatggctcctgacgggcgacatcaagacgcgcccgtcaagttgaccgacagcccccgggtccggttgctacctttggctgaccaagcacccctcccggcatccatccccacgctcccaagaatattggtgtccnacggtccaacctgggactggttaaatttggaccctggaaagcaaatantcctcccaaggcaaccgaaatgccagagttataacccccaagccgtttttggctggcagtttatccnatgcccggattnaagagaacccaaaactaccgcaattggaaatttggcttcccaaaggaaaaanggttttgcaacctgggagcnaaaaagtgaacaanatcccnaactttgncaactaaaaagtagccccctanaacccnaaacttgggttttccccnggaaattccangncttcaaaattn

SEQ ID NO: 81836 - DNA, 565 bp, Triticum aestivum
  unsure (1)..(565): unsure at all n locations
  Clone ID: PAT_TA_81836
ggagaagagagttgtgagaggcaactcgaggtagaagaaggagcggcgctgcgaggaggcggcgccaacaattggcatcagagctttgttgatccgtggcggcgacgacggtgccggtggctatggtggccggcgttggcgcctgggcgcgaggtgatggctggcagcggcgcgatgccgccgggcggccggttngcggtgcgatgccgccgagatgaaggtggtgccatgattcggcgtcccccaaggacctccatccaccggacaaagatggtcccgttnngtgacccggcgcttccnacngcgtcccgttntttgcgccnaccgactttcaatgcccaanattgggaggcccgaacngngccaagaaaggaggatttggttggccaatgcccgtgccnnctaatgtttnaaanaattggcggttgccaaaactttccaacaanaaagatcccaccntttatcccaacaacggnnggtttttaccncacccccacanccngggaaaatttggngnnttaacccccaaaaaattttcgggngaaanccccnttttgaaaaaacg

SEQ ID NO: 81837 - DNA, 605 bp, Triticum aestivum
  unsure (1)..(605): unsure at all n locations
  Clone ID: PAT_TA_81837
ccacaactgactgaatttcagttactttgacatcaagatcatagaatttttgttccatgattctttccaggctctcctgattttgagtcagggtggccaaccccttctcaatcctcagtgatgatgctaacaagtaaccaagctgctcctgcttattcttcaagaaagtactcaagatgcctcctcttggagttggcatcttgggcagccttctctttcccttggccctctcccttccttctccttgggagcttggtactggatgatggttcattcctccattccaaccgaaaaactttggattggtccctccaaaagtcctgggataagaagagcaaaagtgttccctttatcccaaactgggatactttcccctnatggccccatccttttgggagtttaatccaactcccctggaaccctatggggagcatatcccacactcccttttttcccaagcccggctggcanccctcccttggatagtttccaacccgttaggtccaagacctttgatttcccggggggcacatccaaaatggtgaagcaagttattggcatgcctccggattaaggtggnggcaacctgattnggggtaaaaaag

SEQ ID NO: 81838 - DNA, 506 bp, Triticum aestivum
  unsure (1)..(506): unsure at all n locations
  Clone ID: PAT_TA_81838
aaccaatccaccaagcaaacccgatggcccgcacgaagcagacggcgaggaagtccaccggcggcaaggcgccgcggaagcagctggccaccaaggcggcgcgcaagtcggccccggccacgggcggcgtgaagaagncgcaccgcttccgcccgggcaccgtggcgctccgggagatncgcaagtaccagaagagcacggagctgctcatccgcaagctgcccttccagcgcctccgtccgggagatcgcgcaggacttcaagaccgacctcccgcttccaagagctccgccgtctccgcgctgcaggaggccgccgaggcgtacctccgtcgggtcttcnaggacaccaactctgcgccatccacgccangcgcgtcacatcatgccaaggacatccaantcgcaagangcatccngggcnagagggctaagatatgtctgctctctgcnntgtcagataacangcgttntcgtganggangatccgtntcgtgcaagtgggtg

SEQ ID NO: 81839 - DNA, 436 bp, Triticum aestivum
  unsure (1)..(436): unsure at all n locations
  Clone ID: PAT_TA_81839
ggaaatagagaagtccttgaagcaggtgaaagaaactttaataggtttggtggatggttgggcaagtactcaaccactaacaaaaacaaaaggctactggaagatgtccatagtcatattcttgcatcacagcaagctaatttggatagggaaggcgtttgaggctccgattatctcactcttctccttngagacaagtttgactgggcccaactggaaagacaaatgcccgaaaggaggaagctgtccccaaaaggtggttggaagttttaatgggatacctaactcccttttaagcccaggaaagacttttngacacnctttgtttgaatttaacccnaaatttttaaagggcaatcccnaatcccccnaagggattgggaatttccaaaccaaaccttgttttnaaaantgcccnttttnaccaaaggnaatt

SEQ ID NO: 81840 - DNA, 386 bp, Triticum aestivum
  unsure (1)..(386): unsure at all n locations
  Clone ID: PAT_TA_81840
cctcaacctcgacttccagctgcaggagggcgggcgcaagctcaaggtggacgcctggttcggcacccgcaagaccatggccgccatccgcaccgccatctcccacgtccagaacctcatcacgggggtcaccaagggcttccgctacaagatgcgcttccgtggtacgcccacttccccatcaaacgcctccatcaccgccgccaaaccgccggcatccgaagatttaaggaacttccctcccggcgaagaaagaaggttgaggaaanggttggacattgctcccgaccggggtcnaccatcccttgcggtccccgagaaagtcccaaggatgaaattttngtccctcccnaacggcaacgacattcagcttncgttctcccccg

SEQ ID NO: 81841 - DNA, 545 bp, Triticum aestivum
  unsure (1)..(545): unsure at all n locations
  Clone ID: PAT_TA_81841
gcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaaggaggcggcccgaggcgtacctccgtccgggctgttcgaaggacaccaacctggtgcgccatccacgccaagccgcgtcnaccatcatgcccaaaggacatccaagctcnccccggccgcatcccgttggcgaagagggcctaagctgtcctctcccgtnnaacgacgtatggtttcggattaanttgatcccgttggnaatttgtccccaaattgctgttccaaggccctnaactttttgngttanaaaaatatggttttaagnntnaagttaagacaaccacttgaaattnatgtcccctttngggtttnccaatnaacaaacttttcccaattttnaaaaccnnaaaaaccanttttttt

SEQ ID NO: 81842 - DNA, 322 bp, Triticum aestivum
  unsure (1)..(322): unsure at all n locations
  Clone ID: PAT_TA_81842
cccatctccagcctgccccctcccccagtccccaaatccgtagtcccgcgcgccgcgatggaggcgagcaagctcaaggcggccaggctcctggagcagatgagcgcccacctcgccaccgacgccggcaaggagatcgccaacaaggtccggcttccgtctaccagctcaaacatctccgcccaaagaaagatgggcgtttgacgangaagattttcctccgtnggacctcaaagaaagggcgccgtcctccaacaagggaaattacgaggggaacccccnggacgncggctttnaaccttttaaccgnacgaaaatttcc

SEQ ID NO: 81843 - DNA, 437 bp, Triticum aestivum
  unsure (1)..(437): unsure at all n locations
  Clone ID: PAT_TA_81843
gttgttgatggatctgtttccttcagcacttcgcagagtcattcatcctccaatatagaggatacaccacgtagtgagagctttgtattagaggcacctgaggtggtaggactgtcaaataaagaggaaggtagtcatgattctacattacagaacacaaattctgatgctaatgttaagtgaaagttgccgtcttcaagaatctggaacaagcttttgacctcctaaaagaaacaagaggaagatgggaaaaagggatgccgttaagtagcgcacctttggatatacctgttcnatccttccaagaactactggttgcctgccctttctcnatgatccttccngttcccccaatggcnaactttcnngcccctgntccctgctccctgaattttccccctgaaacctnanttaaagaaccctgccaaanaaatttc

SEQ ID NO: 81844 - DNA, 575 bp, Triticum aestivum
  unsure (1)..(575): unsure at all n locations
  Clone ID: PAT_TA_81844
cttggacgtattccatctgctgtgggatacnaaccaacncttgccaccgatcttggnggactgcaagagcggattacgacgacaaagaagggttcnattacatctgtccaaggctatttatgtgcctgctgatgatttgacggatcctgctcctggctaccacctttgcccatccttggacgctactactgtgttgtccacgacnagattccctgagctggggcattttccctggctgtccgattctttttgggactcccacatcccaagaatgttttcttccccccaacgttcctgggtgttgggatntaactaacaacactgccccgtnngtgtcccannaaggttccttccnaaaaacttatnagncccttcccnagtatcaattgcattttttggggnaatggnttagctccaaatttgangatgataagatacggttgcncccctgcnaggaaattccaaaagttcccctagcanccttttccaaagttgcccagttttccnacgggggcnccccaggaattggtggatcctttaagggggggttcnaatttccccaaggggtttttttg

SEQ ID NO: 81845 - DNA, 440 bp, Triticum aestivum
  unsure (1)..(440): unsure at all n locations
  Clone ID: PAT_TA_81845
taccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtccgacgtctgcgacgacgcccaccccaaagtgccccnaagggctgctccngcgttcccgcctnggtgtccnacgagcccccgaaatgttngcgctgcccccggattatnaaatcccaaccgtttcaacggaaccttgccggttggccccttgccaagaagttactggatttngggtccaaatgcccaagcaataatatgtttccccccccttnaaaattgaaattaaagcccccnanaacaaaatnaacaaagtttaa

SEQ ID NO: 81846 - DNA, 491 bp, Triticum aestivum
  unsure (1)..(491): unsure at all n locations
  Clone ID: PAT_TA_81846
gaagaagtggagcaagggcaagcaaaaggagaaggtgaacaacgcggtgctgttcgaccaggccacctacgacaagctgctcaccgaggtgcccaagtacaagcagatcacgccctccgtcctctccgagcgcctcaggatcaacgggtctctggctcgcagggctatcaaggatatttgagaaaggggggctcatcaaggatggtctcaatccactcccagccaagcaagatcttcaccaagggcgacaaacacctggatttaatcatcatcatgtgttctgtgtcctgtttttaatcccaagttagactgaggtggttgctggttatattccaantcaactatgtcccaagggggggcacactgttcccaccaattaatggttttaattgccttttggattttttgggtacacttttnagattccttttttgtccaagcgccaattgaatcctacctttanatattgcccgtatngctttaaaaaaccc

SEQ ID NO: 81847 - DNA, 492 bp, Triticum aestivum
  unsure (1)..(492): unsure at all n locations
  Clone ID: PAT_TA_81847
gctggtgctgcggatcgcggtgctgtgcacggccaagtcccccaaggacaggccgaccatgcgcgacgtggtgaccatgctcgcggaggccaagccgcgccggaaagagcagcagcgccaccgtggtcgccaccgtccgtccacaaggacaagccggtgtttaagcacgtccgcccggactcccggttacctgttagttaatttacctggtttatcacgtacccgggangctcccggagaaccttgacccaaattccnagcgaccgtttaatgtttttggtataccgttatatcccctanctccaatgttanncctaactacaacgntnnttttttttcccacantagtttttttnatttttnggggttaaaattttnggttttaaaatttttngggggccnaanccnaaggaaccaaattgttaacaatggttttaaaccttnaattttttttaggatttttaaggatttgggccccccttttnaaaattt

SEQ ID NO: 81848 - DNA, 425 bp, Triticum aestivum
  unsure (1)..(425): unsure at all n locations
  Clone ID: PAT_TA_81848
gtccaatccacctctcgcaactgtatattcacatcatgcaagaaacagagcagggttaaagctagcactacgtcggctgttcttcagaagctaacaaacagctacttgctggttaagccctacgcccaccacactaccttcaaagctgcacggccttgcgacagagctcatgaatgccttcatgacctccgtnggaggcatctctcctgggagcaaagcacatggcgtactcccatgatncgccggcatcngcaaaggcaagcatgatctccccanccatccgctggcttgccaaagcccgattccctccccttggggacattcgttccaaggactcccncctggaagatttgatgtngctnaagggtatgcccnagttggaacctnnnaaaccggaattccccgccccggggggtnttacagca

SEQ ID NO: 81849 - DNA, 480 bp, Triticum aestivum
  unsure (1)..(480): unsure at all n locations
  Clone ID: PAT_TA_81849
ccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcaagcgccgccgcccaggtcgccgccgtggtccgtcctccggcgtggcgcctgaagaacaaggcggggcattccaggtggccgcccgggcagtcccggcgaagggctgcagctgcggcgacaactgcaagtgcaaaccccctgcaaactgttaanctgcatgcaatcccgtacgtaacgtgtgtttgggggttaagaagtaatacgntgaaataaacaagggtccnaatcctgaatgaagtccaaagnaagggtncnttttccgtttncctttggnttggctttgctcngctcctccccaaagctcctgcccaatggggtcccttggnggtnaaatgt

SEQ ID NO: 81850 - DNA, 386 bp, Triticum aestivum
  unsure (1)..(386): unsure at all n locations
  Clone ID: PAT_TA_81850
cgcagacgatccgccacatgatcgaggacgactgcgccgacaacggcatcccgctccccaacgtcaactccaagatcctctccaaggtcatcgagtactgcaacaagcacgtccaggccaagcccgccgatggggctgccgccggagccggagccggagcctcggacgccgcccccgccgcccccgccgaaggacctcaaagaactggggacgcccgagttcgtcaaaggtccgaccaaggccaccctctttcgacctcatccttggcttgccaaactaccttgaacatcaaagggctgcctggaccttaccttgccaaactgttgcctgacattattcaaagggcaaaacccccanaggaatttcgcnaaccntttaaatcaaat

SEQ ID NO: 81851 - DNA, 632 bp, Triticum aestivum
  unsure (1)..(632): unsure at all n locations
  Clone ID: PAT_TA_81851
gctgagcctgatgtttgctcggagggtttgtctgggttaaagttctcctttggactaactccaaatgacaagaaagaagaatctgatggtactgataaaggagaaattagacaaatagcagaaaagatggacagaatagtatcatttgatcatccggtgcagtcaaatgatgacaaggcagcatatgaatcaccgtgctccgacgacaggaacagccaagggtccaaatatgttaagaggagtgctgtgcccgtttaggaaaaactaatctccttgtttgaagagattngaaaagagagagagtcctacattgattgttcaaccccaactgggtccttggggtgatcatacagtgaaantgataccctcccaccatttgggcaaganaanccgcacatatgaaaggactnccaacatggatgagatgacancccaaccattttggtgcggaccatgatatttataagttgtaacnccgtttacaaactagagatgatccgaatcttaaccaaaaggganaaaganatncncggccaaattccgaaccccgtaaacnagtgtagacccaggaaactgccttacaaatttcagcttgccgtctcggtagaacaataagagntttncttaagttg

SEQ ID NO: 81852 - DNA, 513 bp, Triticum aestivum
  unsure (1)..(513): unsure at all n locations
  Clone ID: PAT_TA_81852
tccaaatcttgtgatggcctataatggatggagatcaggagagatgagatatggcgaatcgccaactgctcccatcaccagatcagcgtcaaattatcatggagcaactacctatggtacaacacattaccctcatccgggtagcgatcacacgttgcctctcttccgagcccaagctagacctaaatcaaatggcgacagtagactcatcgtcggcgagtacgaactggatgatgtggccttngagctgaactatgatcccacctgggttaaacatgatgtccatgctccctgggcatatcatctatatggatgccacacgaaccgcggtgtgtttaatctccatgcatatattggattgtgattgattggtgatggatgctggctactantantnatttgtncagacataagcgcactatggcatggtttcaagaatatataaagttcctggacccaaaaaaaanananaaaaaaanccagggggggccgtaccaattcgcctanaagggc

SEQ ID NO: 81853 - DNA, 347 bp, Triticum aestivum
  unsure (1)..(347): unsure at all n locations
  Clone ID: PAT_TA_81853
ctccagcccagccaaacttttctcaccttcgaagaagaagcagcagcatccatggcccccaaggctgctgagaagaagccagtggagaagacccccgcgggcaagaagcccaaggcggagaagaaggtgccggcgtccaaggagggcggcgnagnaatnggggaagaagaaggccaagaaaagcgtggagacgtacaagatctacatcttcaaggtgctcaagcaggtgcaccccgacatcggatntncctccaagncatttcatcatgaatcccttcatcaacgacatcttnganaantcgccggtgaatccgccnagttcgggggctnaaacnaagagccaccat

SEQ ID NO: 81854 - DNA, 623 bp, Triticum aestivum
  unsure (1)..(623): unsure at all n locations
  Clone ID: PAT_TA_81854
ccacggaaccaagatgctgggttggctgaactcccagccactgttgctgcactgaagaaccccaactcaaaaatcctttatgaccagtacaaccatgaaagatatcctcctggagatcccagcaagcgtgcctttgcctactttgttctgagtggtgggagattcgtatatgcatcactgctgcgtctccttgtcttgaagtttgtcttgagcatgtcagcaagtaaggatgttcttgcacttgcttcccttggaggttgatctatccagcattgaacccggcagcacagtgactgtcaagtggcgtgggaaagcatcttcatcaaggcgacggacagacgatgacatcaagctggccaacagcgtggatgttgcatccctgcgccaccaagagcaagacctgagcattgaaagaccaagagtggtggtggtattggtgccgcatcactgggtggatcccctcccaatccgggaattnggggtggtctgcgngcatggtccataagacatcctgganatccgaaggcctgcccgtaaactnaggggcacaagttctgaaaacagtgnnaagnaggcaacatctacacaatttccaagggatccgtccgnattgttaggnagnt

SEQ ID NO: 81855 - DNA, 640 bp, Triticum aestivum
  unsure (1)..(640): unsure at all n locations
  Clone ID: PAT_TA_81855
caccagaccgaccgcacagttgaagtgagatctgcgctaagggttcatcagcaaccatgaagagcaccaagctcgcggcgatcctgatcctccaggccgtcctggtcatggggatcctctcacacgtgaacgccgactatttccccaagtgctgcaacaactgcaggtccttctcgggggtcgacgtctgcgacgacgcccacccccagtgccccaagggctgctcggcctgccgcgtggtgacgccgagcctcacaagacgttccgggtgcgccgacatgaagagaccgtccgatggcacctgcggcggncatgcaagaanactgatccgttcaanggttcaaggtcaagacgagtgtgccgcctaaaataaantcaanatgagatgagcatcatggtgcctagctggtgtgtgggccgtgctatacggcaacatattatactgctatcgtccttcctgggcaatgttttctcctcccanggggggcccgtaccaattcncctatatgatcnatacgcgcgtnatggcgtcgttaaactctgacggaaacctgggtaccaantatccctganaatcccttccactgggtatacaaaggcgacgttgcctcaagttnanctatggangacncttcggatn

SEQ ID NO: 81856 - DNA, 530 bp, Triticum aestivum
  unsure (1)..(530): unsure at all n locations
  Clone ID: PAT_TA_81856
gcatcatcaagcacaccatggagatcatccacctcctcaccgacgccaaccccatccagatcatcgttgatgccatcatcaacagtggtccacgtgaggatgctacccgtattgggtctgctggtgttgtgaggaggcaggctgtggatatctcccccctgaggagggtgaaccaggctatctaccttctgaccactgggtgccaggggagagcgcttcnaggaacgtcaaagaccattgctggagtncttggctgatgagttgatcaatgctgccaaagggtcancccaacagttatgccatcnaagaagaagacgagttgagcgtttgcccaaggtaaccgtttagatggtgtnacctgaggcccccttttgggtgggaattttgaatgaagtgttttacaagtacctagacggttttactagcttanttttanggatgaatttccagttatggnaagacngcctgagnttncttgggaacatccgtcaaactattggtagttatgccagtgtcgtaaaaaaaaaaaa

SEQ ID NO: 81857 - DNA, 520 bp, Triticum aestivum
  unsure (1)..(520): unsure at all n locations
  Clone ID: PAT_TA_81857
gcagcatgtctgcataggtttagctgctaccagttgcaaatcaactaatcaagtacgaacgaggttaagcatgaggctacttttgtgtttctgcatctgccttgtcctcctcctcgccggctcctcccccgatcccttctccgagcgctgcccgctgcggcaccgccggcagctccaggacgtcgtccgttaggctgcaggcggcgagcaccgcggttgcagcacggccgcggcaagaagggatcgccgatccggctatgagactccaagaggtcanccggggggattcaacctcaagacaccgctgatcgatctttgggtgtccatccatagcagacatgagaaancacanccaccccatggttcntcaaacagccaagcananttcccgaacngncccttatgacacactagcgtacagtgatagtaccatcggttcaagtaacttcgttggcgacaaagagagtattatatcncaataaggcaaatttacaaaaggnctttacccaaaaaaaaaaaa

SEQ ID NO: 81858 - DNA, 462 bp, Triticum aestivum
  unsure (1)..(462): unsure at all n locations
  Clone ID: PAT_TA_81858
ggcgccgccatcatctacaacaagaagcaggcgtgggacgaccactggatcttctgggtgggtccgttcatcggcgcggcgctggcggccatctaccacgtggtggtgatcagggccatccccttcaagagccgcgactagtccaccaatcaaccagctgcatgcggatggaatcttatcgctgttcatcgtcggtcgatcgatcatgtggtggggtggnttgctccgccgcgcgcgtaggacgtgggttcatgtctccggcgcgcacgctgtgatcatctatatctaccgtgctgtcctctctccttcggtgttgtncctgtcggcagcncactgttcaanccncganttccataccccctggtgacttcccttccttttgattgcacgccgtttaaggacctgcatatgtatgttaattacattatgaaggacacgatcnatttattnaaaaaaaaaaaa

SEQ ID NO: 81859 - DNA, 637 bp, Triticum aestivum
  unsure (1)..(637): unsure at all n locations
  Clone ID: PAT_TA_81859
aaaccgaatcagaaatctcaagctcagcacagcaacaatggccgagcagaccttcatcatgatcaagcctgacngcgtccagaggggcctcatcggcgaggtcatcagccgcttcgagaagaagggcttctacctcaaaggtctgaagctccagaacgtgganaagtcgttcgccgagcagcactactccgatctgtcctccaagcccttcttcgctgggctcgtggagtacatcgtctccggcccggtcgtcgctatggtctggganggcaaaagcgtcgtcgccactggacgcangatcattggcgccaccaancccctggnctctgagcccggcaccatccgtggtgactttgccgtcacatcngnaaggaacgtcatccatggaagnactcantttannagtgcangaaaggaatcgcctgtggttcctganggcattgcanagtggagggcaacagcaaactgcttanaggctaaaatgttcanaatggttgatgaagttnttagatnacanactatcntggtggtaaantttncatttacctggaactttgtgttacngaataccctggnngaaaaaaangnaacaaaaatccggaaagggggcngtcnattcnnaaggtntttacncnca

SEQ ID NO: 81860 - DNA, 223 bp, Triticum aestivum
  unsure (1)..(223): unsure at all n locations
  Clone ID: PAT_TA_81860
ctacantcatcattgnttgcanccgttananttcgncacctgtnanggacanatgctgcaaancgctgggggactaagcttcagtcgttttgtgtcggncttgnggggtcacctgatctgaaagccncaantgnggtncccaattanctggggaccatgnaccacgncttcaccttcactgtncangacggcattgatgcaattgaggatgtgatttatcaca

SEQ ID NO: 81861 - DNA, 406 bp, Triticum aestivum
  unsure (1)..(406): unsure at all n locations
  Clone ID: PAT_TA_81861
aaaagattgagtgggatggttatagtaaggggcgaaccaagtgcttgcgcgaagaagcgaatcaatcagaatggagacaaggaaaggaatcgaggcccggcccggtagcgatgcctctcacgcggatgggagttacttttctttatcaccgtaagcgttacgaaatggacccgcattcccctttgcttttcttttgcaactaagcttaaaagaaacatagnagtctttcaagccattagaaaactcattaagtgctctgttgagtgaatgcctgttgagaagcttangtcatacatttccagctaattagaatacaaccatgaaggtggggttcgaatgccatacaactatttattctggtaagtaggattgggatgtnatccctttttaatggaaaaaaaaaaaa

SEQ ID NO: 81862 - DNA, 349 bp, Triticum aestivum
  unsure (1)..(349): unsure at all n locations
  Clone ID: PAT_TA_81862
agttcccggngtcgctcangaacacggccacgggcatgatggccatgatcgtcncgcttgggttctacctgngcaccgccctcatcaatgtcntccagcgcgccaccgcctggctgccggncaacatgaacgngtctaagctggagaacctctactggctgctcaccgtgctcgtcgccgtcaatttcgggtgcttccttacgtgcgccaaagctgtacacntaccaggaacatcnncatgtaagctcaagctcagaacgcaacactcgttgatccacatgcatggngtgtgtnctttgttgaaatatanggtgggctttggccatctaacnntttcagganaaaccgt

SEQ ID NO: 81863 - DNA, 491 bp, Triticum aestivum
  unsure (1)..(491): unsure at all n locations
  Clone ID: PAT_TA_81863
gcggcaacgtcagctccgattcgccggcgacgcgcgcggcaggatggctccgtacctgctgagatccgccgtcgccatccttcgcggatctaccccgccgtcgaccttcctccgccgctctcccatcgacagctcccggttcttcgcctcgggtggagctgtgagggtcgaacccgcaaaggcgtgctgcatggcctgcactgaaatggaggcggacctggagatggtagctgtgaacacgcgtctgcgtgcgttggaagaaaagcttgacatcctggaagaacatgagagacggttccagcgcancgagcggttccagaagaaactggcgtgcgtccttantcccgccacatcgccttgtatgtgtttggtccanagaagaangcaanggagaatccgacatctacttcgtccatgagatcaactaaggtgcaattggaaggaggatttctggtgaagggangtcctttaacgtaaangttgctgggtta

SEQ ID NO: 81864 - DNA, 512 bp, Triticum aestivum
  unsure (1)..(512): unsure at all n locations
  Clone ID: PAT_TA_81864
caacaaccaagccaatctcgccggagaaagaagcgtcgacgatgtccggccgcggcaagggagggaaggggctgggcaagggcggcgccaagcgccaccggaaggtgctccgcgacaacatccanggcatcaccaagccggcgatccgccgtctggctcgccggggcggcgtnaagcgcatctcggggctcatctacnaggagacccgcggcgtgctcaagatcttcctgnagaacgtcatccgcgacgcggtcacctacaccgagcacgcccgccgcaagacggtcaccgccatggacgtcgtctacgccctcaagcgccanggncgcaccctctacggattcggcggctaggcacgcgaatcgatcccccancaccatanttgtgctcgtactagctatggctgntanatgggcntcggtgtatggctgatctcctgctgtagtcctggncttacngttgntgcttggtgtatnnccngggataatggaattnagtggncaccttnaaaa

SEQ ID NO: 81865 - DNA, 445 bp, Triticum aestivum
  unsure (1)..(445): unsure at all n locations
  Clone ID: PAT_TA_81865
tgtcagagaggctcacccagatttgcgccgagggtcaggcgtggatacgcgtcgccaagagccacgaggcagtcgctgcgggcctccaagctacactcgaccagcttctgcaatccccttgcgctgccgtggccgccaccggagcggatggagacggcgacgccgaggacgcgcggtcctgctgtttcgagacccccgccggcgacgacgctgcggcatccaaggcgtcggcggcggcgtgcanggcttgcggcganggcgagtcgtgcgtgttgctgctgccgtgcaggcacctgtgcctctgcancgcgtgcgacgccgccgtggacacttgcccgtttgcgcgacaaccatgaacgcgtcgctccatgtcctgctctcgtgattgaaggaacaantggccgcctcccaaaacggtttgcgacaggaaantagcaagcctcag

SEQ ID NO: 81866 - DNA, 611 bp, Triticum aestivum
  unsure (1)..(611): unsure at all n locations
  Clone ID: PAT_TA_81866
caaatccccaaccaatctcgtctccgatcgactccaggctcgtcgaatccccaccgcctcaagatgcagatctttgtgaaaacactgacaggcaagaccatcacccttgaggttgagtcgtctgacaccatcgacaatgtcaaggccaagatccaggacaaggagggcattcctccggaccagcagcgtctcatcttcgctggcaagcagctggaggatggccgtaccctcgctgactacaacatccagaaggagtccaccctccaccttgtcctgcgtctgcgtggtggcatgcagatattcgtgaagaccctcactggcaagaccatcaccctggaggtcgagagctccgacaccattgacaacgtcaaggccaagatcaggacaaggagggcattcccccgggaccagcagcgccttatctttgctggcaagcagtggaggatggtcgcacctggccgactacaacatcaaaaggagtcaacctcaactggtgctgcgtcncgtgtggatgcagatctcgtgaagacctcacgggnagacattacctgaggtganactcnaacatngcaattcagntaagtcaagacaggaggatcccggcanaagcn

SEQ ID NO: 81867 - DNA, 414 bp, Triticum aestivum
  unsure (1)..(414): unsure at all n locations
  Clone ID: PAT_TA_81867
gtgataatgccttgagtggtgtgatctgaattctggcaactaaggcaagcanaacaagatattanaatgttcaatccaatccaactggttgtcattggatnaagagtgtgactgaaacaatggatttcacggtgaggnttngggtnaangagattnaatggtaatttgtgngtttnncactnaaagaaacatagaatgggtaatgttgcaattcccggcaactttnaaacaacnctgttccctgaaacaaacatgcggaagtgnagggaattgggtcaaaaggttctcacacaaatgtgcttgctggtgttttgcncnaaaccctgtttggttgttnccnaanttgatnaangccctaancccctnatttccnctttaaccngnnaaatttttggnacccctatanggtatacc

SEQ ID NO: 81868 - DNA, 602 bp, Triticum aestivum
  unsure (1)..(602): unsure at all n locations
  Clone ID: PAT_TA_81868
ccaggagtgaactaaactcgtccgacagtgttctacggttcgccgcaacttcgtaggccggttttccacttgaggatcaaggtaactctctatgtaattccagagcagaggtttataaggtcggagtctagagtttacgcataccgttgcatcaatattgttgcatcatggtcaattctcttggacagatagctgaggccattgcataatttcagagaattggaatggagccgagcaaccctggttcattgtaactggtgtttgcttcacatcgaatcattgaaggagtatgatgctgctttggaaggaggcttttctcaatctgtgttgctttcggagcgangctggggccacatcacactattgtcgctcgcctgcctgtgcctgggacgtgttattgaagccttcacatgctacaganggacagtcatgaaagctcaggtttaagctctaacaagtattgaagtgtcaangnaagtcaacctaatgatagttntggagtcataatttttggtccttcgttagtgtagaagnaattggctctanatggcaaacnaancangtctcaantggtcannatggggaatanaaccagtctcntt

SEQ ID NO: 81869 - DNA, 567 bp, Triticum aestivum
  unsure (1)..(567): unsure at all n locations
  Clone ID: PAT_TA_81869
atcatgtcggngccccacgtncaggagcttcaaggcaacaggggcaataagctttgacaacaacacattcaatgagtttcttcccaaatctgaaactanttggctctaaattgtaatccccttganaaagttagagnatttatggactggnttatggatgttgcaaatttgattgcagcagggacgagcaangaaagtgcagtgctcaccgttgatagatatattcagggaaacatcanatttcagtgagaatgaacatgacaagcanggagcttcatgcatcattgggatctgacaattgtttactactgtgaattgttaantttcttggaganactaaccgtagctcctatnatgcccatggtgaaaanaccaaattgtngtgcnttcttggattcaggtcttcnatccaaaanggcgcttgcatcngcaagcgcaattnagnattcntgctgantcctagccnaggaccctncnaccggggantaatatttccgnggncccaattngncnacctaaggttgccccgtaaaaaccaaanantaaagggnttcgaaaatcccctta

SEQ ID NO: 81870 - DNA, 227 bp, Triticum aestivum
  unsure (1)..(227): unsure at all n locations
  Clone ID: PAT_TA_81870
aatatcaccatcgtccaaaaatcatttccaggatcaacacgatatctgcaattagataaaagaaagtgcacagcttccttgtgcgaaccaagcgaaggaagcggtggctggcaatttcctgtaaagaccgctgaangaagatgttgacttcagatgggaaaagggaacacgattggntgccgtgtgacataaagtacactttatgtccttttcttttcgtgtcacta

SEQ ID NO: 81871 - DNA, 355 bp, Triticum aestivum
  Clone ID: PAT_TA_81871
gacaacccggcgctccggccgtccatggccgacgtggtccggaccctggagcagatctcggccgccgggagacgatccgacggcgtaaccaagccgtgagcggcgcgtgcggggtgatgaggagatagagacgatcgatgcctcgacccgatcgacgtggcgagcatcgtgaccgtaggatgctgtgtcatggagcgaatcctcctcccacccgcaaagcaaagcaattgggtttggtgaggagaagaaagcaaataaaaatggttggtttcgacagagacttgccctgagaaaactgaaattattaggctctcatagtaggattataaataaatttttgtgcaaaaaaaaaaaa

SEQ ID NO: 81872 - DNA, 625 bp, Triticum aestivum
  unsure (1)..(625): unsure at all n locations
  Clone ID: PAT_TA_81872
aaggtgatagccctgttcattcgttcccatggttcgatccttcccagtaaaacgcggcgtgttcgaatgatgatcgcttttacgcgagaaagggggaccaccctctaagcctaagtattcctcaatgaccgatagcgtacaagtaccgtgagggaaaggtgaaaagaaccccaatcggggagtgcaatagagaacctgagatccgatgcgaacaatcagtcgaaggagcggagcgcgggcgcactcactctaacggcgtacctttcgcatgatgggtcagcgaggaaatgggaacagcggcttaagccattangtgtaggcgcttccaaaggtggaagatttacgttcttcctanttgacccgaaaccgtcgatctaaccatgagcaagttgaagagantctaacaggcttggaggaccgaaccacgtatgtgggnaaatacgggatgactgtggtanggtgaaaggcaaccaagatcgntanactggtttcccgaatcaatnaattaacctatattcatggccaggaaacaccaatggctaaggggnccaattcgnttaaaaccaaggaatccgataaggctcactagnaaaanangatggngnaancaaancgaggaaaacca

SEQ ID NO: 81873 - DNA, 354 bp, Triticum aestivum
  unsure (1)..(354): unsure at all n locations
  Clone ID: PAT_TA_81873
cttaatatgacaaatctttggcttcatgggaaggaacatatagccgcttcattctctcaagctgaacagagctcagaagcagtcgagacttctagaaaatcatttgggcagaggagtcgaagttcccctgttcctgatgatgactgcangctggtcctaggacttggaccaatgccaaatctgtattccgctgatagccaatcatccggtggcaacaaagttaaattatctggaattttgttcacccaacattgtactgcaagtgatcctgggttactgggtggggacttcaagaggcagctcaaagaaatttgcagtccacaacactgcctgggccgcaaggagcattcacaa

SEQ ID NO: 81874 - DNA, 646 bp, Triticum aestivum
  unsure (1)..(646): unsure at all n locations
  Clone ID: PAT_TA_81874
cagcgccagcgccgcatcctcaagcagcgcctcaaggtgcccccggcactccaccagttcacccgcaccctcgacaagaaccttgcaacaaacttgttcaagatgcttcttaagtaccggcctgaagacaaagctgccaagaaggagaggcttctaaagagggcccaggctgaagctgaagggaagactgttgaggccaagaagccaatagttgttaagtatggccttaaccatgttacctacctaatcgagcagagtaaagcccagctggttgtcatagctcatgatgttgatccgattgagctggttgtgtggctccctgctctttgcaggaaaatggaggtcccttactgcattgtcaagggaaaatctcgccttggatcgattgttcacaagaagactgcctctgttctgtgcctgaccacagtgaagaatgaggataagcttgagttcacaagatcntgaagctattaaggngaactnaacgacaaattgatgaggtaagaagaantgggtgnggtgtatgggctcaaatccaagcgaagacaaggcaaggaaagctatccaaaggaggtccacgganacaattanatgtaacatacatgcnacttatantnaacancgtgcgttgctagttgaanatttt

SEQ ID NO: 81875 - DNA, 279 bp, Triticum aestivum
  Clone ID: PAT_TA_81875
caggagcgaccctccctcggccgagctgccaccgtgaaagctttggtaacttacaagagtactccttgaccggtcggttgcgtgtgaccacgtagagttattcagcttcttcctttcttcctcccatcttataatattaaaaatttatttgatttgttttcccatgcttggcttgattatctctttcggttgagtaagattctttgattcaattgttcgtgcatagacaccagatatgtacatgttcaataataatgatttactcctaaaaaaaaaaaa

SEQ ID NO: 81876 - DNA, 224 bp, Triticum aestivum
  unsure (1)..(224): unsure at all n locations
  Clone ID: PAT_TA_81876
cgcctacttcctctggcccgcggccgcggccaccgccaccgccgccancatggcagcacccggggccgccggtttcctcatctcccgtgcggcgtttgcggccaanccgangctctacttccagatnctccgaactgncgnagngggagaggttgncgcngntttcgccctgtaagctgnacnntagggtaggccacgcaccaantgcttagtttcgtctcgcg

SEQ ID NO: 81877 - DNA, 484 bp, Triticum aestivum
  unsure (1)..(484): unsure at all n locations
  Clone ID: PAT_TA_81877
gccggcggngccttcganggcgcctccatgaaccccgccgtctccttcggccccgctgtcgtcagcggcgtctgggagaaccactgggtctactggctcggacccttcnccggcgccgccatcgccgccctcgtcnacgacatcngcttcatcggtcagcgcccccacgatcagctcaccaaccgccgactnntgaaaanctcaatctcatctcgtcgattngtcatcaccatgtgatattgaaatcgnttcanacaatcaancatntgntcgtcgcaaccgcatcatanataagccagtttnacttntntggcgatatcntgacctnggagaattactggtanccaatncttatcntcaantaatatngnttatcgnancttctcaaaacntgggancagntnaaggccaaattatcaggttncatccnnggancaatttnnttgccanatcaangaanagggnggtccngtacaattgccta

SEQ ID NO: 81878 - DNA, 655 bp, Triticum aestivum
  unsure (1)..(655): unsure at all n locations
  Clone ID: PAT_TA_81878
cgagttttttttttttttttttttaccgaaaaagggtttcccccgctttgtatacaaagcaaccaaccggatcatacagggataggtgctggggcggaagcagcacagtcgcgcccaaaagaaacaacagaaaaagagcaaaagaaacaaatgccgacaacggcggatcaacaaaaacgaagaacctcgcgatcgctaggccaccggtctaatccactaggtccaagatcccgaagcgccggcaccaatcaacacctccaagaaggatcgcgacgatgacgacgctgctgccaagggttcccctcngtgccgaatctgnacgaggaagaatggtgtccgcaccttcgcttgcaagtgaaacantaaatttgggcatgtcacattttctgggatgggaaccntccggatactttggacgagaccagggaaganatgtagaatcccaatgacanggtacacatccaatgagcaacccaaaaggaaggacttaantgctgagagatcnggatctnctcaatgggaanttgncagngcgtataactgcaaacgggaatggtggcanacggggaattgancaantgttctgcaggtgcganaactgcanaggcctgancntgncaattgggaccacctgcnacgtatgaacaagntngta

SEQ ID NO: 81879 - DNA, 502 bp, Triticum aestivum
  unsure (1)..(502): unsure at all n locations
  Clone ID: PAT_TA_81879
cccgcgccggccgatctcgtcgtccaggttcccaacatggggtctaggcgagtccacaacattgggtggctgagaacggcgaccatgtctctccagaatgtgtactacgtccctgggctcgacaagaacctggtctccagcagccagctccgccaaacttggctacaccatcaccctccggcccttcnggagtgccgcgtcaccaaagaacgattnagagccaagacctttgtggggatggtcaattnaaccgaatgattacctgttccgnagctgggcttccctcaagggtccctncctccaaccgggctgganggtgctcctgcctggcnaccnaccgactggtgttgttcttcantgcctanncaataanagttggcnnagtatggntnntatttgcaaananncgcaaccttgttggaanaatnacntaaagggggncnnttattcccgnnaatgggnggttttanaaaataacggggntaaaaaacccanttcnttt

SEQ ID NO: 81880 - DNA, 362 bp, Triticum aestivum
  unsure (1)..(362): unsure at all n locations
  Clone ID: PAT_TA_81880
ccgaggtgtacccgctgttcgcggcgacgggcgtggccatcggcatctgcgcctttagcctccttcgcaacatcaccggcaacccagaagtcagggtcaacaagatggggaagggcagcgggagtgcttgagaaccatgaggagggcaggcgctacgccgagcacggcctcaagagcctatgtgcaggacaagacccccgagatcatgccaggaatcaacaantcttcaacaagcccaaaatgaacattttatctgctgtgactcgcatttataactggtgttggcaaagtgcaaacctatttaaagcattcaagtatgttgttgcnccataattcnagaggcacctcaaaaaggggggggc

SEQ ID NO: 81881 - DNA, 550 bp, Triticum aestivum
  unsure (1)..(550): unsure at all n locations
  Clone ID: PAT_TA_81881
aggaagtccaccggcggcaaggcgccgcggaagcagctggcgaccaaggcggcgcgcaagtccgccccggccaccggcggcgtgaagaagccccaccgcttccgccccggcaccgtcgcgctccgcgagatccgcaagtaccaagaagagcaccgagctgctcatccgcaagctgcccttccagcgcctggtgcgggagatcgcncaagacttcaanaccgacctccgcttcaagagctccgccgtctccgcgctgcaagaagccgccgaggcctacctcgtccggctcttcgaggacacaacctctgcgcatccacgcaagcgcgtcacatcatgcccaaggaatcaactcgccnccgaatcnntgcaaaaggccaaanccctcagcttctcggaggtgtaaaggtttaagttcgaactgtnttcntggtggaaancggcntttnggaaaaagatccccnttttcnncaaggggccttttangtcttggcgntncngatttacaatctttncancanaatnaaantggnancgtcttaaaaaaaaaaaa

SEQ ID NO: 81882 - DNA, 412 bp, Triticum aestivum
  unsure (1)..(412): unsure at all n locations
  Clone ID: PAT_TA_81882
ccctggctgactataacatccagaaagagtctaccctccacctggtgctcaggctccgtggaggcatgcagattttcgtcaagaccctcaccggcaagaccatcaccttggaggtggagtcctcggacaccatcgacaatgtgaaggcaaagatccaggataaggagggcatccctccggaccagcagcgcctcatcttccgccggcaagcagtccgaggatggccgcaccctggcagactataacaccagaagganccaccctccacctgggtgctcaagttccgntgggaggcatgcagatttccgtcaaagacgtcaaccggcaagacatcacctgggaggttggancctccggacacatngacatgtgaagggaaagtncaagacaaggaggatcccccgggacaaga

SEQ ID NO: 81883 - DNA, 654 bp, Triticum aestivum
  unsure (1)..(654): unsure at all n locations
  Clone ID: PAT_TA_81883
gcacctcctcccctcctgcccccgagcaccgcagccgccgccgccgccgccgccgccgccgactgcagccatgtcgctgatcgcgggtgaggagttccagcacatccttcgtgtgctcaacaccaacgtcgacggtaagcagaagatcatgttcgcgctgacctccatcaanggtgtgggcgccgcttctccaacatcggtctgcaagaaggccgacatcngacattgaacaagagggctggagantttcccgccgaggagattggaccgccttgatggcggtgggtgcacaacccgcgccaattcnaaggtgcccngacttggtcctcaanaagaaagaagattattaagacggangtctcccaaagtcgtctcccaacgccgtttgacattaactcaaggatgacttntanangtcaaagaagtttaaggacatcctggcttcntcactaacgggggcgtgctgtccgtgggcaagananaatgataccggnaggaaagaaagntttggngtctcaaanaaccataactgctcnaangtccncaaaactttgcaanacgggttggcaattcaaaccttaagangttcttgttaacaatacttggnaagtttccaaaaagtttggttgaccttaaaangnctganctttaccn

SEQ ID NO: 81884 - DNA, 258 bp, Triticum aestivum
  unsure (1)..(258): unsure at all n locations
  Clone ID: PAT_TA_81884
gcatcgcatantggtttccatccatccatccatccctttctctcgttgctatgcanctanatcntgatcttgttgttgcatggccggtnatggntggcgggaagaagggcggtcgggaccgcaagccngcncaggagcgcaccgaccgcaagtcnggcaccgggatgannggcgangccaagaatggcggccgcggaggnangttcacctnngagggcgccnacngctacaccgangangacctcaacctcgtcgcca

SEQ ID NO: 81885 - DNA, 625 bp, Triticum aestivum
  unsure (1)..(625): unsure at all n locations
  Clone ID: PAT_TA_81885
ggcttcaagcctagccacaggagcaaatgtttcatcgaagtcaatcccttcaacttgtgcgtaaccttgagcaatgagacgagccttgtttctgacaacttgaccatgctcatcttgtttgttgcaatagatccatttggtgccgacattgtgcttgcgaggatctggacgctttaccagctcccatacgttcagctcgaactgttgaagctcttcttgcatagcttgaatccaaggttccatgaaggcttcatcaactctcttgggttcagatatagagaaatatgcaaagtgcccacagaaatttgctagctgtgttgctcttgaatgagtgagtggaccaagtgcattgatgctatcanttatcttctcaatctgtacttcatttgcaacacgangatgaactggnacaaagattttgcccttgctgatcaatgtcctcatctcagcattggctcaagctgagcatggcgtcaggctgattagtgcanaaatgatgattcctcttcagcctgtgctccgaaggtagattctcagtaccataancttgatanatcacaagtgtactcatcaacanattgcaagnntcccttgcaaccgttatccacaaccgaaacanattnan

SEQ ID NO: 81886 - DNA, 616 bp, Triticum aestivum
  unsure (1)..(616): unsure at all n locations
  Clone ID: PAT_TA_81886
ttgacgtccaccccaatgctgcactagtcttggatccatagatcccaacaaagtcaaagtatttgcttggctgctgttcttggaagcggggaggccctcctagagatccgcccccgcgagctccagttcctctattgcttaaatttcgagaattagtaagtgctccaaaaaaaatgcagtaacgctgcattattctcccgtattaatccaggggttccgaggtctaattcctcctatgaagctgtcactttangaggttgtgccatttgtctttctggtcagtggcggaggacggntttgaaattttggtatgggccaagtcagcaccatggaccaaaaagtatacgcaaaaattgaggtgaggaagcaaagttnatgtccggtcaaccttgtaacagaacaaatnatattttgaatcaaaggttaaacaacttcccaaaaagaattgtgttcaccaaatattgngtatcctccaagggaacanngntttaaantcccgttaacgganncccgaaaaaggggatttggnggngaanggaagaacgggtcccccctaaanncgggggaaggcaactcngtcctggggaaaaaagacntccgaaaccaaggcaatttg

SEQ ID NO: 81887 - DNA, 463 bp, Triticum aestivum
  unsure (1)..(463): unsure at all n locations
  Clone ID: PAT_TA_81887
caggcggcggcggtgcccgaagaggagaagcacggcgacctagcccgagctcgcaaccatggctaggggttttgaagaaacatcctgaaagaaggctcaatgccccgtctcattggatgcttgacaagcttggtggagcttttgccccnaagcaatcatccggtcctcanaaggcaagggantgcctgctctgatcctcatcctgaggaacagactgaaatatgctcccacctaccgttaagtgcaatctanccttatgcaacgtcatattanggttgatggaaangtccncactganaaancctaacctgcnggttcaaggganataatttcaattccaangacnggtgaaaaataaaggnttcggtntnaaacaaagggtccctttcggccttaaancggtnagggacaaggntcaaatttaacctcngaagggncaggtctgaaaatttggcaaaagggc

SEQ ID NO: 81888 - DNA, 603 bp, Triticum aestivum
  unsure (1)..(603): unsure at all n locations
  Clone ID: PAT_TA_81888
ttttttttttttttttagtcgttagcatttggatactgtattaattaatcttttgatattctacccaaaagatttattgtgaaaaatatgacaaaaggagtgcaaacactcattttgcacatgaaatcttagatagactttgtataactacatgtatcagtcaacgtcttgtccacttgcccacaatgaccgagtctgacaaggttattcctctgcatcaccaaaatccacactgcctgtcatattgttctctcctcccaatccttccattatttggttgtgactcaagccaagcaatccttgggatatgttggtgcattcaatgttaaggagtgcgcccgaagtaccacnggacgagggcctccnagcatttcaatgtaagtgcgccctggaggcgttgggcactaagtttccgtgtacgaggtcaatggtaaagtgaaccatttgcgcacacttgtcaaatttccataacaaactttcaanttattaaaaggtcctacgtggtataccanacttatgcatatttgctggcaataatancacattgccgggaagcnanacanaatttgagancagctnaaggtccgagaacctacaaggtcc

SEQ ID NO: 81889 - DNA, 475 bp, Triticum aestivum
  unsure (1)..(475): unsure at all n locations
  Clone ID: PAT_TA_81889
gccttttccttanaaccaataanattggtcttgttgaagananctcacttgccatcttancaccaaatgtatangagtacaagcgtcttgtgcanaaggttcttaactgtgatgtaaatgaggaanangcttctgaccaactgactgcactttgccaaaaaattgnnngtgtaaccatcatgangaanggaaaancanatgtcattantgacggtancanagtcacacatntgaagtacctttgagntctccaaggcnatgtggtggncaaggcgacatcnctctggaagngtggcattactttcntcaanggacangcactttctctngnnaagtaagcanctannggattaccgtgatccaanngtctngggtgcaatcctggtccccattgcanaaaaaacnntggngcttgcnttggaaagacaaggctaatggnnacanggacaaattggtccttgngcnaaagttgtaa

SEQ ID NO: 81890 - DNA, 506 bp, Triticum aestivum
  unsure (1)..(506): unsure at all n locations
  Clone ID: PAT_TA_81890
gctgagcagtcctttgcttctggtcgtctaccacctccagtcgaggtcgcgccccatccccagctcccaagtcgcagctcttccggccatggcggcggcggcgcagaggctcctcgcggcgagcacgaagatcgtcggggtcgggcgcaactacgtcgcccacgccaaggagctccggcaaccccgtccccaaggagcgggtgctgttcctcaaagccgacctccgtcgttcctccacgcagggcgtggcaccgccgccgtccnaggtgcccggagcgctcngancgctgcacaacgaagtcggagtcgccgttcgtcatctcaacggagcnctctncgactgcccgangctccnccatggactccttnggaggtaatcncttgcttttggncatgacanaaaggacttccatncggtnctnatccaaaagctcccttggacttnggntaaaagaaaaggatactttanccaattaangnagggttccaaanaaatngcccnaacc

SEQ ID NO: 81891 - DNA, 617 bp, Triticum aestivum
  unsure (1)..(617): unsure at all n locations
  Clone ID: PAT_TA_81891
aagaccccggccgggaaaaagcccaaggcggagaagcgggcgccggcgtccaaggaggccggtggcgaggggaagacgaggggcaggaagaagggcagcaaggccaagaagggcgtggagacgtacaagatctacatcttcaaggtgctcaagcaggtgcaccccgacatcggcatctcctccaaggccatgtccatcatgaactccttcatcaacgacatcttcgagaagctcgctggggagtccgccaagctcgcccgctacaacaagaagcccaccatcacgtcccgggagatccaagacctccgtccgcctcgtcctccccggcgagctcgccaagcacgccgtctcaganggcancaaggccgtcaccaagttaactcatcctaggcttcgtcgttgttcatgagttgatggatcntgtagtagttggcantatgatgttcatctctgtaagaatgtctgcttcggctttaagaaatatatgttgctgccaacgccgcgccgccgcgccgccaatgcagcatttcctattccgggtaggantcagaaatctgctttgtaanacaacttcangnaacaaaatatttcncnacncacaaggtggccccctccaa

SEQ ID NO: 81892 - DNA, 408 bp, Triticum aestivum
  unsure (1)..(408): unsure at all n locations
  Clone ID: PAT_TA_81892
gatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggctccacctccaaagactggggaagcatgggtcacgcaaagtgtcactttngttgccatttgacatctttaaatgggaaaagaagtttnaggatatcgntcctttnacccaaaactngtgactcccccatgttgaccgccaagattatcaagtggattngacataactggatgatggtatgtcaaccttcc

SEQ ID NO: 81893 - DNA, 584 bp, Triticum aestivum
  unsure (1)..(584): unsure at all n locations
  Clone ID: PAT_TA_81893
ccgacccaaagaggaggaagaacaccaaggactcactaccagcgcctctccgcgatccaaatcctcccgggaaagttcttggttgatctcttcctcctcgaccgcctcccaggttcttggtgtagcttttgccactctcaccaggagatttcatgtctgatcttgacgttcagatccaactgcctttgaccccttttgccgaaggcaaatggtggggaacctggtgnaactggccgggttaaaagantnagttcaanttnncatccaacaacngtaatggnccaaanagcctgncaactgtcnaaggtctgaanaaggagttnagctacagcaagattctcaaaggacctcaaagaaagagtttgctgaatgggtacaatttgtccaagacacagaacttgggcangtcatcaactccaaggtgattagaggaanaactctcaaacttccttgtcaaagccggaatntgaanaaggaaacatcaagatcaagggttctgncaatgcantccatataaggtctnatgcaagaantattatggggggcgnaaattaatntgtgcaacccnanaggtacaacttncg

SEQ ID NO: 81894 - DNA, 395 bp, Triticum aestivum
  unsure (1)..(395): unsure at all n locations
  Clone ID: PAT_TA_81894
cttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccnagggcaccaaggctgtcaccaagttcacctcctcttaaggctgttcgtcttcctgtgtctcgtagttactgttcggggtgtgtttggnggccgtgttanctggtaagatcgcacngcgatgttcctgtatcnccaagaaatggtaatgggtgcctgcctcaatgttcaagtntcccaatg

SEQ ID NO: 81895 - DNA, 467 bp, Triticum aestivum
  unsure (1)..(467): unsure at all n locations
  Clone ID: PAT_TA_81895
aagaactggagctccagaagcagaagcagaatccacaattatagcaccagaagctggaaccagcagaaagaagtttctaagaagtctcttgtgctcactcgaagtccgatgataactaaggttggaagagttgaaatccgccaaagctctgtatgttggtgtcagtgctgtgatgcagagtcgacgaaggcttctttcacgagcatgaccgangccgaggaatgggncgagtgtttcaangacaaccangaagtatgggtagcancggtcgccgctgggtcctccttngagatgaggttacgtcgaccaaccttnnaacctganttcgggcangaaaacntttnagtaattncccatttccccnacaaangcctttcaacaattattccncaaagtctaangggattgggaaggacaagtgccggtgagtcaagtgnacatgttcntctanaaaacgagaattcant

SEQ ID NO: 81896 - DNA, 298 bp, Triticum aestivum
  unsure (1)..(298): unsure at all n locations
  Clone ID: PAT_TA_81896
ggatgctattggtgtgtcgagtgttgttgctgcaatgattgggctttcaattcttcttctacttggagtgatgaactgggatgattgcttgaatgaaaagtctgcaaggggacactttancttgggttgctantccaantgggaatggggaaggcanntcantgacctcnggantgtggcatggntgtcaaactggggtgcaaaaggtcttcaatcnttctcaatgagnttggcctgcaanaatttggggtcctcaaggctcccaattccttaatcactaactanttncaaagccaaa

SEQ ID NO: 81897 - DNA, 335 bp, Triticum aestivum
  unsure (1)..(335): unsure at all n locations
  Clone ID: PAT_TA_81897
gtcgccggccgccgtgcgggcgcgcgtggncaaacccgtcgtcccgctccgcgccaanaaatcgtccgggggaagncatganaaattttaanaatccntttacaaggcctcctnttnaaaagaaaattaaaanaggtcttttcaanttaaatggccgggganncaaccaaattgnaatnatgggttggggaaaaaaaanggtccgnaaaatnnttgggtgaaattttggggtaancaatccttttcanaggtaaaatnggtccnatcaaaccgntnggaatncccttannttgctcaaaatttnaaaggtnaaaaatnaancctntttcanggaa

SEQ ID NO: 81898 - DNA, 523 bp, Triticum aestivum
  unsure (1)..(523): unsure at all n locations
  Clone ID: PAT_TA_81898
ggcgggcaagccggcgggcgtgttcttcancacgggcacgcanggcggcgggcaggagacnacnccnctgacnggggtganccaactgacccancacggcatggtgttcgtgccggtggggtacacnttcggcgccaanatgttcnacatggacaangtgcanggcggcancccgtacngngctggcacnttcgccggggacgggtcgcggtggncgtcagaaatgganctggancaagccttccaacanggcaagtacttctncgggatcnccaagaagctcaaaggctcctccgcctgagtgcangatcattgatcacctgattactggggggtgtgttgctgctgctgctgctatctgtatctntggagcttaaatttgattgtgantgtnggnatggtatgttaatantatggcnttnattaaccggttttaaatttnnaatggtttttcgttcaaangattacaatnacggcatnttcnaaaanaaaaaaacnccaggggggccggaacaattcccca

SEQ ID NO: 81899 - DNA, 348 bp, Triticum aestivum
  unsure (1)..(348): unsure at all n locations
  Clone ID: PAT_TA_81899
ccggcatctctttctcattcatgtccagtccgtggatttggtggtgctctgctccaggtgagcactccgtagcttgtcgggtgcgctcggttccttttccagatgcagcctgccggtgtccttcctcccaggttctagggtgaaccgcgacactgtcaacggttcggcgccttcgatccangcgaggaggtaggggctttctttgacantggagctgggaggacatggcatgtcggggccgctggcgatttgganaccgtgtgcccttcctcaccgtcnaaagtgctactcctgtgcngncattctcctacttccttgggganccgtacgcaattgangacctaaaat

SEQ ID NO: 81900 - DNA, 606 bp, Triticum aestivum
  unsure (1)..(606): unsure at all n locations
  Clone ID: PAT_TA_81900
gactaaggttgaccacagggaggacgacttgtggatgcttgctgttgacatgagaagcaagactctgaaaggagtggctggtctcaccagtaaaagaaccatgggttttagattcatgtacttgcaaagtgacctctccaaccatctgggtggccacaagcaaaaaaaccgaggctccaaccatctggtggcacaagcaaaaccggagacatccaaagaatgtgcccaaaaagcaaaaggcctccacgcaagaaagaaacatgggtaagaaagaacttgtgaagtccttgctaacacatggtgtggatgtttgatgcgacccnggaggganccgcagcattgggtgcaacttgccngaacaagaagaacaggactggagntacccnggtgttttaanaagnttaatgcaactgatgtgcgttnnaaggaatttgctcatgtccaaggttnaaggaaaagaaatttaagnttaangggtgactataactgcangatacnatatctggngtgccttcctcacaanttaatgtgtttgtgttaagtatctgtancactgtatatgtaatggtattatgtacctgccacttagttgttgtccaaaaaaaa

SEQ ID NO: 81901 - DNA, 550 bp, Triticum aestivum
  unsure (1)..(550): unsure at all n locations
  Clone ID: PAT_TA_81901
accagggcaacggcggcggcgccaactccgtcgcgcccgggtacaccaagggggacggcctcggggccgagatcgtcggcacgttcgtgctggtgtacaccgtcttctccgccaccgacgccaagcgcagcgccagagactcccacgtccccatcctggccccgcttccgatcgggattcgcggtgtttctgggtgcacctgggcgacgatccccaatcaacggggnaccgggnatcaaacccgggcaaggtccctgggngncgccatcatcctacaacaaagaagcaagcgtggggacgacattggttctcctgggttggccgttcatcggcgccgcgctggcggcatctacacgtggtggtgattcnggcatncccttnaaagaccgcgatanccaacaatcatctnccgatgtggtnnancctcctggtcccggtggtttctccttgctcctngaaatgtttcccaacatatacttatttccagttttggaagttcnggcaaatccggggnaattgcaaagacgnaaattgtgtaaatggntgnttg

SEQ ID NO: 81902 - DNA, 491 bp, Triticum aestivum
  unsure (1)..(491): unsure at all n locations
  Clone ID: PAT_TA_81902
caggctgaggctcacaaaccaggacaagaacaagtacaacactcctaagtaccgttttgttgtgcgatttaccaacaaggatgtcactgcacaaattgtttatgctaccattgctggtgatattgtgatggccgctgcctactcccatgagttgcctcgctatggtcttgaagttggcctcaccaactatgctgcagcttactgcactgggtctgcttttgggtcctcntgtgcttaaagaacgtggatcttggatgaaggagtatgaaaggcaatgttttaggcactgggtgaaggactctcctgtttgancttcctgatnagaaggagncttttccatgcctccttgggtgtttggccttaatcaaggaccacaactgggaaccgtgtgtttnggtgcccttaaaggacttttggattggtggctttacatccccaanagtggataagaattncctggttcaaaaaaggacaaaatccctgggtgccga

SEQ ID NO: 81903 - DNA, 486 bp, Triticum aestivum
  unsure (1)..(486): unsure at all n locations
  Clone ID: PAT_TA_81903
gaaaaagcatcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcaagactttcatcctgcaccacctctgaaagcaaagtgcaaggagcatgctgaggcgaaagcatccgaaagagcgactcgtccaatgttccccccacctcaaagcaagtgatatctgcccaatcaaatnggngagagagtnannagagagaganaactgtcataacccacctnntatatnatgttcccgcaaatgcctgattgttgacctaactttgggcctnacncngggttgccgntntccaactgtttggttttgtgccanctacaaggtanctccccnncaacctgttttggcnaaatacctaaccngggtggtttccc

SEQ ID NO: 81904 - DNA, 303 bp, Triticum aestivum
  unsure (1)..(303): unsure at all n locations
  Clone ID: PAT_TA_81904
gcgagggggcggcgtgagcgtccctgccaactccctcgcgcctttctcggcccccaccatggtgagcannacctantgaagaaggggaagaagccgccgcgccgtgaagagaaactctatgacgagagcatctgcaganagagtgcttcctgctgctgtgaaactgctcaggctccacccgggtaattannttagcgtnntgntagcacagtataatgttagatcancaccattagcgatgcttttcgncccctccgcctcctcccctttggtcttttatctatcccttttctcctctccaat

SEQ ID NO: 81905 - DNA, 665 bp, Triticum aestivum
  unsure (1)..(665): unsure at all n locations
  Clone ID: PAT_TA_81905
atacaactcggcgtcaccgggtaagacgctgatacattacaaggcagatctcagctgaactctccctccccgccctggagtccaagcgtttgtggcctacatccgtgagctccatgtctccgtccctccaccgagcagcggcacacacacaaggggatcaagcgcaaccaaatggacgatgctccttcctgccacacccatgtgtcccgttcaagattacaggttgcatgtatgaatatccaagtggggatgcttggatctatttaactgaaacaagacgtgtttatatatgtcaaaatgtctgttgggagaggcacgaaagcgcaaaggccgtgatgtgtaaggttttaatccaaggagacaacccggtagactatcaagtgttaaggtatagcctaactaagtagtttatanctcccattgactcccttgattaagnatgccatgactgggtaatggatttggtaagttataatggtgtctgggtgctttggacaaacctttgtantgccggtnaattgcaagtctggtttagttnatcaagcntcgataaaggggggccggtaccaatcccctaangagctatagccgctaangcgtctttaantctncngaaacctggtnccantaccctgaaaanccctttcatggaaacaaggcnnctt

SEQ ID NO: 81906 - DNA, 650 bp, Triticum aestivum
  unsure (1)..(650): unsure at all n locations
  Clone ID: PAT_TA_81906
aggaggggaaggcttcttgggtccatcaagaagaagcagaggaggactctgttgactgcaggtctgatatctcggaggagctgggcgctagatacgaatgcaacaacatgtctaaagattgcggcggtggtggtggctcttcagtggaatcctcaatggatgacatatccaagtgcatttggtgggatgaatttccaagatgtaggtgctgatgccgcngcaaccagccagggaaacaagctgaccatgtccaaggagaaggacacctaanaggcggggaacgaatcccgggcattcaaccccaanggcccgaactttcctcccggtgggtgcctgatccaagatgctgaaaagtttgtttcaagcatcaagatggctgatgatccggaagaatgccnaggaatggatggttgattatcacttccngaggacaatgaacaattggccctnctcaanaaangaagtgganatctntcnancctttngaacgttctgcacatcctgggggaaaaaaaccnacgacaagaaaacttgcctgcactnataattncagnacaannctagggtaaatantcagtgnaaatntcatcagtgncaattttntcnaanttcacagattgggcaacctctnatttggtaaaaaaaaaaaa

SEQ ID NO: 81907 - DNA, 659 bp, Triticum aestivum
  unsure (1)..(659): unsure at all n locations
  Clone ID: PAT_TA_81907
gcagcgtctcatcttcgctgggaagcagctggaggatggccgtaccctcgctgactacaacatccagaangagtccaccctccaccttgacctgcgtctgcgtggtggcatgcagatcttcgtgaagaccctcactggaaagactatcacccttgaggtttanagctctgacaccatccgacaatgtcaaggccaagatccaaganaangagggcattcncccggaccaacancgcctgatcttttgctggcaagcanctnggaggatggtcccaccctcatcccgactncaacatccaagaagganccaccttcaactggtgtcccctcccntgaggggcaataattgcctctcaatccaacttcagctgctgtgtaccngtttccncccngtnggtacctttntttaaatgctgnccccttnttgtaaacccnacnggtccagggttaaaaggcaacgntcccgnggttggggcaaaaatttcagnanatctgacgttnantctaataatcaattttangnncaaaaaaaannaaagggggccggtaccaattccctaaangncctatttgcccccanggctttttaaactctganggnaaacctgggtaccaattnccctgnaaaacccttncanngttaaacaagcccncnttcn

SEQ ID NO: 81908 - DNA, 613 bp, Triticum aestivum
  unsure (1)..(613): unsure at all n locations
  Clone ID: PAT_TA_81908
aagatttctagcttgcctatgtgttgataagtgcattcggccaaacaatttgtggaccaaataaacttgttgcagatacagaagaacaaggctgcacacaaggagttgcctgaattgcagtggcagcggtgttgtaatatgtaagttccacatcccacatcgaaccttccagactcatccaagtgaccatttgcaacatccttttctgggacaatctgggattagttcanggttttcatcactctgggtctgcacaacattcatgggaaattatagtcttcccaaaatattccctgggatcacttggcaaaaaggaatgttgtgaagagtagcgttccatcatccnggggccaaacacccannaggganatttcntggganatttgctgcaaacaacctcccngtggcaatcctaaagtcccccaagcacattnaggtgtcantggnaaagtaagaatgttggnggaggcaacattnaaaanggntgganatgggtggacaatcaanggttaccccaaacttgggaccagggnancaantggtcctgnaacccagttggncantttanaaattggncaaatacattgganaataaacccggggtggcgggcgt

SEQ ID NO: 81909 - DNA, 587 bp, Triticum aestivum
  unsure (1)..(587): unsure at all n locations
  Clone ID: PAT_TA_81909
ctcagcacctttcttttattcaaagcaggaacaacatatttctcaactgaactataactgggctccctcttagttctaatttcaggcggagccattgcatgcaaatctgctgcaggaaccttcattaggggtgtcaacaccaataccagtttatacttgaactacttttactcctgccatatcggatttccattttcttctcaaacggtagtgaaactatttaaagattgtttctcaaacgccacttctcctttcaacaaatcngataacatccgacattaattatcaagcaaagccttcctacaagttccccttcctttccttccaaacaancaacattggtttcctcanccngtgcaagtgttggtccnntcttaaangtccttcaaacctggcatttggatttccgtaatggtatccatcaagactggnatccnanccnatggtatcaaaatttaaatncnggcaagtacggnataaagggatttccttttaaaanngnaagttcngaaancaagngtctggattcnaatcggnggctgtgtcagggccannttgttggggnttaancattggttaatttgcaa

SEQ ID NO: 81910 - DNA, 162 bp, Triticum aestivum
  unsure (1)..(162): unsure at all n locations
  Clone ID: PAT_TA_81910
gagagagagaaagtcactccctgatttgtgttggatncaaaaaattgttgattgaaagattgttgtnctcacaaggagatgtctanctcagtttgttcttctttccatcacatactgtgaatattgnntatacaatttgcttanacagttctgcagccaaaa

SEQ ID NO: 81911 - DNA, 646 bp, Triticum aestivum
  unsure (1)..(646): unsure at all n locations
  Clone ID: PAT_TA_81911
gcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctgngtgccgattacgtttgtggatccaccggtgtcttcactggacaaggacaangccgctggctcactttaagggtggtgccaagaagtggcatctctgccccaagcaaagatcccctatgtttgtggttggngtcaatgaagacaanacacctcaagacgttaaatttctcaaaatgctactgcaccactaatgccttctcccctactaagttattaatgacacttccggatattgangtttngatgacacgttcatgcatcantgccacacanaaacgtttatggcctcnagcaaagncgnganaggtggaaggccaantttantaatccagnanaatggngtgcaaagggttgnangtctcnacnaanggaactanggtaatcttcggtccacgggntncatntttcacgtnacnaaagggacctgtgnanaaaggttagg

SEQ ID NO: 81912 - DNA, 627 bp, Triticum aestivum
  unsure (1)..(627): unsure at all n locations
  Clone ID: PAT_TA_81912
gagatctagttgacttgggagatatgtatttccatgagctcgttaatagaagtttaatacaaccggtgaaagtaaaatataatggtaaggtatcatggtgccgagttcacgacaccatccttgatttcctcattgacttgtctgagagagagaacttctctactttgttaagcaataaagcaaagccagatcgcagaattcgtcgactgtctctgatggggaatgaagatcaagggattatcgagcagttggatatatcacatgctccgatcacttggtgtcttcgggcccaccaaacagttgccttcccttgtgaagtcagatgctttgcgtgtgctgggacctaagagtttgtggaggattgggaaatcatcaggtcaaagatattggaaaacttgttcagttgagatacttgaacatcgatggtacagatataactgagctcctaatcaaattgggggcttggagcacctaaaacgctgcacaatccaaattccgtgttgcctgaacggtaaccgctaaaaccctgctntttggtttggaatgnacaatncggtggatggacatggnaattcaagactnaggnaaaccttggaacctgatnaanaaactggaacgaaattnggn

SEQ ID NO: 81913 - DNA, 630 bp, Triticum aestivum
  unsure (1)..(630): unsure at all n locations
  Clone ID: PAT_TA_81913
agatgggacttactctactcgaactacatcctaagaagtgcgctttgccttctgatccacttcgtcgaggaccaagaaatcaggaatttctaaagtccggaacatttctctactacactgctacttcaaaaagactaatagcctaaagatttgtttcggtgtcagttgctgttaagcattttagctcatgtcagttgctgctttcatggccctcgaagaagaacaaatcctgaccatgttagttgccacctattactgtttccccttgtgtaccgggcgcgctcacggccagttctggtgctatgcccggctaccgcctgtcctttcaaaacctcatcgtacccacccttgctgcctaccaaattcaaattttctatgatccaaatccgcgcgcctatgtcnaactgtctagaaaccactcttgcagcccattatantcaagtgngcaaggaattgggaccacgctgctcantcaatccanggagnaacagctcnggcnagccttcccttcggnnnggtcacanggncaggncaaaagtnttgaaagttaggntccggagaacctgggttaggnggnctnaaacgnaggcaaaagataagcctcggcaaaanngtaaggaaaaaattttg

SEQ ID NO: 81914 - DNA, 626 bp, Triticum aestivum
  unsure (1)..(626): unsure at all n locations
  Clone ID: PAT_TA_81914
aggaggccaaggcgaatctgctgcttctcgaggggcagctcaagggggagaggttctttggaggcgacaccattggcctcgtggacatagctgccagtgggttggctcgctggctcgaagttttcgaggagatttcccgggtggatctgctcaccgatgagaagttccctgctctaaacccatgggcgaaagaatatgccggcgacgagcatgctaaggagtgcctgccgaacaaggatgaactggttgccaagttcactgcagtgaagaagaagtttctagcaatggcagaggttcagaagtgatcctgtgttattaagtgcgaggatatcatggggttatgacataaatcaatcgtccggacatgtcgttaatgatcatggtttcctttcctgggaaaaggaacaatattaagtgttgtgccggatttctatggcgtacnatacgtgtaattccatctggntgtaacttgtcctgcttctctgatacagaatcttaaagacatggaaattgtattcntttcaatgcngagtgaancacatacaacagattgaaacgatcccggnttaaatgtgtcactatttgcacagttgaagttctttcantggatgtataagtactgttgt

SEQ ID NO: 81915 - DNA, 424 bp, Triticum aestivum
  unsure (1)..(424): unsure at all n locations
  Clone ID: PAT_TA_81915
gagctctcatccagcactagagtaattaatatttgctagctgcagcagcaaccttccacgaccaagaaaatggcaccgactctgaagctcaggttcctcgccgtggccgccaccgccaccgtcgtggcatcgttgctggtcggcatggcctccgcggttgacggaccagcccccgcaccagcttccggcgcgtcggtaactgccccggctgttgccatggcctccttgaccgccctcgtctttggctacttcttctgaggacatgggcgacgacgtgcatcatgtcgcgcaattatttgggatctttatttgattctacttgtgttcatacaggatatgagtacatattgtaaatgtatgtccttttttatttttaataaaagtttaattggatacaannnaaaaaaaaaccgngggggggggg

SEQ ID NO: 81916 - DNA, 597 bp, Triticum aestivum
  unsure (1)..(597): unsure at all n locations
  Clone ID: PAT_TA_81916
gccatgagcaaatcggtctcatcaggcagtacatcgtcaggcagtagacagtcgaaatctgtgtcagctgcaaatgatctctacagcaaggccaatgcattgtcaggcagtgcaaagtcgaaatctgtgtcagctgcaaatgatctctctagcaaggccaatgcatcgtcaggcagtgcaaatttaaaatcagtgtcagctatagatgatttccctagcaaggccaatgcatcatcaggcaggacacattcaaatgatcactctagcaaggccaatgcatcgtcaggcagtacacattcaaattctgtgcagactaagaagatccaggagaagactaagaagaaggtggtaccgctcccagtgaagaagaagccacagaagtaagaggaagtcccaaaacgggggagacctacccgtggcgaaccangtcttcggncatgatgaatcaagtgcgttcctgtcaataggttggtaacttanttcaatatataattttaactccgttcgatngagcccgtatgtcattgcaatttcatgatgcaaaancngctggtcaaccgcctcaatatcctttccccgcaaaaacaatattctttc

SEQ ID NO: 81917 - DNA, 412 bp, Triticum aestivum
  unsure (1)..(412): unsure at all n locations
  Clone ID: PAT_TA_81917
ataccaaagctcatcttcttctccttgaaatctttttgggtccacagatttggaggatgtcntgcaactgcggatcaggctgcatctgcngctcanactgcaagtgcgggaagatgtaccctgatntgacngagcagggcagcgccgccgccgaggtcgccgccgttggtcgtcctcgggtggcgcctganaacaangagggananttcanggtggccncccggcaaatcccggctaaggctgcaactgcggggacaactgcaantncaaaccctgcaactgttaanctgcaancactcctacgtantaagtgtgatggtgtnagantatacgtgaataaagaacntcctgatntgaaggatccaacaagtnttcctgngtnantgggttanttgcccgnctncgtttaagc

SEQ ID NO: 81918 - DNA, 479 bp, Triticum aestivum
  unsure (1)..(479): unsure at all n locations
  Clone ID: PAT_TA_81918
ggtttctgttcgtgtgggaagagcttccagcgtggcancgtctcgtgatgggggcacaagacgagggtagccggcggccgccgccgccagagcccacccctggccagcccgccgcanccgcgggcacggcgccgccnccnatcaccccagcccagttcctctcctggaagcagcgnaaggatgcanaagaagctgcatagaaagctnaagcggctcagaancganncgctgatataacttcatgatcagnttaagatgnaatggcccgataanttgttccagcatganccctgcgtgtttgacancancatttactgagacaancatgatcctgcattaancacacagagcatgcatgtatgccatgttcactgtcagaatcccacaccataaantttgtacatgccgtttgaantctgtttatgggaacccgtaattnttttgcactgatanatggaacaaatacagttctccaaaaa

SEQ ID NO: 81919 - DNA, 585 bp, Triticum aestivum
  unsure (1)..(585): unsure at all n locations
  Clone ID: PAT_TA_81919
ctcatccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccaagaagatgaaatccgccatgctgggtgatcttggaaatgtgacagctggagcggatggtgttgctaacatcaatgttactgactgccatatcccccttactggaccaaattcaattgttggcgtgctgttgtcgtcaacggtgacgctgatatcttggcaagggtggacatgacttanaagagactggaaacctggtgcccctgttgcttcggatcatcgggtcaaggctaagattcatctcaacggcaantctaagtntggaacctttnaaatganattgaacncatcaaatagca

SEQ ID NO: 81920 - DNA, 367 bp, Triticum aestivum
  unsure (1)..(367): unsure at all n locations
  Clone ID: PAT_TA_81920
ggcgtgctcgccaccgtgatcgtcaatagcaacaggtattccaccgtggacgcgctgccaccgttatgtacggcaagctgtctggctcgggcgtgaagggagactgttgcatttttgggagagaggggagatggcaaccgtggattgaaaatgaacatgacatgtggaccagtgtantaagtgagagtaaagattgatcccgccgagataatctttttcctgatccgctaaacggttcanggncgagatagaccaggatatgtgagtataggatacatatttcanggatttgtangtgacggatcatttacgatgagctctacaatttcaaggtttaaaacngnatnaaaaaaaccnaagggggggn

SEQ ID NO: 81921 - DNA, 610 bp, Triticum aestivum
  unsure (1)..(610): unsure at all n locations
  Clone ID: PAT_TA_81921
tgtanctcaaagggacgccgccgctgcccccgacgcgatcgccggcggcgagtacacgctggtgtacgaggacgacgagggcgacaggatgctggtcggggacgtcccatggnagatgttcatcgtcacagcgaagaggctgcgagggctgaanagctccgacctgccagcctcgtcgctgacggaggncgggagcangaagaggccggcggncgcggctataattagagccgtgtctgtgacgaaggttaancctgttttgctactacgtacgtacgnacgtatgaggatgaaatcacngctataattagagccntgtctgtgacctgcagctatnttggggggcaatcgtggccgtatttgnngcttttttccanttcaaataantgcgttctcngatgctctaatccantacaagtactagtatgttctaaanggataantgcacaaatacttcgtntgaacttatcttnccggttgttaaaaaannaaaaacaaaaacnccngggggggcccgattncnaantccccnaaaangantcgattagngcctcacngcntcgttaaatgtcggacnggaaaacngaggtaccacttaccccttggaaaa

SEQ ID NO: 81922 - DNA, 474 bp, Triticum aestivum
  unsure (1)..(474): unsure at all n locations
  Clone ID: PAT_TA_81922
atcataaaccactcaanattctcttacatgaacacgtgcatacccttgccggaacacaacatttctttctcccccgatatgaaaacangaaanatacaaggcgtactggagtagtatngccgttggttgtggaaatcatacaagangacaaagtaaaaggcatggngcanaattattccactctccccttgcatgcancgcacacggncctaantgcatgcaangtcagtgacgagacatttgcagttggnacttgggancagttggnatcgattgatcagaccgcactaactccgtgcccgttggatggaagggcttggctgctccgttggntttctngnatccggattgtgtcnggccaanacggngtctccggtcaactttggagntgcaggaggcaatggcnaatggtaaccccncccnaatagccgggnctcnncctgggtncccttggngggggggcccggtcccaat

SEQ ID NO: 81923 - DNA, 264 bp, Triticum aestivum
  unsure (1)..(264): unsure at all n locations
  Clone ID: PAT_TA_81923
gctcggttgtcatgcacttcaacatcctaacacggatggtttgcacgatcatccttgcattctcattcaacttctccatcttcaanctcaanatcttcgtgtcctctgaaatggncacgatctcaactttcttctcttcgaggaaatggncttgttctcntcgagcttgagcttcttcttggtcgctaccataantatgttaaacctctnggntttttttccctccttgacgtcnaatcgcttgacacatgcctcaccgtcttc

SEQ ID NO: 81924 - DNA, 377 bp, Triticum aestivum
  unsure (1)..(377): unsure at all n locations
  Clone ID: PAT_TA_81924
gaccaggccaccatggcaactgcaccacgccctcctacgtctccaccaccagcgacgccgccaggaaccaggtcgcaacgaactccaccaacaccgtcttcttgcacaaatagccaaattgttcaacgtgaagaacagggaagcctattgggtcggtctgtagctctctgcttaaggatggcatgctgatgcatttagtccacttgaattatgtagctggcttattttgccaatactancaagttanaatgtaagtggttgncctttcaancaatttgtttaaaangtnnatttcncacantggggcattattgtaacgtcaactcaatagtgatgtngaanttttggtgcnnggtgataataatcnccgggggttt

SEQ ID NO: 81925 - DNA, 392 bp, Triticum aestivum
  unsure (1)..(392): unsure at all n locations
  Clone ID: PAT_TA_81925
gccctgacgcgaagganaanaagggcctgctgggcaagatcatggncaagctgcctggttaccacaaaacagnngaaggtanncanggccaccgacgatanaggcgagcacaagcncagcgcttnatcgccggnttnccccgtgatcncattgactgcgacctcaattncattgttnaganctgtgtnnatatttanctnanctctaagttngngtcaccagtgaggttgtgtaantatnttatncntgntctgtctgtgcaacccatntctgtatccatgattcatgttncantcgcgtcaaatcaaagactgnttttctnaatgtttttatcangtcacatgtgncttgggctttgctggtacanccttattttaaagtttcccccccaa

SEQ ID NO: 81926 - DNA, 171 bp, Triticum aestivum
  unsure (1)..(171): unsure at all n locations
  Clone ID: PAT_TA_81926
ccacnctgtaccanggcaantgnggcngagccaactccgtcgngcccgggtacannaanggggacggcctcggggccgagatcntcagcacgttcttttctggngtacaccgtcttctccgcnaccgaacgccatngcnnagcgctcagatactcacacggtntncatcct

SEQ ID NO: 81927 - DNA, 456 bp, Triticum aestivum
  unsure (1)..(456): unsure at all n locations
  Clone ID: PAT_TA_81927
aagaagcccaaggccgagaagcggccgcccaagtccaaggagggcggcgccgacaagaagaagaagaaggccaagaagagcgtggagacttacaagatctacatcttcaaggtgctgaagcaggtgcacccggacatccggcatctcctccaaggccatgtccatcatgaatccttcatcaacgacatcttccgagaagtccgcccggcgatccgccaagtccgcccngctacaacaagaanccaccacactcccgggagnttcaaactccgtccgctcctcctcccccggcgantccccaaaacgcttctcttaaggaccaagcgtcacaattcactcctccttaaaacatntctctgcctcctggnggtncatttccccngtaaggcaccgttcnnncatttgcctgnttttccnggtgtttggaaaaatntcatactcntggaataatatggc

SEQ ID NO: 81928 - DNA, 458 bp, Triticum aestivum
  unsure (1)..(458): unsure at all n locations
  Clone ID: PAT_TA_81928
acggaggagaccaaggagcccgagcccgcagctgcggccgagccggaggccgaggcgccagccgtggtcgagacagagaccanggaggccgtggctgaggcagagccggcggtggtcgaagatgtnaatgangaggcggcgcctgctgccgancctgaggttgcggccgtcnccnaggaagcacctgctgctgcggaggangcaccccgcgngccgcngcagangacccggcgccgcttggccancgtcagcgttttaaggcgccnggcgcncncagacnaagacttggtgttttnaactccaacggnggnagctttttctcctaacattgcacggcntatctcaatcaaccaatnggagttgctggagtggatgcacttttttcnacaaagtgtnnggtcttttcccngnccgccttacttggctaaataaatgtttctggtctacccatcccaatg

SEQ ID NO: 81929 - DNA, 290 bp, Triticum aestivum
  unsure (1)..(290): unsure at all n locations
  Clone ID: PAT_TA_81929
ggagaatggaacagtagtggaacaaggaccacatgattttcttctgtcaaagggcgggcggtatgctgaactgtggtcacagcagaacaacagtgaagccagtgatgcttctgatgttagcttagaagtttgatagactccgatacaagttcccctttgcaagggaaaattacacatccatctctcactgaaagcaggttctcccttggccttggtaaatgtgggtgcttaaagatttcnatactggggggaacataaatatacagttngcnggaaaatcctccatttta

SEQ ID NO: 81930 - DNA, 641 bp, Triticum aestivum
  unsure (1)..(641): unsure at all n locations
  Clone ID: PAT_TA_81930
ccaccattggtgttgaagttcacccattggatttcaccactaactgcggaaagatccgtttctactgctgggacactgctgggcaagagaagtttggtggccttagagatggatactatatccatggtcagtgtgcgattatcatgtttgatgtcacttcaaggctgacctacaagaatgttcctacgtggcacagggacctgtgcagggtttgtgagaacatccccattgtcctgtgcggcaacaaggttgatgtgaagaacaggcaggttaaggccaagcaggtgacattccacaggaagaagaactgcagtactatgaatttccgccaaganaactacaactttntagaacccttccctttaacttgcaaaggaactggtggtgattccaaacatccacttccttgaacatgggccttaaccccccggaagtgacttccacctgggcaatgcacaacacacgagctgacttgcggcgcaacggnacaccacgcccgacacatgacatcgatcaatanganagatatgatcgtcgtctacatcatacttggagcaaaacgtcaatcgtttagttaagnttattgtancancggtgtttccgcgcttcctgcggggtgaacgtttgtaatnacaaaattc

SEQ ID NO: 81931 - DNA, 245 bp, Triticum aestivum
  unsure (1)..(245): unsure at all n locations
  Clone ID: PAT_TA_81931
gtggactgggctacaataacgggccgttgttcttcaactcagcgccggcgagaagattgagcctgaggagcatggcgacgggaaatggctcgcggttcctcctggntcttggtgctgcaagccatgtttaangtgtgatttgnatttcaatttncnattttacaattttgccaaacggcaaagcatatagntttgcacaaactgacatgtncaanaggttaatacttcaaattttaaactaagtt

SEQ ID NO: 81932 - DNA, 450 bp, Triticum aestivum
  unsure (1)..(450): unsure at all n locations
  Clone ID: PAT_TA_81932
ccccaacccaacccaccggagcagaccaaggcggcgccgcggcgacctcatctccggccaagggaaatgactaccgttccggggtctctggtgtgggagctggtgaagaagaacaactgcttcttgatcaagcagttcggcaacagcaacgccaaggtgcagttcaacaaggagccaacaactctacaatgtccatcctaaaaantctcgggcttgggngaacaacaagacctnggggtcaaccattcaacaagagaagncaanggtttanccttttcaaanaccaaagaccaanaagcaanaaacccttgcaanttccaananaaacccttattcccaaagggttcccccaagattgcaatttttttcaaaacaatcttgggaaatataaaggctgnttnacaacccgncctttaaaggtnaccccttnccnaactccaagtttaaatc

SEQ ID NO: 81933 - DNA, 513 bp, Triticum aestivum
  unsure (1)..(513): unsure at all n locations
  Clone ID: PAT_TA_81933
cccagccctcttctgcagcagccgccgcccctggcttgctgctcgtccccttctcccctggtgctgctgcctgctgctcatcccttggttactgctactacagagctatccctatcagattccatgggatgacgtcttctctgacaccaaacaaccattgtttgttgatataggaagtgggaaatggttgtttcctattccaaaatggctaagaaactggggaaaggctccgaatttccctggggctttgaagatgaatgaaaaagttggttgtaaggtgccttcaaggatgttagcatcaactggggaaaaagaactttatactttcccaacngacaaatgcacctccaaatttncnctcngatanttccaanttatccctggactgttnaactttttccaaataaaatgcccaatccctgacttnaaaaanganaaataggtggaaatgggacaaaggngctttccaaactttccgatttccttaaggncaatgaaantnaattaaaatcg

SEQ ID NO: 81934 - DNA, 182 bp, Triticum aestivum
  unsure (1)..(182): unsure at all n locations
  Clone ID: PAT_TA_81934
ttttttttttttttntttttttnttnagaanagnatcacaactgcagcntattcnggattcnnaatcaccataaggctttaaatccggcgngaacaacactgtcncagacaacaagtttancagtgtcnacaattgtnaattctcgaatncagccagtaacacacctcnggttgnncccctc

SEQ ID NO: 81935 - DNA, 624 bp, Triticum aestivum
  unsure (1)..(624): unsure at all n locations
  Clone ID: PAT_TA_81935
gctgagggtcgtctgatgaaccttggatgtgccactggccaccccagcttcgtcatgtcctgctcattcaccaaccaggttattgctcagcttgagttgtggaacgagaaggccactggcaagtacgagaagaaggtgtacgttctccccaagcacctctacgagaaggtcgcggcctccacttggggcaagctcggcgccaaggctgaccaagtcaccaancccaatctggactacatttacacccagtttgagggccgtacaacctgcggctaccggtactaatgtgtccaacacgactaacggtggcctgacctgatccngagcaacggaccaacggganccttacaacacctgtcccttccataacctanatctgtcccttaagcggagtttgtaataaggtaangtttttacctntttaaggttggaaaagcgggtttgctttncccaaaaataatggattatatggttaatnagnggggtccttcaaaaaaaggggggcccgtaccaaatcnccaaangggtctntacccccnaangcctcntttaactctactggaaaacctgngtnccaattaaccctnanaaacccnttcaanggaaacaaggccacattccctc

SEQ ID NO: 81936 - DNA, 526 bp, Triticum aestivum
  unsure (1)..(526): unsure at all n locations
  Clone ID: PAT_TA_81936
cttgctgagggtcgtctgatgaaccttggatgtgccactggccaccccagctttgtcatgtcctgctcattcactaaccaggttattgctcagcttgagttgtggaacgagaaggccaccggcaagtacgagaagaaggtgtacgttctccccaagcacctcgacgagaagtcgcggcctccacttggggcaagctccggcgccaaggctgaccaagctcacaaatcccaatcctgactacattancatcccaattnaaggtccttaacaacctgcggcctaacggtacaatgttccaacacggctaacggcggccttaaccttaatccngngaacggaaccaaanggaatccaacaacnacctgtttcccttccataacctanatgcgtcccttaaggcggagattngtaataatggtaagtttttaccttttaaggttggaaaaggcggcttgcttttnccaaaaaaaaggaatatatggtttaantaggaggtggtttccaaaaaantttgccccttntccca

SEQ ID NO: 81937 - DNA, 394 bp, Triticum aestivum
  unsure (1)..(394): unsure at all n locations
  Clone ID: PAT_TA_81937
aagaccatcaccttggaggtggagtcctcggacaccatcgacaatgtgaaggcaaagatccaggataaggagggcatccctccggaccagcagcgcctcatcttcgccggcaagcagctcgaggatggccgcaccctggcagactataacatccagaaggagtccaccctccacctgggtgctcaagcttcgtggaggcatgcaagttttcgtcaaagacgctcaaccggcaagaccatcaccctggangtgggatcctccggacaccatttacaatgtgaangcgaagttccaagacaaggaggnattccccccngaccaacactcngtnnttttccgggaaacacttnaggatggcgcacctggnaaactanacatccananganctacctt

SEQ ID NO: 81938 - DNA, 501 bp, Triticum aestivum
  unsure (1)..(501): unsure at all n locations
  Clone ID: PAT_TA_81938
gcttgctggaaccaacggtgagaccaccacccagggctttgatgaccttggcaagcgctgcgccaagtactatgaggctggtgcccgcttcgccaagtggcgtgcagtccttaagatcggcgccaccgagccatcacagctctccatcgaccagaacgctcagggtctggctccgctatgccatcatctgccaggagaatggggctgggtgcccattgttgagcctgagatccttngttgatggacctccatgacattgaccgctgtgcttacgtgactgaattctccttgctgcctgctacaaagccctcaaacgaccacattcctcctttgaagggacctccctgnaacccaatatggcaccctggttccgaccccaanaagtggccctgaagtgatttctgatacaccttcggacctccaaaaagacctccctgctgcntccccgcatngctctctccggggganaantnaggaggaggnacctggaaccnaacccat

SEQ ID NO: 81939 - DNA, 397 bp, Triticum aestivum
  unsure (1)..(397): unsure at all n locations
  Clone ID: PAT_TA_81939
ggtttccagttgcaagccgccccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacatccggcttcatcaattaccgttaagaatgggaaacctcaaaaggaagcaaagggctaagaattatcaaacgaatgtgggtgttcnacaaanccngatctttnaccctataactatgttatgaactacnattatgttttgaccccggggtgacaaaaccatgaaaccatgtttaatgacggctgtttgacatgttaaaccgatattccgtttccc

SEQ ID NO: 81940 - DNA, 265 bp, Triticum aestivum
  unsure (1)..(265): unsure at all n locations
  Clone ID: PAT_TA_81940
gaggaggtgaacatgtacatcgagctccccaagaangtgcccacnangctgattcattgtgtgttcnaggccggcnacnttgaggtcggaattcgcggcaacccgccctacctcaaccatgaccttatgcaccccntgangaccgattcttctttctgggacaataggagggncgngtgaattgcgatatcactctgnanttgaggggaanaagggggaaaagtntgggnntctncaaataaagggcaagggcncttaattccaa

SEQ ID NO: 81941 - DNA, 204 bp, Triticum aestivum
  unsure (1)..(204): unsure at all n locations
  Clone ID: PAT_TA_81941
anaaaagcatcgtctctcgtctcgtcgaggaatcaacanccatgggcggtggcaacncgcancaagtcnaagatggcgagggataggaacctcganaagctgacgggcggcanngggagccagctcnaggccaacatagantcgccatgantatccantgnaagatatnnatgcngactttcatctgcaccacctctganacac

SEQ ID NO: 81942 - DNA, 481 bp, Triticum aestivum
  unsure (1)..(481): unsure at all n locations
  Clone ID: PAT_TA_81942
aaggccttttgtgtaaatataatcatgtatgtgtttggcttcccattgttcttgcttttcatcctttggttgtttcctttgccgccctcccttggncgccgccttcccagccggacagctactctgcagtctgtggctggagaagtgcttggccngttgggagggcaagtactctagctttcttgagattgtagcanagtgaatgggtagccggccagccggctgttctgacagccggtangcgtgctgggaggccggcttgtgttatataggttcattaagtccttaaccgtttttccgtgtggggcatcctttccctgcctttgggctcttgccantcggtcaatccggtcttcnagctgcgacttcaacaaagacagggtccgggtgctggganacncttgtccnactgcaggtanattnnatatcccangggggnantccccggtctgacgntccaactggngcnggaanaaaacaa

SEQ ID NO: 81943 - DNA, 516 bp, Triticum aestivum
  unsure (1)..(516): unsure at all n locations
  Clone ID: PAT_TA_81943
ggtcttcaagcagtccggccgacttaacgccgaacacaaggggctcgacgcaccaagcgaagatgacgacgaaccccacaagcagcacgccggaaaacagaagaatttcccactagaagtcaaaacagtgaactcacttcatgtgataacaaggaaaaatagtgcggcgcctgctaaaacacgcgcagcacggtccaccccagcaagatccccgaaattgggatgtttaaaaccaatacttccgaccatcaaggattactcccagaagtgttccgaaacacaaggagggactgcttttnggtattgggttnccataatcnnacggttacaactccaacacaaatccaaatgggatggcgggaagcgatattaactgctataccaaggacacatcccgcaaaatgggggataaccctaccaaattcncgtttncaacattccttcaaagggatggacccaagcttnacccaattttcaagnttggtcnacnaaaggcctgttcggttaatcnnaaac

SEQ ID NO: 81944 - DNA, 424 bp, Triticum aestivum
  unsure (1)..(424): unsure at all n locations
  Clone ID: PAT_TA_81944
gttattgcggcattataaatttaactcatgctaagaactacattgatgaaagctctagagatagtctgatgaaacccantgtaaaatgattagctgggcttganagagcatgtaactgacttaccagtancatgctttttgtnagcttgctgaagttctgccggttctgtgtatgtagttgtggcaccgaattgagtggcaatgtgatgtgctgtctcaattcccattgtacaagctatacatatatttgcggaaaactgaatggtnncttgacgttanggattgatnctggtaaaagtgtgtgcnacncaattgcttttgaacattgattcaattggncactgtaactgcaagtattcctcccncaattgnggaaaacaatcctccgaatgtttttcaaaggcccangttaactctggatttc

SEQ ID NO: 81945 - DNA, 646 bp, Triticum aestivum
  unsure (1)..(646): unsure at all n locations
  Clone ID: PAT_TA_81945
gtagtgaggacagatgaaaaatcttgaacttgttcagctgggtaaagggctgcttcagagatcatgttggggggtctgttatacagtgcctggaaaggtgtcattttcagagaggtgtggtagctggtgttgtaccaccattccgctagggagagccagttcatccatttcttangttgtaagaaaaccatgcatctcaaagtaatttccaaagcattgnattgaccctttcctgtttgggcatctgattggagggtgatacgaaatgccatgtgcacttggatcccatttccttgaagagtgcctgccaaagatngtantgaaatgtnccctgtcaatgacaataacagaagaacccgtgtaacttaaatatattacaatgnaactttgacacaattatggcaatgatggatncgcaatgggaaaaaagccaaattttgggaaccanccacaacaactaanccagttttgcttnggaaatggaaaggcncaacaaatcaatgctgattgacacatcaaaactggaanagcaaaggtgtanatcaggtattgatgtcaggttgtnatttgacttggnatgttatgtaccaataangttctcagcantgaaattaccccgaangncgtgcaangcccacaattgaga

SEQ ID NO: 81946 - DNA, 619 bp, Triticum aestivum
  unsure (1)..(619): unsure at all n locations
  Clone ID: PAT_TA_81946
tccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtccgacgagcccccgaaatgtggcgctgcgccngatatgaatcnaccgtcagacggacctgcggtgggaccctgcaagaantactgatcngntcaatgcccggataatgaatttccgcccnaaattaaattaaagctccggacgaaatgacactcaatcntgcctaagcctgtntgtttgaccaacaaatatttatcaatattcgtgcttcntcccgtttttcctcnccaaggggggccggtacnaatccccctaaggnncgatacccgcnaaggcntcntttaaattctnacnggaaaactgcgtaccanntaacgcctgagaaacccttcgcanntgcgtaatacanaggcgaacgttgcttcanattggacctatgcaanga

SEQ ID NO: 81947 - DNA, 490 bp, Triticum aestivum
  unsure (1)..(490): unsure at all n locations
  Clone ID: PAT_TA_81947
ccaggatgttgataatgccaataggttcctttttgatcaaacaagtggcaatcagcagcactccttcatgaaacgtcccgagcaaggacattttagggcacctgaggggtattcggctaattcttctatgatgagaaatcagatgaatggtggtaacttcacatcatctgacaatcctcaagttgggatctgggctatgcttccgccaaggattgggcgcaaaggtccccaaggaggcactttacttccnaaggcaaaatttangtgggtgcatccaaactacctaaggctacaatgggagttggaancccgactggggcacttcctcttcnaaatgcctaattgatncattatatttcnattaccttgccncccaaattnccaacaanttatgatgatnctttccaaggccngtgggcaccnaaggaattcctaaaaggnttactttggcccccaaaanggttgccttaacccaatgctttaatcccaa

SEQ ID NO: 81948 - DNA, 592 bp, Triticum aestivum
  unsure (1)..(592): unsure at all n locations
  Clone ID: PAT_TA_81948
aatcttggctatttttatgctttcccactctgcctcgagttgtagttaagatactcttgtacaaacgtaggactagctggtggcttgactgaagagagatattccatatgctaatacaataatttgacaggtttgattattatttcaagtgtagaccatcctttgactgatactaaaaacatttatattttctgaatgatgaacaatatgaatgttttttaaatgagtcttttataataatgttcttgaaatgatatgtaaagtacttctaacatgtctgaagtacattttangtgtgacatggaagaagtgaaagatgaagaggagagcaccatggaatgagggcgaggctgcatgtccattgctcatgccaattgcttggtttgagagggtgtcccgtgcaattgatattggcatatacccatatccgcacagttttttttataanagcncctgntccacnaaattanagtagtagatataatagccagcgtctcagccaagtatcantatacanttantgttaaccncanttgctcaactagnatcantagacagttagancctcgtccnaatanacattcaacanctn

SEQ ID NO: 81949 - DNA, 616 bp, Triticum aestivum
  unsure (1)..(616): unsure at all n locations
  Clone ID: PAT_TA_81949
gacgagatggggctcacgttcaccaagctgttcagccgcctgttcgccaagaaggagatgcggatcctgatggtgggtctcgacgccgccggaaagaccaccatcctctacaagctcaagctcggggagatcgtcaccaccatccccaccatcgggtttaatgttnaaactgtgngagtacaagaacatcagcttcactgtctggggatgtcggggggtcaaggacaagtcaggcactgtgggnggcattactccaanaacacacagggctcatctttggttgtggacagcaacgataggaccgtgttgtttaagcaagggatgactccacaagatgctgaatgagatgantacttatgctgtnctgctggtgtttgctaacaagcatntctcccanatgccatgaatctgcctgagattacngataacttgggctgatccctttgcnaangacactggtaatccaaganacttttctanncagggaaggacgtnttaaggctggacgggcttcaacaacatngcaacaagtccaaatttctcaagatttaangactagaacncttgatgacaatgatcacggtactaggatgtttgatggatggctngcaatcct

SEQ ID NO: 81950 - DNA, 504 bp, Triticum aestivum
  unsure (1)..(504): unsure at all n locations
  Clone ID: PAT_TA_81950
gggcagcaaggacacactgacacggcgacacatggcaccccgtccactggcggcacctacgggcagcacgaacacaccggagtgaccgataaggaaacacagggcaccggtggcatcgacaagaagaaggatgccatggagaacatcaaggagaagctccccggtggtcatggtgaccaccagcagaccgctggcacctactggcagcatggacacactggaatgaccggcacggagacgcatggaaccacggccacccgacggcgggcagcaaggacacaacgaaacaactgggcactggggacacacggcacccgacgggaccngttgagaagaaacttccatggacaagtttcaaggagaactgccttggactgaactaacccnncctgcctacgccgtacctttngcaanatatanccaccgcatataattgattgatccattcnactactcattgggccttngganaacnatnttcttggttaattttcnannaaaaag

SEQ ID NO: 81951 - DNA, 254 bp, Triticum aestivum
  unsure (1)..(254): unsure at all n locations
  Clone ID: PAT_TA_81951
ccgcctccagcctagggtttcctcccgccgtccgccgccatggctcgccgcagcggaggaggaaggtcttcccgccctgctccaacgttgctgctncaattgagaaaaccaacaanggcaagcccttnaagctcctcaacctgctactacccanaaatagcggtgggnggtatcatgantggnaattgggtccaccattgctcaagggnatggtttcgggtactgggnantncaaggncnaaaaggttttttaa

SEQ ID NO: 81952 - DNA, 378 bp, Triticum aestivum
  unsure (1)..(378): unsure at all n locations
  Clone ID: PAT_TA_81952
gctcggccccttcgccggcgccgccatcgccgccctcgtctacgacatctgcttcatcggccagcgcccccacgagcagctccccaccgccgactactgaaaacctcaatctcatctcgtccatccgtcatcgccatgagagattgaaatcgcttcaaaaatccagcaagtgtacgtccgtccgccgtcatcatcagtaancanttatttcattgcgctacttgtccttggagaaatcnagggtaaacagtgtgtggcganccanccatccaggaataactcaccttcctcttatcttgggtgtatgtatgtacgtcctccaatttatgaatgcttcctattccnagggccaaattggatgtttggcacaannaaaaa

SEQ ID NO: 81953 - DNA, 508 bp, Triticum aestivum
  unsure (1)..(508): unsure at all n locations
  Clone ID: PAT_TA_81953
gctcaggatcggtgtgccggagaacgagcagtgctgcccgctcctgggcgggctcgccgacctcgacgccgccgtgtgcctctgcaccgccatcagggccaacattctcggcatccagctcaatgtgcccatcgacctgaccctcctcctcaaccaatgcggcaagaagtgcccctccgacttcacctgccccatctgatccatccaacaccatcgatgaatattatacaagcatttttttattccgtaactatttgcatgtcatacgtacgcaccatacgtatatttccaagttccaattcccggtactatatgttaagtgtttgcatgggtccctcgctccntgcatgcatgcttgataatttgtgattgatcacatgatcatttacctcattaangtacctaaatgcatgatcaagtatttgtaaaagatgtatgtgtatnagganaanggttgtccaaatgtgttacttacccgcaaanaaanggtaatnntaaaaaaaaaaaa

SEQ ID NO: 81954 - DNA, 372 bp, Triticum aestivum
  unsure (1)..(372): unsure at all n locations
  Clone ID: PAT_TA_81954
ccgacgtcgagtacctcaaagccaacaagccaccaacttgggaatacgcagtgtccaaggtgcttctagagaaggcggcgagcaaatttgcggtggagaacggcatcagcctcgccaccgtactgccagtgttcaccttggggcgcggcgccggtctccaaaggccaaggaccagcgtccccgttaccctctccctgttgtctgggcatngagacacagtgcacatcctgataagcctgcaatccggcaaccgatcccgtgtccatatccaactttggacactctgttcctgccgangtgttcnatanccnganacatcctccntccggcaaggtcatctgctgcaccacacacaacgtncntgcacttccc

SEQ ID NO: 81955 - DNA, 479 bp, Triticum aestivum
  unsure (1)..(479): unsure at all n locations
  Clone ID: PAT_TA_81955
aagcattctactcctccacacaagtgaagtgagagctttgcgctgaaagttcatcagcaactatgaagggcaccaagctcgcggcgatcctgatcctccaggccgtcctgggtcatgggagtcctctccgcacgtcaacgccgacttccttcccccaagtgctgcaacaactgcaggtccttctccgggggtccgacgtcctgcgacgacgcccaaccccaaangtccccaaagggtgctccggcgtgccgcgttgggtgtccnaacaaccccngaaatgtggggctgcncccggatatgaanccaaccggncnaacggacctgcnggtggccctggnaanaantacggatnggttnaagcccgganaatnatatttcccncccnaaaatttaataaactcgggacnaaatnacacgtnatcgtgccaaagctgtgtgtttttaccaacaatattttacaatnttcgntctcctcccgg

SEQ ID NO: 81956 - DNA, 499 bp, Triticum aestivum
  unsure (1)..(499): unsure at all n locations
  Clone ID: PAT_TA_81956
ccatcaccggcaccggcatcaacccggcaaggagcttgggagctgctgtgatctacaacaacgagaaggcctgggatgaccactggatcttctgggtggggccattcatcggcgccgccatcgccgccttgtaccaccagtacgtgctgagggccagcgccaccaattccggctccgtcggctccttccggcatccgctagattcgacggccggccgccgtctccggtgatggtccggaggcactgaactgttagatatatcaagaggacagaggggcctcccagtgtgtgctgctgttccggtccctggatcctgctggcctttgcacgctctctgttttcctcaactcgccgccgcnttgctgcttgttttcccccaaccatncaatgtgctccgtctcccttannnttgcttccatcccaatgtncnaccngttaacnataagatgatgtactgcnacctgtcatgttancatcaaagtatttggggggaatttnn

SEQ ID NO: 81957 - DNA, 516 bp, Triticum aestivum
  unsure (1)..(516): unsure at all n locations
  Clone ID: PAT_TA_81957
ggatatggtgggagctatggtggaaccggactttgaaccacacaagaggtcatctcatcgagctcgtgaattcaaccaacgtattgatctccaatgtcaccctacgcaactccccattttggacagtgcatccggtctactgcagaaacgtggtgattaaggatctgactatactactcccctggaatgctccaaacactggatggatttgatccaagactccaantcnagaantttgtgtccgaggactggctatatccgaaagtggagatgaccttggttgctgtccaagaggggttgggattnatatgggatatctgtnaggaaacccaactcaaacatttacatcccagcggnttcaagcaccaacctacttctcccgtgtgggttcnngaaccaatttccggttggatacaaactgcttgtccgcgactccanatatgganccncttccgcnatnaggtnaaacnatttnggcccgggggtacataacaacncacatcgcaaagttacatg

SEQ ID NO: 81958 - DNA, 439 bp, Triticum aestivum
  unsure (1)..(439): unsure at all n locations
  Clone ID: PAT_TA_81958
gtcgccgggctggccaagtacccgaagaaggtgatccgcaaggactcggccaagaagacggccaagaagtcccgcgtcaaggtgttcctcaagctcgtcaacttcacccatctcatgcccacccgctataccctcgacgtcgacctcaaggaggttggctccggcgcgcccgatccctcacctcccaaggacaagaaggtgggcgcccgccaaggcccgccaaaggccaactccgaggagaggtcaaagaccgggcaagaacagtggtccttcaaccaantccgcttctaaggccggccggcgcgccaaggcggctctggccgttattactacccgacctttaatttttaattcttggtatcngtgactgttgctgccttaagtncctgttttggtattcccangaanaaatcctgtttnacttggtcttatnataaaa

SEQ ID NO: 81959 - DNA, 198 bp, Triticum aestivum
  unsure (1)..(198): unsure at all n locations
  Clone ID: PAT_TA_81959
ttttttttttttttttttttttttaggatgtcaagaccaacagcataaacttggtccataanaanctcagtangattggaggacaatgnatttanggnaaattgcccagtancgattcagggcacatnctcganctcanactcaanccctatgntagnanatgttttgagaacgcngncgccaacctacgacaacctc

SEQ ID NO: 81960 - DNA, 634 bp, Triticum aestivum
  unsure (1)..(634): unsure at all n locations
  Clone ID: PAT_TA_81960
tttttttccaagaactggatagtacacaatgctccacagttcgtacgagttagcggaaggacatcatggatcagctagtcggcaatgacatgctcgatcatgaactagggtgtaacattttgtgagaaccaggtcgatctggagtcaaaccacgctttgccatatctgaatcaccgtcacatactagagtttggatttatccgatgctccgctctataaggcacaagtatttcctgattttcccaagagatcaagaatcaatttaattgggggcaaacggccaacctgcaatngaggatgccggctggaaatgatgtttgaagaaacaagtatttgtgttaatgcacacnaccaagcaccatgatgttgaagaantacgaagcctacaacaaagataacttgggcgaaactaagaatcattcctgcaagactgatgaacttcaaggcaacantctttgccaaccgancataggcantcaagccccaacgaggtttggaagnacctccggaaccaancatttactgtcacaaaacagctcagttttctcanaagantgcttgnaccacagctatgtgtcctcaacaaatacttactcantccanncaggaacaacagcaaatcncgtnataaaaa

SEQ ID NO: 81961 - DNA, 383 bp, Triticum aestivum
  unsure (1)..(383): unsure at all n locations
  Clone ID: PAT_TA_81961
gaattctttagntaaagaatttgcaaatcttgattgcaaaggaccaagggaatatgggttgcgccacgtaaagaaaatttctggaactttatattccatgggttgtgctggatgctatgaanagcacttgngattcttcncatgagtctgtcaaatttacgagcccacttgacaagactgtngggtggtttactcnctanatctgtcaaagattangatactttcattgcccgacagttccctgcaaatgcngatgaaaagagtgtttgatgcagttaacaatatgttgttnggatggttggaattgnatggttttaactactacccnngatccaaannnttgacganccnaaaacaaatccttnagacaaccatnnggatac

SEQ ID NO: 81962 - DNA, 637 bp, Triticum aestivum
  unsure (1)..(637): unsure at all n locations
  Clone ID: PAT_TA_81962
tccccaatgaagagtattttccaggttacttttgctgcttttaagaacatgagcttagaaatccctgccgatagctctcttctttatgaggccaggagcaagaacacacacaagagaggaccgagattagctcatactgatgatttcaggttcttggataaggcagccgttattctggatcttccctttggacaacagcagttgccaaantcttgggaggatctgntactgtaactccaagccgaggaattggaaaatactaatcccgactgcttcccaattttggggcgactgggagtatccttttgcttcctncatctcaacaaatgcacactaccttcattccaagcaaggaaccgttgatgaacaccaaattggtccctgtccatccnacacttccttgnatcccttttgnagtganngtgtgaactttggtctcctaatgaacaaancattgtccaacgaccaagaanctcacaaggggacggactaacacagtgcaaggtcgggatggcgttccaagntcttgcatgnaaggngcccttaaacaaagngntaanacgtcacangaatcatancaccgtgaatgcgatattccacntgggaaagttccaatgcactggtctcagcagacgac

SEQ ID NO: 81963 - DNA, 552 bp, Triticum aestivum
  unsure (1)..(552): unsure at all n locations
  Clone ID: PAT_TA_81963
ctcgccatcaacacaggtgcagctgcaggggaggcgattaagcagtcgccgtcgatgccgacgaccccgaccacgccggtgacgccgtcgtcgtccacgccgccgcgcggcggcagcgtgtggcggagcgttttccaccccgggagcaacctggccaccaagagctccggcgccaactcttccgaccgcccgcagccaatcccccaccgtctacgactggttttacagcgacgagacgaggacaaggagcaacaccgctaaataagagccttcggncaagagaactgaagcagggtgtccaacactngtgcgacgcccgcatgtttctgtccttttgggtaacctatccctgcgtagcgtacgttgcttcccaggtgcatgttgtttgcctcnactttcntatactgtctacnatgcttgtacttatttccctgggtccgtatctcnctgcatgctaacnattatggtgtangtgtgtcngtgtaactccagctgtgtaatcnctntgtggtgtgtggcctccaatgttaacactatggtaagaaataaacc

SEQ ID NO: 81964 - DNA, 506 bp, Triticum aestivum
  unsure (1)..(506): unsure at all n locations
  Clone ID: PAT_TA_81964
gatgaacaaaaacaagaagctggtcaagaagcttgcaaagaagtatcatgctttccttgcatctgaggctattattaagcagattccccgacttcttggacctggtcttaacaaggcaggaaagttccaactttgggtgtctcaccaggaatcccttggagtccaaggttaatgagaccaaggccacagcaattccagttggaaaaaggtgtttgcatgggtgttgccgtttggcacctgggtatggaggagaagcagattttcccaaaacgtgcagatgagcgtcactcctcctctctccngttgnaagaagactgggaaaacgtnagatgcttgtacctgaaagacacatgggaaagtgtaccgntgttccaaagtccagccttccnagtttcccaaggaattgacactgggactttgtgcttcncnattacatttcctgcctaagatgnaatatgcctggacngagacttgtcaatggccggatngatgcattannaaaaaaa

SEQ ID NO: 81965 - DNA, 600 bp, Triticum aestivum
  unsure (1)..(600): unsure at all n locations
  Clone ID: PAT_TA_81965
gaggcacccgcggccgccgaggcggtgccggcagaggcaccagctgctgccgccgccgccgacaaggccactgagtgagttgatgcgcgcgggtgcgatcgtgccccgtgtagctagcctttgcctgtgctggctggcttccgtgcgccgtgccgtgacatgccatgtgcacgctacctattccgtttattattgggtcccgtatgttgtgggcgtattnngtgagtggccncgtcgttgtcctctggggtgcattgtacgtgatgttagtactgcgtnnttaagtagactgctgcgttaaatgtccnatcaatattgtgccctatctanccnatgtgtgtccttctccgngtgatttcaataagnttttccggtattccccccccaaanagatngngggatttggaaaattgtttgnattttntttanaagggttnacccctnaaacccttaaccacccgtttggaaccaaccgaaaaggctaagttcnttcgttcgtggnntccgggncaatgtaatnttcctggnntacnggttggngctatttacnctttttctgggttcnttgnaaaaaaagngancntttttaaaaaaaaaaaa

SEQ ID NO: 81966 - DNA, 391 bp, Triticum aestivum
  unsure (1)..(391): unsure at all n locations
  Clone ID: PAT_TA_81966
cccgccttcctccacatctcctcgcctccaccccatccagttcgtgccattcgctgctccaagacaagggcatggcgctcggcggctgcggcaacgaagctgatggtgcacgagccaaccatgaaggcagtagcacggggcagcgacagcagcatggagggcgtcctcttgtttgggaaggtaatgggaactgcaaataggagtggcagcggcgaccatgatgcaaatggaagtggtcccaaaacttgggaagaatggcacgtggagcaaaggtatcaaganctttttggtgtttggancttttgnctgaagcttcaaatanctaagttgccttttgggaatttccaagtttaaggtttaaanctttttgntgtaccgggcaattnaattt

SEQ ID NO: 81967 - DNA, 472 bp, Triticum aestivum
  unsure (1)..(472): unsure at all n locations
  Clone ID: PAT_TA_81967
gctttacctaccgagaagaagagagaaaaaaggttcgagtgcgttgcagagtgagaagagatggctccggtgaagctgtacggcgcgaccctgtcntggaacgtcaccaggtgcgtggcggcgctggaggaaggccggcgtcgagtacgagctccgtccccatcaaacttccggcaccggcgagcacaagagccccgaccactcgccaaggaacccttttggccaagtgccaactttncaagatggtacttgtactcttccnatcaacgtgcnatttcaagtatcntgccggcaaagacaagccaaanctgtttaaggagggcacatcnagganccacaantgnggtttttttgnnccaggntggaggccaacattnaacggcgttttgacccatttctttncggngcttaacaaccnnanctttggggaaccactgncaaaaggcatgncaaaactntttaaattaaaact

SEQ ID NO: 81968 - DNA, 553 bp, Triticum aestivum
  unsure (1)..(553): unsure at all n locations
  Clone ID: PAT_TA_81968
cgccattggcgtttcagcgaccaagggcgaggcgtggaggaacctctggacgatcgggctccacaagatctttgcggcggtggccatgggcattgcgctcctccgaatgatccccaagcgcccgttcctcatgacggtgctttactccgctggcctttgccgtgtcaagcccggttggggtgggcatccggaatccgccatccgacgccacggcggagggccggcccgcaagactgggacatatgccactccatggggtatcgccacggggattttccgtctacgtcgccatccaaccacctccatgggcaaaggggtaccgcccacatcaaaccaattacttccgacaanccacttcaantcctccngtgtgctcaaccggctccctgtcnagggccgtnggaatgattggggacggattaccatcctgttaaaccaacggngattganttgaccctcaagtgcatanataaatgcttnattcacttgggtttcccggggtggatngtcacataagtgttaaaccgaatngataattggtaaaaaaaaaaaa

SEQ ID NO: 81969 - DNA, 640 bp, Triticum aestivum
  unsure (1)..(640): unsure at all n locations
  Clone ID: PAT_TA_81969
ggtgaacaaggatgatggtgggaaccaacctgaatttcttgggacagcagacgaagataagaatgccatggatcttgggtactctgaggtggaaaggagtcgtagattggagttcatgatggctaagagaagatcaaggaagaacataatatttgatcttggatggaaatgatgcttgtcaagagtgcagatagntttccacgtttcccgtatgcaantcaacctatttccagtatcaaaggagaaccctttttgaccttgcttcccggattcctggacgaagcaccatccctgggtccngtcccgtcaatcatcatccggcgaaatacctgtttggacccctttcctgaacaatccaagatnatagcagtgtacctgcacatgatactttggctcctccaagaatcataacagntccccgcccnnacatatcttcaaaganaatatccttcnactttnngcggcaanaaaaacntcccaatttaaccagtccttccggtcaagggttccaggaaagatgcattcaaaggaataatgcaaatttcaaacaatcgtacnattaaccttctcgtcgtaaagaacanaccnncaaggttcaagggtatgancattaangactttttcacgaccttnttgccat

SEQ ID NO: 81970 - DNA, 475 bp, Triticum aestivum
  unsure (1)..(475): unsure at all n locations
  Clone ID: PAT_TA_81970
cagcgtctcatttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctggaggtcgagtcctctgacaccatcngacaacgtcaaggccaagatccaggacaaggagggcatcccacccggaccagcagcgtctcatctttgctggcaagcacttgaggatggccgcactttnggcggactacaacatccagaagganccacacttcacttgggtgctcccgttctgcgcngtggccaattagctccctgggccatggtttgcttccgtctctggggttnanaatctccgtttcctcggttcctccaaatgganctggctgtgtccnttgatccngaacgncttggttggnnacanatacgtgatcatgta

SEQ ID NO: 81971 - DNA, 379 bp, Triticum aestivum
  unsure (1)..(379): unsure at all n locations
  Clone ID: PAT_TA_81971
cccaatggcccgcacgaagcagacggcgcgcaagtccaccggcggcaaggcgccgaggaagcagctcgccaccaaggcggctcgcaagtcggccccggccacaggcggcgtgaagaagccccaccgtttccgccccggcaccgtggcgctccgggagatccgcaagtaccaagaagagcacggagctgctcatccgcaantccccttccagcgctcctccgggaagatnncccaaggatttcaaagaccgactccgttcccatcctcccgccgtctcccgcgctccaagaaagccgcccgagcgtactccgtccggtctttccnaggacacaacttctgcgcatccacgccaangcgtcacatcatcccnaagaatcca

SEQ ID NO: 81972 - DNA, 460 bp, Triticum aestivum
  unsure (1)..(460): unsure at all n locations
  Clone ID: PAT_TA_81972
cctggtgccctccagtacctcagcggcgtgatcctgtttgaggagaccctgtaccagagcaccaagggtggcaagcccttcgtcgacatcctcaaggcgggcaatgtcctccctggcatcaaggtggacaagggtaccattgagcttgctggaaccaacggtgagaccaccacccagggctttgatgaccttgggcaagcgctgcgccaagtactatgaggctgggtgccgttccgccaagtggcgtgcatcctcaaagattcggcgcaccgancatccgcagtctccatccgaccaaaacgtcaagggtctggtccctatccacatctgccaagagaatggcctgggtgccattgtgggacctgaatcttgttgatggctccatgacaattnacgctgtgcttactcacgaattnccttgctgcctgctataagcctcaaacnacaacatncctcctcc

SEQ ID NO: 81973 - DNA, 563 bp, Triticum aestivum
  unsure (1)..(563): unsure at all n locations
  Clone ID: PAT_TA_81973
ggaagcgtcgcgttctcttgcttgtttcccaagaagaagaaggagaagagcggcgtctgatctcgtcagcggcgatggcggcgattcggcgtctgatcccgtccttcaaccgggtgctggtggagaaggtggtgcagcccaagaagagcgccggcggcatcctcctcccggagacctccaagcagctgaactctgggtaaggtgatagctgttggcctgggcacccgtgacaaggaagggaagctgatccctgttgctctcaaaggaaggggaccatttctcctgcctgatatggtggccttgaatcaacttgctccccgagaaaganactcctctacaagagacgacgaattctgggacctccaacgannatcaaatgtgtggaancancaactgctttnatgcaggaggagagattttagagtcccaagttattgggaaaactttaaataaacncctttaatggngtgataantttactccaacacatgaatngatatatgttgcaaacttcttctgatcaatcataaactgnactgaatgtgccttaatttcgcaaaaaa

SEQ ID NO: 81974 - DNA, 363 bp, Triticum aestivum
  unsure (1)..(363): unsure at all n locations
  Clone ID: PAT_TA_81974
tggcagtgagggtgtcaagggcaccatcttcttcacccaggagggagagggcccgaccaccgtgacgggaagtgtcaccggactcaaggaagggctccacggcttccatgtgcacgctcttggggacaccancaatggctgcatgtcaactggaccaaaacttaacccccgctngtcatnttcaatgggcaacttgaagantaaatncgccaatnntgtattcttggnaantttaaaacntgantttgatgtggttccaacaataatattctnattgcanaacccccttaangaccaaattaatttttgccttccgnttttctcaatgggaacntaaattnttggaaagggnnncaataatta

SEQ ID NO: 81975 - DNA, 621 bp, Triticum aestivum
  unsure (1)..(621): unsure at all n locations
  Clone ID: PAT_TA_81975
tctgtctttgctggtgttggagaacgtacgcgtgagggtaatgacttgtacagggaaatgattgagagtggtgtcattaagctcgacggcaagcagagtgagagcaagtgtgctcttgtgtacgggcaaatgaatgagccccctggtgctcgtgctcgtgttggactgactggtttgactgtcgctgagcatttccgtgatgccgaaggacaggatgtgcttctcttcattgataacattttccgtttcactcaggcaaactctgaggtgtctgctctgcttggacgtattccatctgctgtgggataccaacaaccttgctaccgacctgggaaggctgcaagagcggattaccaccacaaaaaagggtctattacatccgtgcaaactattaagtgcctgctgatgactngacaaattcggccctgctacactttgcccacttgatctacaacgtgctccacnacagattcgaactcggtattancctgcgtcgatcttggatcacatcaaaatgttgtccccangtctgggaagncacnaaanatgccnngggtcaaaagtctaaaatnnagaactcaagatatatcanttggaaggtaccatagncacaantaaanc

SEQ ID NO: 81976 - DNA, 554 bp, Triticum aestivum
  unsure (1)..(554): unsure at all n locations
  Clone ID: PAT_TA_81976
gatctggtttggcgcccaggcctgcgtgcggcgggcggcccaaccaggttggctcgtgttcgtcgagtttctgcgtgcggcggtgacaagtctgttcctggtagtgtgtgcatggcctttttctgcccggtggcgctggcaggcctcggatccatgtttgttggcggatgactcggcttcggatgaagatcctgcactgttcttgtcagtgccggcggtaacggcatctacggatgtcgtcttcctccttggaggtaccgccgtggagctcgttttgctcttcgttcctcatggctcgtggtctccgggtgaaaacctaagatttggctaggccagatcgggtgacggtgttgtcctcgatatcactccctccttgggaggatccccttgggaggcccaacaatggtcctgatggtgtacatggcttgttggtggagcttgggtttgtggtgggtgccgactttttcttcttccttttgcacnancctttgctgtgcttccntctnaaggtccttgtaaccctctttgatnaanaattggaacctatgcaactt

SEQ ID NO: 81977 - DNA, 252 bp, Triticum aestivum
  Clone ID: PAT_TA_81977
agaagatcaaatcatgagaccccaggattcaggacccgtatgtgtatgctttgacttcccctgttctcagattggattcttggtcgtgtaagatatgtcagcattactcacagcattacagttaaacatccattgtattctcaccgtgtatgctgcaattgtacttactgctcatcattctttgcgtgaccaaagatgcccctggttatgaatacaagttccatttttgtgcagcagttcaaaaaaaaaaaa

SEQ ID NO: 81978 - DNA, 631 bp, Triticum aestivum
  unsure (1)..(631): unsure at all n locations
  Clone ID: PAT_TA_81978
gaaactgaaaactgccatgatgaccacacctgtattggtgctgcccaactttgatcaacaattttgcattgaaacagatgcttgtgctacagggattggggctgtactgactcagggaggtcaccctgttgctttttacagcaaggctcttggtgtgaaaaatcagtccttatccatttatgagaaggagtttttagctatcatggtggccgtagagaaatggagagcctatttacaaagaggtccctttatcatcaagacggatcatcgaagtttgtgtcaattggaagatcaggtctcaccactgatgtgcaaaagaaagcaatgactaagctagtggggnccagttccaattccaatataaaaaaggaagtgagaatttagcagctgatgcctctccaagagtgggacatttgttaacaatgacaaccacatctagcaaccaacctgtgtgggctacaagaagtgataaatcttatgaatggatcacatgctcaagaattgctaaaaaatactattctctgagacactcaaaatatcctggcnaagggngttaacacaagcaaaattggttgngctacaagttaaaaaaactattcgatcancatgaatgaggcatctgattaacact

SEQ ID NO: 81979 - DNA, 368 bp, Triticum aestivum
  Clone ID: PAT_TA_81979
cgcaacatcaccggcaacccagaagtcagggtcaacaagatggggagggcagcaggagtgcttgagaaccatgaggagggcaggcgctacgccgagcacggtctcagagcctatgtgcaggacaagacccccgagatcatgccaggaatcaacaagttcttcaccagcccgaaatgaagcactttagtctctctgtgactcgctattagcaactgttgtggtcaagtgcaaacctatttcaagcattcagtaatgttgtcgcgtccataattcaagaggatatcataaatacctcttattgaaagaaccatgtgatgtttggatggcttgctatatatgtgatggttgatggcttcaaaaaaaaaaaa

SEQ ID NO: 81980 - DNA, 640 bp, Triticum aestivum
  unsure (1)..(640): unsure at all n locations
  Clone ID: PAT_TA_81980
gcgagaggttaatatcagtaccaactgaaagatttgtggagttccattgccttgaagaattggaggtggtttattgccgaaatatctgctcccgaagtttggtggctccttcactcaagaggcttgtgctgggttgttctggggatttagcacacaatattgagtgttgctccctcactacttcttcttatattattcccgccacactccatacacctacaacatcttcccaccctaatgantttganattgcaaggtgcgancctccttacatcctgtggaaccagcgatcttcactacttctccccattgtggggtgcattgccaagcggatacatcctccttgtnccttaacggggcnaccattaaccggtngcacnaacnncaacccttngangccccctnacaacaagatgctgcctgccnttnaaagtttatattgcacactngcacaattcccncccncccgganaagntcgnattccttgtcnaaagactggagattatgatgcaactcggacggnaagggangggtcgtnagccaaggtctacggcaagtggganaacgatggtccacgcgaaacncctattttccgatcatncgnnaaacatcaggcattggcacctncnccaagttann

SEQ ID NO: 81981 - DNA, 546 bp, Triticum aestivum
  unsure (1)..(546): unsure at all n locations
  Clone ID: PAT_TA_81981
tgttttcttagtgaacattcatttccctccagattaccccttcaagccaccaaaggtatcttttaagacaaaggtcttccatcctaatatcaacagcaatggaagcatatgccttgatattcttaaggagcagtggagccctgctttgacgatctccaaggtcttgctctctatctgttccctgctgaccgatcccaacccggatgatccccttgttcctgagattgcccacatgtacaagacggaccggcaaagtatgagacgacagccgcagctgggacgcaagaatacccatgggttgaaacctgcatcctgggacaactgaatgtcccttcaaagaaaaatttaggncatgtttcttccatttgttccggtgggtgtatccgttcctccaagattgtnaatgcattcgggtcggcctacancattgccactagtnccggaaacatcagctacaacctatcactagcttgtgggttactcacatgttggngtattgggaatgtcataaanagttgctcagactgtcaaattaaaaaaaaaaaa

SEQ ID NO: 81982 - DNA, 341 bp, Triticum aestivum
  unsure (1)..(341): unsure at all n locations
  Clone ID: PAT_TA_81982
aggcgcaccataacctgttcggcaaaccctccgaccatccaaaccgcactcgttctcaccccatgtcccgtcgatggaggcgccgagcagcagcagcagcctgctgagccagatggagagccacctgtccgccaggagcagcgccggcgcgccagcgacctccaccgggcaccggcagcgtgtccagcgcctcccgcccgagcaagaccggttccggtgggacgcccggagtgcacgagcggttcntggctgcctttancaantccngcggcgccggacaagggancccgaaagggnttctggaacttgatgaatcccgacggctcnacatcttaccacat

SEQ ID NO: 81983 - DNA, 336 bp, Triticum aestivum
  unsure (1)..(336): unsure at all n locations
  Clone ID: PAT_TA_81983
gcgcggctgacgcgggttggggatgctgtttcgttgccgttgcccgccggcgggggttgaagccaactccgccggaaggagcaacgttggcggagggacgacgtggtgggggcccgccggggctccgcgctgctccgcttccgtccgaccaagcacgcccgtggcccgagctgtngaaatgtgaatgttgattgggccggtcctgcctcccggatgtgttgttacataatgggatttgaactggggccgggctgccgtcccnatggggctccccaagaaataaacggncctccttcccttgaacccctttatcccaaaaaaaanaagggggggggg

SEQ ID NO: 81984 - DNA, 340 bp, Triticum aestivum
  Clone ID: PAT_TA_81984
cggctcctcggcgacgcgcccatctccgtcgccgtgcccgtcaccaacgccaccaccttcgccgccaccgccgtcgccgccgcgctcctcggggaggccacccgcgccgcgcccgccgcactcggcaccgcgctcatcgtcctcggcgtctgggtctgcatctcctagctccgctaacttccaagggtcccgactgcatctgcatcactgtcctcatctgtcttccaatgttgtctgcagaataatctgaatttggctactggtgtagtaaatgtttgaattcatattttgtgccttttgatgctaaaatgtacgctgaatgcgcttattttttccaaaa

SEQ ID NO: 81985 - DNA, 623 bp, Triticum aestivum
  unsure (1)..(623): unsure at all n locations
  Clone ID: PAT_TA_81985
ggtgctgagtacgttgttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaatctgacatccgacattgtctcccaacgctagctgcaccactaactgcctttctccctcccttgctaaggtttacaaatgacagttttggaattgtttaaggttttgatgaccacagttcatgccaatgactgcaaccccaaaaactgtttgatggccttcccaacaagactggaaaagtggaaaggntgccactttaaatcattccnaacaaantgggcccccaaagntttttgnaaaggcncccaactttaangaatttactggangctccttttccacggtnanttccgtgtnnttaacgttaattnnaaccccacctnttaattaaggggcataaggnggtctnnggaanccagggattgggtacttaaaagaccttttcangatncagggaaaangccanatntnatcaggcgantttcntacaaantttaanttnccctgaaaacatggaaaaancccnggccccn

SEQ ID NO: 81986 - DNA, 335 bp, Triticum aestivum
  unsure (1)..(335): unsure at all n locations
  Clone ID: PAT_TA_81986
acaaggnccacgncnggatcncccnccacnaggacaagaancangaaaggatggaaagggaaatggaaataaagaaaatgcaagcagaccnaattgccnaagcaaaagagaagtgaatccatgattgtctttccgccaatggtttcaaactagttgctttgtccatattttaactttccaaagtggataancttgggctggatgttatgccttggacacctcccnaataaaccaagttgttataacttccattggaatgccaagaggcttatgctccatgtttaaaccatgtttaattttataaaacagcataacccacttcnacgccttgggtt

SEQ ID NO: 81987 - DNA, 646 bp, Triticum aestivum
  unsure (1)..(646): unsure at all n locations
  Clone ID: PAT_TA_81987
ctccgacgccatcttccgacagagccatgcaggtcttctgaatctatgcattgttgtgctgattgcagtgaacagcaggctcattattgagaacttaatgaagtatggcctattaataagagctgggttttggtttaagtgcaagatcgctgggagattggccacttctgatgtgctgcctcactttacccattttcccacttgctgctctcatgaccggagaattgggtcaaaagaaantcatccgtggatcatgtgtctatcctcccccatataattattacaaccactgtccttatcctatccggtgntgtgatccttaaagtgtgaaccacantatatcctggtttgtgnttatgtccattgcaanatacttgggtgancttgncccttttgctccatacaattagatataagtattgnccccaaantatngaaagggtgctacacagggattctaccnagaagaaaattaaagcccaactncaacaagtgtgtatcangttggcccaacactggtacaaccaatttacccggcanattatanaaaggtggtcaccggaactataaagtgtattttaagcttatggctcaaatggcataataaccattgganatcaacacatgacgaanttttgncatgaaa

SEQ ID NO: 81988 - DNA, 584 bp, Triticum aestivum
  unsure (1)..(584): unsure at all n locations
  Clone ID: PAT_TA_81988
ggaagatgtaccctgatctgacggagcagggcaagcgccgccgccgaggtcgccgccgtggtcgtcctcggcgtggcgcctgagaacaaggcgggacagttcgaggtggccgccgggcagtccggcgagggctgcagctgcggcgacaactgcaagtgcaaccctgcaactgttaactgcatgcaccctacgttatacgtgtgatggtgttgagagtataccttgaataacgagcgtctgattctgatggagtcccacaagtttgcgtgtgtgtgtngtttacttctcgctctcccttctatgtctgccctttctntccctgtgtgtatgtgtatcatgttcccctgtattnttcancctactccaactatgttggttggtgatatgttaagatgnaaattttcctnattactacncccttaanaaaaaaaaaccgnagggggggncccgtaccantncccctaaaatgnncctatanccccctaaagggctcctttaaactcctnacnggaaactgggttaccaantaacncctgagaaaacccnttncactgngtattacaaaggcccaccnttncctccac

SEQ ID NO: 81989 - DNA, 610 bp, Triticum aestivum
  unsure (1)..(610): unsure at all n locations
  Clone ID: PAT_TA_81989
atccagtcgatttcgagtttgcccttctcatcctcctgttttcgttgacctcctcctcgttgctgcttccttgttccaggacccaggaggatcgtcggagatgtcggacaccgatgagcaccacttcgagtccaaggccgactccggcgcctccaagacctaccctcagcaggccggcgccatccgcaaggggtgggacacatcgtcatcaaggcccgtccctgcaaggttgttgaggtctccacctccaaagactggggaagcatggtcacgcaaagtgtcactttgttgccattgacatctttaatgggaaaagaacttngaggatatcgttccttcatcccacaactggtgactcccccatgttgaccgccaagattatcaactggattgacataactgatgatggatatgtcaancttctaactgaagatggnaacactaaggatgacctgaacttccacgataagttctgcttgggcaaattaagacggattnctgatggaaggactgatccgtcgtgattccncaaggtgaaaacaattgcncgttaaggaacgtggngaaataacactttctggttccaacncaaactggancaagcntgggg

SEQ ID NO: 81990 - DNA, 455 bp, Triticum aestivum
  unsure (1)..(455): unsure at all n locations
  Clone ID: PAT_TA_81990
tttttttttttttttttagcataataatagggtaaggaatgtattcattgcttttgaaggtacaagatgctgcagcgtctcaacagaaataacatgagagtttgcagaaatgaactctgccttctgaattagcagtggtatttcatttcaattgaactaagaaaacttgggccacatctcacatgcaagtatctgggtgctctagcatgcgtgtagatggaaaaaacatgtgtatccatattantctttggaggtaagtcaatgncttcccactggatccatttacaaaaaatggaagatctggataagaaccgactcccctggcatcctatgtcctccctgaaagttatcaccttggggaccccgtgctgcaaggactggaatttaanacagccncttttgctccaacaacgcccggggcccaaggaagaaaccctcctgaacgcaacgcagtg

SEQ ID NO: 81991 - DNA, 345 bp, Triticum aestivum
  unsure (1)..(345): unsure at all n locations
  Clone ID: PAT_TA_81991
ctcatctttgccggcaagcagcttgaggacggccgcaccctcgctgactacaacatccagaaggagtccaccctccacctggtgctccgtctcaggggtggtatgcagatcttcgttaagaccctcaccggcaagaccatcacgctccgaggtcgagtcatctgacaccattggacaatgtgaaggcgaagatccaaggacaaggagggcatcccaccgggaccaagcancgcctccatctttgctgggtaagcaantcccaaggacggccgcaccctccgctggactacaacatcccaagaagganccaccctcccacctggggtccntctcccgttgggtggc

SEQ ID NO: 81992 - DNA, 281 bp, Triticum aestivum
  unsure (1)..(281): unsure at all n locations
  Clone ID: PAT_TA_81992
ctcatagcggcggctgcgtccctgctgctcaggtgtctggtttctgcccggcttggtctgcaactaccactgcatgcaacggttatatatgttagtaatgctttgggttttaactactcaaattagtataatgatcttgttgtgtaccatatccagtgttgtgttgtgtttgtaaaatacacgcggtgctgtatgtgtgtgtacactgtacatacatgcatacataattacatatacggcggcatgtatgtgtgtccanttgcatgtttaaaaaaaaaaaa

SEQ ID NO: 81993 - DNA, 546 bp, Triticum aestivum
  unsure (1)..(546): unsure at all n locations
  Clone ID: PAT_TA_81993
gcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcaccatcatgcccaaggacatccagcttgcccgccgcatccgtggagagagggcctaaggccgcatctgtgcgccgtgagtgtttaggccaccttaacctttgtccaagcgttgggaaatgtatgcgtgctagtgtttttccntccnatgggtggatgttagtgtnccngattctgatncacgtcttgctgcnacnattaactgaaatgaaatttgcattccnttccnaaaaaaaaagggggggcccggtaccatttncccnaaangancctattaccggctaaatggcgtcntttaaaagtcntgacgggaaacccngggttaccaaattaacncttgnanaatcccctttcnnagtggggtatacaanaggcccactnttccttcaaaaatttcnacct

SEQ ID NO: 81994 - DNA, 478 bp, Triticum aestivum
  unsure (1)..(478): unsure at all n locations
  Clone ID: PAT_TA_81994
cgcatttatacgagctgtcaaatcacaagccccgccttccagcagtaatgagctgtcaaatcacaaaggccctcacctctcgtgaaaccgaccaagctagactgccccgccctctagcctttcaaaaatgtatacttttgtacagcggtagtatcgatggattgcgccatggagcaaaacttggaaattaaaaaaaggtggtacatatagagagcgctccgtcgccaaatttatgcatatagtactattaaaaaggtagtccacaataatggtgtccagcataaccaccctcaaataaaactaanacctggattctttgacaaaactaacancctgaattcttngcaactaaactgcnggtatatganttggcaatataatggtncnntataatgtgaagaacnanggtagtacatncaacttaaagatgaacgttagaatactanagntcctnctgaaangaanttcaagagaaata

SEQ ID NO: 81995 - DNA, 645 bp, Triticum aestivum
  unsure (1)..(645): unsure at all n locations
  Clone ID: PAT_TA_81995
gatcnaaaatttgaatgaagctcaattgtatttcagttgactacatgacaataattgtgcagtgactttgtaatcaacaatcaacgacatgacaagtacaaatacaaatgcaaatcatgcttggttaatttcgagacgagccgcccttcttcgccagctgaacgaanagggtgtcngtcgaagacggtgcgtgcgttgtccttgtgaaggaagcctccttgtccttggcgaggctgtacagcaagcccactccgccttccgacgccgccttccctatgtcgtcgccgtcctccctgttcgcggtgcgcacgcctccaactcgctctcgttcacagcgttcggttcaccttggatcttgggtgatatnccttgacttcaagggaacaactcccttaactcctacnaccgcgtcattccggggttcccttgggggantccccaagtnatgaaatcangcnanatttaagccgggcctggtccatgatccttnanaagtnccttacggggctcgaaccaagacgaggtcaacctnccgtccgnaaagaacatcctcttgcgntcaaaaccangctngaggcttgcaagcaaccccgnncaccaatgncaaggaaanaaaancggngncgacccngggaccanntgcgg

SEQ ID NO: 81996 - DNA, 440 bp, Triticum aestivum
  unsure (1)..(440): unsure at all n locations
  Clone ID: PAT_TA_81996
tacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgantccacaggatgctgaatgaggattgattacgtgatgctgtgctgcttgttttgctaacaanaaatcttcccaaagccatggaatgctgctgagatnnactggatagcttggcctgatcccttcngcccagcgacactggtacatcccaaagaatttggcaaannnaaggggaagaactgtatgaaggccttgactggctgtccaacaacattgccacaatcnaaattttccnccaaattttnaaagactagacccttttgatgacattatcacgggactaagtgttttngatg

SEQ ID NO: 81997 - DNA, 442 bp, Triticum aestivum
  unsure (1)..(442): unsure at all n locations
  Clone ID: PAT_TA_81997
gttaccgcgatgacttctatgagtacagacatgtaatcttgcngaangagatggtctcttgcttaccgaagaatcgcttgatgtccgagaaagagtggcgaaaccttggagtcacacagtctcctggctgggttcactacatgcagtacagccccgaaccacacgtcctgcttttccgacgtgcaatcgatgatgagaacaacaaataacttctccccatctcctccaaaaaccaatccgaattctttatcatctgttgtnaaatncnctgttctcaatgagcattctccgtcaactaacagtcagtttccgttctgtttgagccctgccaatccttggnactaatgtacatttcccttgttccaacgaatacgacgagaatctttttctcacgctactcaagagaanaanacaaaaatccgaggggggcccggtaccaaat

SEQ ID NO: 81998 - DNA, 675 bp, Triticum aestivum
  unsure (1)..(675): unsure at all n locations
  Clone ID: PAT_TA_81998
tggnggttgagtcctcggacaccatcgacaacgtcaaggctaagatccaggacaaggagggcatccctccggaccagcagcgtctcatctttgctggcaagcagctcgaggatggccgcacccttgctgactacaacatccagaaggagtccaccctccacctgggtgctcaggctccgtggtggcatgcagatatttgtgaaagaccctcaccggcaagaccatcaccctgggaggttgggncctccggacaccatccgacaacgtcaaaggctaagattcaangacaaaggagggatccctccccggacaagcangcttgatctttggctgggcaagcactccnaggatggcgcacccttggcagactacacatcccagaagganccacccttcaactggtgtcnaagtccntggnggatgcnaatattngtgaagacctcaaccgggaaaacatcacctcnaagtttnancctccggnacaatgataagtnnaaggcaaantcaagacaaggaggtncccaccggacaacaacgttatctcnctggnaacaactgaggtggcgcaccctgcagatacaantcagaaggtccaccntanttgngctaaggnccgtgngaacaattntctagcctcatgaagacatcaccttngtnatcccgnaatcaaantag

SEQ ID NO: 81999 - DNA, 554 bp, Triticum aestivum
  unsure (1)..(554): unsure at all n locations
  Clone ID: PAT_TA_81999
gttaaaacatgttcaacaccacgtgatcttaaaagccataaggacattgatagtcctgaactggagagacaagactcacctaaatccatacatgttgatcagcgtcccaaatacgggagtaagcagccaaaaatcatcaagaagatactaacaactctaagagaggagactaataagctcagggtaaacaattcacctttggagagctacccgtggtaaagtacatccacctaagtccacagagantcttgtcctggatgatccaagagcataacantgtttcctcccaagtgttacncctaagtgaaatgacaccatatgccaccaacaaaagnccaaccgcgatactatgaaacacatacaanatctcctccccctgaagtattggccnccaattgttggaattcccccaaaagttaaatnaaaagggggtttancncaacaacttancctaccaagcaaacatntaaaanttatccnctnaaggaaggcaaaaaggtctaccatttagtaacccnacttcncccctnngcattggacaanatccaaaaaac

SEQ ID NO: 82000 - DNA, 689 bp, Triticum aestivum
  unsure (1)..(689): unsure at all n locations
  Clone ID: PAT_TA_82000
tttttttaatatggtaccaaaaatacatatatgtattgatcacaggctcaaacacaagtcaatgttgacatagcaaagtttgtctatcttacaaccctccaggaaacacaagtcacataaaaatacccctatttgctaaatggtccaaaacacttaagttacatccatgagcacaagatttctactccataacacttaagcaccaaatggtccagaacacacataagcttcatgattacaattggagttggctggtacagccaaatgctctataacactccaaaagcatcacatccatgtgtactangtggctggattgcctggaaaatactgcacctccctggggcacattaattgccttccttgtcatcccttggagctacaataataaccgctacttcaataagaataaccgttgccttccttancaattatgaggtccttcctccaactaagaantgctcctaacaaaagcgtaaacatgttacaacggcctccgtccctgtnaactcaantcctaacttggcaacaaccgtcgtagcaccanctcaagctctcaactcccctaanggcaacgcgaatccccgttcacacgatacacaaccatcaccaatcaataacactactnagagaccatcccttcanaagnaattcacggctnaaccttgaaantgcaggatccnttgaaa

SEQ ID NO: 82001 - DNA, 679 bp, Triticum aestivum
  unsure (1)..(679): unsure at all n locations
  Clone ID: PAT_TA_82001
gcgacccagatcagcaagaagaagaagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcagaacgtgcttggtgagaagggcgcaggatcaagggagtcacctccgtccgtccaagaagcgcttcaattccccgggagaacggcgtttgactttacgcccgaagaagtcctcaacccgtgggctctgcgccatcgccccaagcccgatcactccggctacaactcctccngagcctttcccgtcccgcaaggcttgctanggtgttcttccctttggttaatggagattggtgctaaggttnttgaggcattgtnaatggcaactcaaggcccaanagaccaatccnatnaattcaaaaggacggtacatgnctcnaccgggcaacccttnaacgaatacnntatgcgcaattagnacttctctaaaanaggcgttcttggaacaagtgaaattatnctgactgganccaaggnaacttgnctacatccgctgctacctctacatcanccccaagaggagacaattccccccgtttgtnagcnaatccataagacagcanaactcatatttgctt

SEQ ID NO: 82002 - DNA, 441 bp, Triticum aestivum
  unsure (1)..(441): unsure at all n locations
  Clone ID: PAT_TA_82002
aggaacggaaccaacaaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttccgctgggaagcagctgggaggatggccgtaccctcgctgactacaacatccagaaggatccaccctccaccttgtcctgcgtctgccttggtggcatgcaattctccgtgaaacctcactgggaaagactatcaccctttaggtttanactctgacacatcgacaatgtncaaggcaagttcaaagacaagganggatccccccggacaacacgcctgatttt

SEQ ID NO: 82003 - DNA, 403 bp, Triticum aestivum
  unsure (1)..(403): unsure at all n locations
  Clone ID: PAT_TA_82003
ggccctccttgccttgttccttcctgagggaaacacactttgaagcacgcctccaagtggtggccgagcgcctccctcatgatcttagcaaagtcgatggccctccaggagagagcccccgagccttgcccgaggagggcaccgggcgcgccttcctatgcgaccgaaggaagcgccccttngaacgggcgcggattctgaaagggctgcctccctggagggtcccggaccaggtgattcttcctccttccttaanggactgctcaaggaatccttccnntcctcccngctaatgggccttccattggccgccgcttttggnaancatgctccaaaagggaacacactgcaccctctcctttanaaaaggantggtgattatcccaacgcttcccngggacct

SEQ ID NO: 82004 - DNA, 664 bp, Triticum aestivum
  unsure (1)..(664): unsure at all n locations
  Clone ID: PAT_TA_82004
gcccacgtgacagggtgtgtgtgtgtgtgtgctctgtatattagttggacatgcatgagttaagtctgaagtctgaaccttctctgttctctgaacctctcccaactttcctctccatcctctgtttgattgatctgtacgcggtattgtgcaatttgaacatagtgaatcgtgttcagtcccctgctgtccagtgttgttagttagtatgtctatgtgttaattttcacctggggccgtttttgttgtcactgtgtgggatgcatggttggncccctccgccttggggattgtctctgtaattctcaaatgggatttactgggtaatccctattgggatttgcaatgtaatcatgtttgggtttaacagtgtaatcccnaatgggatttacactgtacttcnnatgggctttacacngtatttcaatgggatttgcacngtaactgtcataaatttgcnattgggttaaaaatgtatcccaatgggttcaatggaatccnacgggttaaaatgtaacccaatggtttcagngaatttaattggttcnnaggtaacncnttcgtttanagtgaattcaatggattcaaggaatccatcancngaaggtnagcaattgcatggttcaatctancgnattagangaggtcgcgacttatttgatna

SEQ ID NO: 82005 - DNA, 609 bp, Triticum aestivum
  unsure (1)..(609): unsure at all n locations
  Clone ID: PAT_TA_82005
gcccagtctccaccgcccccaaccagtaccgatctggttcccccatgcccaacctcagtgagctcccttcctgatagttctttctggcacggccctgccttgcctcgccgccctgtgtcagccccgcggcggagctctaccaatctgcgctgccccactgccctcccatgtgggagccgctgcggtggtgtgcaccgtgactgcggttgtgtcagctcatcccaagcggcatgcggttaggtgtgtgggggcgtgtggttggggcacccgtgggacgtgcattcttttttgggggtaagcacattgcaaaaaatgcagtgcatttgggcgacgatgggattgtaatgtggttccggtgcccatggaggtgcacttcaacatttttgtcaaaacaaattatccaaatgangtcccaagcgccctcngacaaagcagtacatatgggacccgtgcaactcaatcaacaacatacttgtggtttggaactaagangtgcattcggtanccanatgnacagtanttcaattcctttgccggnggtgcctggcccgggtgtttgcaaatgcaagttgctcgnaaaatacaangaatccacanaaaaaaaaaaaa

SEQ ID NO: 82006 - DNA, 426 bp, Triticum aestivum
  unsure (1)..(426): unsure at all n locations
  Clone ID: PAT_TA_82006
ccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtccgtgctccggcgtggctcctggagaacaaggcggggcattccgaggtggccncccgggcatcccggcgagggtgcaagctgccgcgacaactggcaaatgcaaccccctgcaactggttnagctgcatgcacccctaactnacttacttttatggtgttaananatacttnnataacagcgtccgatncngatggatcccacaaggttcctntncttttattgcttgcccnctcccnccaagcctgccaaagg

SEQ ID NO: 82007 - DNA, 669 bp, Triticum aestivum
  unsure (1)..(669): unsure at all n locations
  Clone ID: PAT_TA_82007
gtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaaagggagttgttgcaacaactggatgttgttgaggcttgcactgggtgtgaatgttgcggttatggttgggtggatccccaaggaangaaggaatggaaaggaaggatgtttatgacgaaaaagtttcaatcctacaaantcaaacatctgtccttgaactcaancagccccaatngcaaggtttgggtgttgccaaccaacaaacacaatgtccancctgaaggatttgctcnaccaccctgaaaaaanacaattgttntacccnctaaacanaanaggnatcgtcanntctaaaaattggggtcaanttcgacntaaaangcatacnggnaanaacctcatcanaccgagtacatgcattaaacccatgnaaaccgtcgaatttaaataaaggtaagggattatn

SEQ ID NO: 82008 - DNA, 482 bp, Triticum aestivum
  unsure (1)..(482): unsure at all n locations
  Clone ID: PAT_TA_82008
gtcagctcgccggcaacccccaaacccgacctccagctcggcggctgccccaaaccagacccccagctcggcggctgcaggtaatccaccagattcattcagatgcttgatttcctttccatgtatttactgaaattaattttccccccttttgtttctgttggaaatgtactgattctagtgaaaagaaaaattgtagtctgtaactcacaagttgtgatagttgtagccttgtaggattccatcaatcacgcaantctttcccttaccattgaatgggaagaaaagatgtaatcctgcatgctcattaactacatatttggaaggcatcatattacattccnaataatgcaatgggtatatacaatgttccacttgatcaaccctnggtaggatgttgttggggtgggtatancctgcatttttgctgtgctcaaaaagatttgatatacaagaatgctgganccaanaaaaaaaaaaaa

SEQ ID NO: 82009 - DNA, 235 bp, Triticum aestivum
  unsure (1)..(235): unsure at all n locations
  Clone ID: PAT_TA_82009
naccgggggtcacctngagatcacatacacaatggngaangctgtggctgtgcttaccggcagtgagggtgtcaagggcaccatcttcttcacccaggagggatnatggnccgaancancgtgtcgggnancgtcactggactcaaggaagggctccacgggttccacggtgncacgcncttcgggacaccaccnagcggctgnatntnccatggnccagacttcaggcctgctg

SEQ ID NO: 82010 - DNA, 498 bp, Triticum aestivum
  unsure (1)..(498): unsure at all n locations
  Clone ID: PAT_TA_82010
cagtggtacctgactcattatggagttgaaatcggtaggaagaagaaagctgctgcagctgccaagaaggaagctgctgagggacaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctgggacagtgtggcagagctgatgggtacatcctgggagggcaaggactggantctacatgaggaactccagaagaagaagggcaaggtgccacagcttaagccgaagactgctgcatgttactccttggttttccttaaatttcgtccattcattttgcaacatactgaacacattttctgtaaactgttccatcctagttgaactganaagtttgcctgttttggtgtgatcnaactatccagttcaanaaaaa

SEQ ID NO: 82011 - DNA, 398 bp, Triticum aestivum
  unsure (1)..(398): unsure at all n locations
  Clone ID: PAT_TA_82011
aggccctattatgacagcagagctcataaaagaaacagaggaacttgtcttacggacaggaagtgttggtgctggctgttctcagcttttatcagatatgcaggcgttcaaggctgcaaacccgggatgtgtccttgaagatttcattaggtggcactctccacctgactgggtctgaagatcgtgcagcaagcaatgcaacagtaggggagggctcatctagacgtggcaggctaagtgacaggatgcaaacaaaagaaggaaattttgtgggaaggaattgtgggaagcagcaaaacctataccccgctattggaacaaactccgctatatgatgaaaatttactgtggagacatattngatgccttgggaatttttgaaccagcaaactgttcaa

SEQ ID NO: 82012 - DNA, 518 bp, Triticum aestivum
  unsure (1)..(518): unsure at all n locations
  Clone ID: PAT_TA_82012
cggcggtgacaccaacatcaacactgccttcgcgacgtctctcaaggccaactgcccccagtccggcggcaacaccaacctggcgaacctggacacgacgacgcccaacgcgttcgacaacgcctactacaccaacctcctgtcacagaaagggctcctgcactcggaccaggtgctcttcaacaacgacaccaccgacaacactgtccgcaactttgcgtccaacgcggcggccttcagcagcgccttcacgacggccatgatcaagatgggaaacatcgcgccgctcaaccgggacgcanggcagttnagctcagtgctccaaggtgaatccntgatggacgtatgcgtcggcaacacgacacgttaatgaataagcccccaaaacatgggcaattacacttatcataccacacttgatcgtgtattttcaaacaatgtgcaacancaatcatgcatcatcaactttttacgacgtttganctcaattctcatcaaaagnaaggagattacttcaa

SEQ ID NO: 82013 - DNA, 424 bp, Triticum aestivum
  unsure (1)..(424): unsure at all n locations
  Clone ID: PAT_TA_82013
gattaatccgacttcagatgtgaagaacaggtgctggagctgcttcttgagctgattgagaagatatatcaagcttatagagttgattgatactgggaggtgtttgcatgggggataggccatggcaacagccgcatgagcaggcttcttgttcagcccacgccgagatgatccaagcttctaccgctgctacctcgtccatccatggaagcatcatgtaaacccgaacaccatggaaatgttcttgttttcctcngtgacaagtaattagagctcttttccttgatgtttttcaccttggataatattttccttttctgttttttccttaagctttttggattatccncgtgtattaatttatgatgcataagttggtccttcaacaaacaantaaataacttanctgaagnttaagcatgaa

SEQ ID NO: 82014 - DNA, 617 bp, Triticum aestivum
  unsure (1)..(617): unsure at all n locations
  Clone ID: PAT_TA_82014
cccgcatcggctcgcaatccccgcgcgcgcaatcgagctcctcgtcccccgaccgaccgaccgatccccgccgcccgagcgcttcctcgccgtggtattccgatcgatgcattgagctcccgcccaggtaacaggtttctaccactctacaaaatagagcaattcgctgaaatggggggtgtgattggaaagggagacaccccaaggtacagttcaagcagctacaaagttagagcagaagatggttgatgccatgcagcagagggcacaacaagggactctctgaatcattcaacatgtcatcatgaattcccctaaaattgacgagaatttnnagaaactgcaggatatctttaagcattttgatgaaattcaaaatgggnaaatagtnnaattagaactgaaacatgtttccaaaaactggtgtctcatcaanagatgaggagataaaaantattngagcgtgcgacatatatgaacacatggcatgaatcaatgatnatgtctcctgtgcctgttanctccaatatcaactgtgtagaacaagaaaagatggatagtaactnaacnactttaacttggtgatcattggttctgaaaanaaatggtttcataaa

SEQ ID NO: 82015 - DNA, 349 bp, Triticum aestivum
  unsure (1)..(349): unsure at all n locations
  Clone ID: PAT_TA_82015
ggagcgcggtgcatggcgcaatgcgggcggcagccgggcgcagggcgcgacgcgacgcggacgggcgcgggcgctccacacgggagggtgcatccaacggcgcgggcgcgtgcagcgcggtggccattctgtcccgtggaggagcagccaaggcgcacggacgggggcgccgctagcgatgtgatgaaaagcagcagcagttgccgctcgatccagtgcaagaaatcactccggaagatgaaatagagatctttgattgatggcaagaagaagaaaagaaagaaaatgggacaatgtcctgatccattttcctgtttacggatgcacaagtcaaaaanaaaaaanaaaa

SEQ ID NO: 82016 - DNA, 353 bp, Triticum aestivum
  unsure (1)..(353): unsure at all n locations
  Clone ID: PAT_TA_82016
ccgagatgttgaggaaggagtttggggctagatcatggaaatctagcccgtaatagaacataagtccgcggatgaaagggtggagaggaaaccctaacccgcggacgagatgggggatgaacaccaccctctcattgggcttcggggtggggacgactcgccccttggacggaagccggtgagagatctctttcgccagatactcggcctcccgaagctcggtgatgtccttctccttgacggaggaggccatccactttccttggcgctccagattctggacatgggtttgagtgctttccttaaaggcggaaaagatgaggacttngggcgtgnctcccaaaggggggggc

SEQ ID NO: 82017 - DNA, 602 bp, Triticum aestivum
  unsure (1)..(602): unsure at all n locations
  Clone ID: PAT_TA_82017
aatgatcttcacgtgcaaggtctgcgagacgaggtccgtgaagatggccagccgggactcgtacgacaacggggtggtggtcgcccgctgcgggggctgcaacaacctgcacctgatggcggacaggctcggctggtttggccagccggggagcatcgaggacttcctggcggagcaggggcaggacgtgaagaaaggcgacacggatactctcagcttcaccctgggaggacttggccgggtctcaaggtcaaatccaaggaaccttcctggtgaaaataagccttgctgctgtaatatcttgggcttctgggcccagcagcagctataataaaactgtcacctcccttaacgaaacttttgcgaactattcgctcatttcaaagcttctcaaagtggattataactgttaattccnactanattaaactgcaatatgaattgattcctggtatggactaccacacccnatatttgtgcttanccttctgcccaatcattttccgtcaaagaacaagtatganattgacctctaactcanttaactggatatgngtcttttttaagtcaatatatataatgttcnctataaaaaaaaaaaa

SEQ ID NO: 82018 - DNA, 426 bp, Triticum aestivum
  unsure (1)..(426): unsure at all n locations
  Clone ID: PAT_TA_82018
ggcatcacagtcctccggcgtgactggaggcgatgctggcggcatgtcgctctacaaccttgccggcgggaatgtggggaactaccagcttcccggagacaactttggagcctggggtggcggcggtggcggagtcaggccaccgttctgatccgtgactaggcagtgcaacccacagttctacactcacatgacgaagacatcacagaagtttgaaatggcggagaagctattgatatccggtacagatggagagcttatgcattgctggattgttcattggactggccttatgatcttggtgctatttacacgcatgcgtcgcgcatgcatgcgttgcaaagattgggtatacanganggagatctattgggngatcatgagaggtatactatttcaagggagctangaagctgattattttaa

SEQ ID NO: 82019 - DNA, 694 bp, Triticum aestivum
  unsure (1)..(694): unsure at all n locations
  Clone ID: PAT_TA_82019
ccggaccagcagcgcttgatctttgctggcaagcagctcgaggatggccgcaccctggcagactacaacatccagaaggagtccacccttcacctggtgctcaggctccgtggtggcatgcagatatttgtgaagaccctcaccggcaagaccatcaccctcgaggttgagtcctcggacaccattgataatgtgaaggccaagatccaggacaaggagggtatcccaccggaccagcagcgtctcatcttccgctgggcaagcagcttngaggatgggccgcacccttgcaagactacaacatccaagaaggatccaccttcactttggtgctcaggtccgtnggtggtatgcaatnttcgtcaaacctccactggcaaacatcaccttgagttgatcctccggacacatccgacaacttaagncaagatccaagacaaggaggnatccccccggaccaaaactcttacttccctgggaacactttaggatggcccaccttgcggttacaacatccanaaggaccactcaactgtctcgcctctggtggatnaatctgtaaaactacggcanacatacctgagttatctnanacattacatgtaagcaantcagcagggggatcccgcaaaagttattncgaaanttagtgccccttngtnaataagnnccttntggcctngtgggatancng

SEQ ID NO: 82020 - DNA, 593 bp, Triticum aestivum
  unsure (1)..(593): unsure at all n locations
  Clone ID: PAT_TA_82020
attcaagagtttcaggtccatggttttggacccaaatggaatcgcggaatatgatcatacagtgtatgcgcaagctggaagatcttattatcaggttgtgatcgatgtggccatgaaacaacaatacatgagggtggcaaaagtcccagctgacctgatggtggttgacctgtcgtgcaaccgattcagtgggttcatcccacggtcaatcggtaacctcacgtaccttcacgtggtaaacttatctcacaatgctttcagaggcaagatcccacgcgagctcggccagttggnccggattgaatcactggacctctcctggaaccgtctcgtgggggagatcccacaggagctggccatgttgacacacttgaatgggtcaactctcctacnatgatcnccgtggggaggatactcnagcancattttccaatcacaacactcgttccaaggcggaaacaanggttgtccggtgccactcctgtgaaattactacatcgtgactcgcactcgngctcactccgtcaagaaggtncattntaacagtaggtttgtgggtagcttggattggttgatnantntcacggaacagt

SEQ ID NO: 82021 - DNA, 546 bp, Triticum aestivum
  unsure (1)..(546): unsure at all n locations
  Clone ID: PAT_TA_82021
ccgtccctcttcctcccctgcgcagcccctcttcctcccctgcgccgccgtcttcctcgacttcctctcctggcacaacctcgcgccgccgcgcctctacctctcgccgtcgtcccctcgcgccaccacgcctctgcctcgcgccatgctgctccctctctctcccgtgcctttctctcgcgccaccgtgcatcaaggtgcttcttctccggctcccggcaccgtgttgctactccgaccagaatccgatttcctaaggccacatgggaantaattgggacggggccaagaacggccaagacggccgggcccggaccgannttcaatgcaagcggngcggccctgtaacaaggacggttgaaagtcggcccggtcccgggcccgaacgccgggntcngtcaaaacggggttcngaccgggaacgggccngccggaccgttttcaaccctgatctcgctcaaatcggactggttnaaacgaccgccgtcttagttacgctggttcctacgttggttanaaggaacgacntcgacggtntacgaatta

SEQ ID NO: 82022 - DNA, 436 bp, Triticum aestivum
  unsure (1)..(436): unsure at all n locations
  Clone ID: PAT_TA_82022
ctccaccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaaggctcggcggcgctgtcgtgcgggcaggttggatccaaagtccgcgccgtgcgtgggantgaacggggaaaagggcgtctcnattaagaaaggattgctgtcccggcgtgcaangggctgaaacggctgggcccgcagnaccccggccgcaaaatagcgtgcaagtgcctcaaaganctcgccacaanatcaaanccaacaacatngnaaaggctcccgggntgcccnggaantgcggcgtaaactgcctttcccaatcaagatgtccaacaaa

SEQ ID NO: 82023 - DNA, 601 bp, Triticum aestivum
  unsure (1)..(601): unsure at all n locations
  Clone ID: PAT_TA_82023
atcactgctgcgtctccttgtcttgaagtttgtcttgagcatgtcagcaagtaaggatgtgcttgcacttgcttcccttgaggttgatctatccagcattgaacccggtagcacagtgactgtcaagtggcgtggaaagcagtcttcatcaggcgacggacagacgatgacatcaagctgggccaacaggttgggatgttgcatccctgcgccacccaanagcaagacgctgagcgtgttgaaagaacccanagtggtggtgggtantgggtgtcctgcatcanccttgggtgcattcccttccccaatccnggaacttnggtggtgggttctgccccttccaaggtcccaataagaatccctnggcaaatcccgcaaagggcctgccccttanacttntangngccaactaagttccttgggaanataacaagtgncaaaagntnaaagcctaaacaatactaccggcatatattaccacaggngtnatccggtncccggtaattggttcaatgtgggnagaatttggtcnagacatncaacgtgatcacggtactacgaattaattcatgcaaaaaattnttcccaagttcacggntta

SEQ ID NO: 82024 - DNA, 594 bp, Triticum aestivum
  unsure (1)..(594): unsure at all n locations
  Clone ID: PAT_TA_82024
cgacttcagtcgatggatccgccgatgccgatgtccctggtgttcccgtcgaccgatccgccgaagccggccgccctcctctccatggatctgctgctggaggaggctttccgggccatggcgcgcgcggcggagcagttccgctccctgggcgagaagcaggccaagcgcctcatggtcgccggcgccgggggcggcaagctgcgggaggtggcgacccagctgggagcaggtccgcgacctgctccggggccgtcgacgacggggggagtccccggcggcggcggcggatccttctacggatcgacgactgcttgacgagatggagtacacatctcgccttccactcgaacctctgcaaatacaaatccaaagtcaanatccctcgcttcgcctcaagctgggnagcatccctaancancagcanaacaacagcatgggctccctcccgtggtctcaangacctgatccgnggaacatccgactctcngtcaacaatcaangtcaatctccgctgcaactccatcncgccaggataaaactttggccnacaggaaccaagcatgncaatctanaancgnctatcacatctac

SEQ ID NO: 82025 - DNA, 600 bp, Triticum aestivum
  unsure (1)..(600): unsure at all n locations
  Clone ID: PAT_TA_82025
gcctaccaaacctagccatcctgcgtctgcggaaagattcgtttgagggagaagaggtccatctccattttcgttggggtgaatcgttcccaagcctaatggtgctggaactgagttccccaggtaagctcaaatctgtggagttccaaaagggagcgacccctaagcttgagctgctgcagtattacgatcagcctgatcacgatcaggaggatcttgtctcaaaagagaatgatgatcatttgaaagaggtcccagcatttggntgttttcctggggctaacatatctgggaaagntcaaagaaattttgctagagggtggcaactataaacgcnattcctgcggactgcgattccaacttgaatcaaatctgatccnactgttctcaaaatggactgaactaaanccnggaanccgaatccgctaccgttttgatcggtcctcnataattaaggcattcaccaatatcctgtaggatncactanatganaacaataaagnacgtcanataactactaagcatcagataaaataatgtattctaattttgngttaancantccaagtatttagaaatnatgttcctaaaaaaaaaaaa

SEQ ID NO: 82026 - DNA, 636 bp, Triticum aestivum
  unsure (1)..(636): unsure at all n locations
  Clone ID: PAT_TA_82026
tcgagtttttttttttttttttttttttttttttttttttttttttttttttacngtgagcgagatcttcagatttactatccaggtgttctgacaagaaaaactacacaatacngcattattagatctaaacagttatctctaagaaaatatttataggaaaacatcatacagattctagagatgcagcacaagctccacttgatacagttgcccancaaacctcaagcccaaggattctgcaggatgcaaaagtgcatcaaccattccaccaaanagatacacacagtaaccaagaagtatctacacatgccccaagggaaggaccggcaattcggggattggccatctatccttagtttttccacatcctccttgccatttcccngttacctgaccaaacggaagnaaagcgggnagatctaagatccaagaatcaccctccgcggtcttcttgnccccccaacatatacaggtnttgccacaaagagaagtgcgaanccaacccggganaaggaatcccaagatacananaacgtacttgccctcaatgngcaatgnnacaattcaacagcaggctccangccccanatcgatccacacaaaaaacatngccaaacaancagttagggggca

SEQ ID NO: 82027 - DNA, 519 bp, Triticum aestivum
  unsure (1)..(519): unsure at all n locations
  Clone ID: PAT_TA_82027
agcatcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccaagtgcaagatatgcatgcagactttcatctgcaccacctctgaagcaaagtgcaaggagcatgctgaggcgaacatccgaagagcgactcgtccaatgctcccccaactcaagaatgatatctgcccaatcaanatggagagagagatanaagagagagagaactgtcntanccaactaatattacatgtttccgcaatggactgattgntttactaacttgggtcctnanccgggtgtgctgctgtcccaactcttttggttgttgtgccatctacaantnaccncctccancaaccggttttgcnaaatacttaacccgnttgattnnccncctgctancaatagcgtcacaaaattaccttttgataaaaaaaa

SEQ ID NO: 82028 - DNA, 357 bp, Triticum aestivum
  unsure (1)..(357): unsure at all n locations
  Clone ID: PAT_TA_82028
ttgacaacgtgaaggcgaagatccaggacaaggagggcatccccccggatcagcagcgtctcatctttgccggtaagcagcttgaggatggccgcaccttggcggactacaacatccaagaaggagtccacccttcacttggtgctccgtctccgtgggtggccaattaaagtcctgggcgatggactctgcttcggctctgggtcgcaanctcgtctttgtttctgtactgtacattgatgcantgttacnnttgtacttcnaaatttctgctgggtgtgcacacttttggtgaactatgataagtgaccnaatccgnttgtcttgcntgaaaaaaaaacgnnnaacagggggggg

SEQ ID NO: 82029 - DNA, 575 bp, Triticum aestivum
  unsure (1)..(575): unsure at all n locations
  Clone ID: PAT_TA_82029
aaaccctcgcccaaatccgccgaatcccgcggcccaggaaccaaggtagatcgatggcgaagagctcgttcaagctggagcacccgctcgagaggaggcaggcggaggctacccgcataagggagaagtactctgacagaatcctgtgatcgttggagaaggctgggaaagagtgacatccctgacatccgacaagaaaaantacctgggccctgctgaccttacagtttggcantccgtntacgttgtcccgaaagcggtncaagctcnancgcttgagaagcattttcatctttgggggaaaaatccttccaaccgacagtgccctgattcctncatttntttaaggagaacaagacaaggacgttcctcctanatgacctaaaacngcgagacactttcgttgnccaaaatggcgctggttgcaacggatcctcttatgctcctgtnataagggtgcnacnacggtgtaaaaccggttgcccctcctagtttttaattcacaacaagaaaactatgtaccgactactantaatgtcgactaaattnangatagttcacncaaaaaaaaaaaa

SEQ ID NO: 82030 - DNA, 569 bp, Triticum aestivum
  unsure (1)..(569): unsure at all n locations
  Clone ID: PAT_TA_82030
cttcaggctccatggggtgatctgctgcaagtttgcaggaaggctgaactcatagatgtgggctatgaggagctcatagttaaaactaataaagtcttgttacacaaagtcgatatggaagcacaagagcttgtggaaataaatagcttgcatcataacgtgttgtttcctggggcgtaaccatctatatgccttaattgctgaaagaatatcccgcaactggaaggaatttgtgtccatttccgccagatgatgagcaacataatttgggtgtttaaagacgaaccccccggatataagtgtcctcaaccttttnaagatgatagtaggaaggaattttgtccccgcttttngccaactggccantccccatatggatacacccatccttaacatgatnacctgccattggtcaatagactttttttaattaagtcctttataanggccggtcnacanttttccnccttttgcngcaaatctatanaacggacattccttaacccttttcaaaatgttgccgtaccgataaactaggcgaaaataattngaatggaatgggcncanac

SEQ ID NO: 82031 - DNA, 679 bp, Triticum aestivum
  unsure (1)..(679): unsure at all n locations
  Clone ID: PAT_TA_82031
tttttttgcagacgaaaaattaaattgtattcctttcgagaaaacgagtcacaatatttgatctgttccacaaacttgtgctgcgtctcctactatatggtgtatgtaacatgtatacatatatgcttgcgaaagaaaaccatctctttccgctataccaagacaagaaaacaaacttggattcgatcaactatcttggggattccaggtcccatgttagagaaactgttatgcaaaggagacctccgacctccagtttaatgatgctgcgggccctggggcaccgggcccttccctcccttaagagccgccatggtggacacaccgtccttgtttgcctggaccactcctccccgcagacttccctcaacaaatgccctgnccccattgtccgatgccntcancgtggctttccccccattacccattgtttggcaacccgctcaactggcaacgaagcaaacnanagaacaaggacgcnaaacatcaanacggacngccggantcgcagcttgncanttcctngcaancaaggactactgcatattacanaatggcctcnaccaaccaaagcaaggaaaccncantgatagtaaaaaaatnnccctgcaatcgacaccaattgcctccgtataancactcaaggactnggggccgaaanngtngtaacgnaatttnc

SEQ ID NO: 82032 - DNA, 576 bp, Triticum aestivum
  unsure (1)..(576): unsure at all n locations
  Clone ID: PAT_TA_82032
ggaaaaggccccctatgtggccaaggccaacaagctcaagggcgagtacaacaaggccattgctgcctgcaacaagggcgagagcgctgctgctgctgccccaaagaaggctgcggccaaggaggtagaggaggaagatgaggaggaatctgacaatccaatcggagattaaatgacgacgaatgacgaatgagggcagcgaatgangacgaaggacgatgacgatngaagaaagacgcatccttnttcnaaggctgctcccggcggacaattcngagctgcttgttccnagaacgnccttaactgttttccggtggtgtccataaggacctatccatctccaactanattacccaatttcaattcanatctnagttgttttactttttccctgtcaatttgtccctgctaanaacggtacctccctgtttggncccccgccgggggatccctaatggggagtgttattctnttccncgggtccctgctnttnctaaatgntaccttccntccatttcaccggtaacatgtgatatanatctggtaagttaataactgtgccccaaaaaaaaaaaa

SEQ ID NO: 82033 - DNA, 556 bp, Triticum aestivum
  unsure (1)..(556): unsure at all n locations
  Clone ID: PAT_TA_82033
nacgtcnccatcgncctcgtcctcntcctcaaacagtncngnaagaagtgcccctcnnacttcacctgncctatctgatccatcgagctatcgatnaatattatnnacatacataatcgntgtactcgtaactantttgcatgncatacgtacgcaccanacgtanattttctatgttccagtgcaggcactanatntcaagtgtttgcgtgggtccctggtcgngcatgcatgcttgataaacntgtgattgattaangatcaatgtaccncgttatggatctaaatgcatgatcatgtatntgtacanggtataaaagtttcttgacagttnaaggacgcaatanacaaanaccctnngggggggncctgtaccaattcgcccaaangttcntntaaccggccaacggcattcttttaaacttcngacnggaaaacctgggttaccacttancacttgcanaancccttncacattggcgtatacnaaaagccnacgattccttcaacaatgncactaatgcaatngacccccgtacggnataancgngttttg

SEQ ID NO: 82034 - DNA, 581 bp, Triticum aestivum
  unsure (1)..(581): unsure at all n locations
  Clone ID: PAT_TA_82034
ccgggctgaatctggtgaccacggtgatcggcttcgggatgagcgccaccttcatcgtcttcgtctgcgcacgcctcatctgcggacgcgccgtgcgggccgacgccgaggccgacgtcgccgccgcccgggcgatggctccgggccccgcgcccttcgacttcgacatcgattccgcactgcggatctcgattcgcacgattcaagaacacctgcagtggattgggactttcgttgttgctgnattccaacaatgactatactctgaacttccattcaaaagaatatccaatgctccaanagtttgggtgaatacaacaaaaaattcggggtaaaagccaaannccaaaatttnacttcccggtnaaaanaggttananaacaanaactgcccattccatcncttgcttacgggggaaacantccctgccgtaccccctnattnttgcacctaaacctcatcntcacgatggaatccancactatnnangggtaangaaancggctaanantngatggaaaataatctaaaaanaaaattgcagttttcttnggacanatccttaaactggacctntaaa

SEQ ID NO: 82035 - DNA, 667 bp, Triticum aestivum
  unsure (1)..(667): unsure at all n locations
  Clone ID: PAT_TA_82035
gtcgtcggcacgcacggctacatcgctccagagtatgcttcagagggtctcttctccaccaaatccgacgttttcagcttcggggtcttgctcttggagatcataagtgggaagaggactgcaggcttctaccagtacggaaaattcttcaatctcacaggatacgcttatcagttgtggcaagaggcgaaatggcacgagatggtcgatcaggtactcggggtcgactacccggtgacggaggtgatgaagtgcgtccaggtggcgttgttgtgcgtccaggacagcgccgacgatcgacccagcatgtccgatgtcgtcgccatgctcagcggcgaagggctcacgctgccggagccccgacagccggnctacttcaacgttaggttatcaaagcttaccagagtcaaatagttcctttggtgaatcntcntacatcaacaacgtcgccttgactgatgaagacggaaataacaagnccaanntagggggcaatcaattntacaacnaantaattactatacatggtacatccaacanatntcaacaggagggcattttntnacaactatttatgaataacccagccatcaaatttaaataccnttttggatccccnaattatttatctcggtnccagggntttcagtnnaaattagcgcaaatt

SEQ ID NO: 82036 - DNA, 482 bp, Triticum aestivum
  Clone ID: PAT_TA_82036
ctctctccgcgcccacgaagcaagctctccactcccgatggcccgcacgaagcagacggcgaggaagtccaccggcggcaaggcgccgcgcaagcagctggcaaccaaggcggcgcgcaagtccgccccggccaccggcggcgtgaagaagccccaccgcttccgccccggcaccgtcgcgctccgggagatccgcaagtaccaagaagagcaccgagctgctcatccgcaagctccccttccagcgcctggtgcgggagatcgcgcaggacttcaagaccgacctccgcttccagagctccgccgtctccgcgctgcaggaggccgccgagggctacctcgttgggctcttcgaaggacaccaacctctgcgccatcaacgccaagcgcgtcacatcatgccaaggacatcagctcgccgccgcatcgtggcgaaaggcctagctgcttctagaatcctagtgtctgatctggtctcagtg

SEQ ID NO: 82037 - DNA, 314 bp, Triticum aestivum
  Clone ID: PAT_TA_82037
catccttttaatgatatggaatgaattcccacgcacaaccttcaacgttgaaccatctgtgaaacagctgtttattgagataggaagctgatgtcatatgccatgtacatacacagtcttgtccgatgaaactttcttcttctatttttaggtagttgttgtggatattcatattattgggcatttatgtttgtcttggttgttatattgatatgtatgtgtgtagactgtctgctgtgtgcaacttatcttcgaagtcagactgcttgccctgggtggtgctattaatttgttactgaaataaaaaaaaaaaa

SEQ ID NO: 82038 - DNA, 628 bp, Triticum aestivum
  unsure (1)..(628): unsure at all n locations
  Clone ID: PAT_TA_82038
gctgtattggactgcaccggcgccggtgccggccgggctgcagaccggtcgactccttcgccttgcccggcctcctcgcagacacggctttggagattcaaagaatttacgttactagacaattcatgcatatatgaagtcctacttgtaggtgagcctagcagtgctattcttatgtgcagtatggcacggacaactgcagatcaggcaatggcgacacgtaagttggtcgtaaaggtcgtcggtgctcacggcctggcacacagcaagaggggtttacccagtgcatttgttgtgctttcgtttgattctcaagcagttccgcacgagtgtcaaggagaataatgagaaccggtatggaacgacaccttctgcttcaacgtgttggatcgaccaagattcatgagctaattctcaagtttgtgtgtatgacaccaatactcgttcaangcgaaatgtcnttgantggaaaatcaaagtaaatggggcctcaatccggcctgtgacaaaggacatcaaatancgctgaggctggaagttaacataatgngcatactgacagagagatctcagagatagtaaagnaattactagatagtacatcgncgnacaatcaacctgcttctnt

SEQ ID NO: 82039 - DNA, 681 bp, Triticum aestivum
  unsure (1)..(681): unsure at all n locations
  Clone ID: PAT_TA_82039
ccgtcatgtgacgcgtgtagtggccgttcaccgggagagacccagctccacgatccagctcaccaccactcacttgatgtgcatgtccacacgccatcgacaagtcgacccgcgaaagaagctggccctaccgatcaggatgacatcgatgaggaggaagcaatggtgtgacgtcatggatcccacctgtaagtgcatgaatgtgtggctacagttttctacaatattgtgaaaaccacgatgtgtttggcagtcacagtatttgccactatatttggtgatccggtcatcaatatgttcatgttctacaaccctatcggccccgggcaaagaatcacacactttatcataggcgaggactgggtcgtggctatatgcaagtgtggtcgccgacaccaagcangntcaacgtatcgcatgcatacacaagctcntttcttcatactancaccttgaattctgtggatatacacgtanattgcnccagtanattgcnccaagtcatatagaggttatgccaatcntggttcattttaaaaacaattggggatcnttgtcanaanancaggtntggtcaaatacaagttgcctcanaatgttttaacancttaancnttaaaatggttgnattgacttncacgnatggtannaaaaaatatnncctgttaacangagtccatt

SEQ ID NO: 82040 - DNA, 547 bp, Triticum aestivum
  unsure (1)..(547): unsure at all n locations
  Clone ID: PAT_TA_82040
ggattgtcgccgcaggttccaggccgtctaccctggtgaattgttcaagcacgacacctagggttccccatcgctatcctttggttcgcctctggtgtctaccacgacgttccaatcgccggagtcggagctccgccatcgtccagtcctcgcgaaaatcctccatcgcatcgaattttttatttcttccagcactttggtgagattgcttctgcactgttcgtcacaggacgatttgtgcaggtccatacttcctttttccaatgtattgcgcggtcgaggtctctagcaaggataccctccctggggtgttccgcaacttcttggactccgtctgctcgccgaacgccagtggagattcgctgctgcaacacctcaaggaagcgtcctgcaacacggngcaacggncgcangattgtccttcangaactcggnacctggacctaagcaaggcaacgtctctgtgcnaccntgtatcctggncatgctccctttttcnaatccgcgcgtcaagtctattcaaggagcctccctaggtatcccaact

SEQ ID NO: 82041 - DNA, 504 bp, Triticum aestivum
  unsure (1)..(504): unsure at all n locations
  Clone ID: PAT_TA_82041
gcaagaagaaggggtccgtctccttcgtgatcgactgcaccaagcccgtggaggacaagatcatggagatcgcgtcgctggagaagttcctccaggagcgcatcaaggtcgccggcggcaaggccgggaatctcggcgactccgtcaccgtcacgcgcgacaagagcaaggtcaccgtcacctccgacggcgccttctccaagaggtacctcaagtactttgacaaagaattacttngaagaagcacaacgtgcgggactggttccgtgtgattcgcagccaacaaggagcgcaacgttttacgactcccggtactcnacatcgctgaaacnaagggcgaagaggnagatttanangcattgttatattgtatgctggtgatttttgaacttgatctgatactcctaattaccactacttangttgtctcccgtttnaacatgaatggttaatttgnaaanccttanatttgcctcccctttacngtgggccaaaaaaaaaaaa

SEQ ID NO: 82042 - DNA, 202 bp, Triticum aestivum
  unsure (1)..(202): unsure at all n locations
  Clone ID: PAT_TA_82042
cgagttttttttttttttttttttttttttttttttcanancataaataaataaattaacgttccaaattgcacnaantctcactcacagcggttttacattacangttcatcatccanccaacacaaacacnancaanagtantnactaaggtnattccacancagtnacggagacaangannaataattgaacaatgcaa

SEQ ID NO: 82043 - DNA, 394 bp, Triticum aestivum
  unsure (1)..(394): unsure at all n locations
  Clone ID: PAT_TA_82043
tttttttaaggtcaatgagtcctttgttttccttttaagagaaaagttgaaccacacatgcaatttgttcatttgctggtacacaattgcttcatctccaaaccatacgttggtcagtcaaggcttcattccagaacagatatacaccattcctccctcctgctgattcgacattttcttctcttaaaccttttctacctccgtaacttgttctatgatatgtacagccagctctcccaagaagatggcacaaggtaaactacatactttacaatacaagtttacaacagtgtggctgtgttaantcggcacggagcagatcccggtaaaaaggatctaccgctgtccgttgggaatgacaaacgggccaacaacccgaactacctgggggatc

SEQ ID NO: 82044 - DNA, 562 bp, Triticum aestivum
  unsure (1)..(562): unsure at all n locations
  Clone ID: PAT_TA_82044
gttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaactctctgccaagcttgaaggggatgacctagatgctttcaaagaagaatgttgatccgccacaaagtatcttcttaagcaagctcaaagaccttcnattcctttggttgggcgaaagcatgcatgatgatggcggcgttngtgttcccctactacaaggaggaactgctgattcaacttccctgtactttgcacatgggctgaaagagnccaantgctaacccactggtatgcnaaaccaagctgtcctcaatattttnccctaacaatggtgtcatccatcccaatgttggggcaataatgtcaaatttnatgtctgaaaattctganatgggggattgcttgtaangnaaccnaaattgggtggtgggtttggtgaacaaaaatcgccgt

SEQ ID NO: 82045 - DNA, 657 bp, Triticum aestivum
  unsure (1)..(657): unsure at all n locations
  Clone ID: PAT_TA_82045
ggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctccgtgcaaggagggcacatgaggccaagcagaagggccgtcactctggatatgggtaagcgtaggggtaccagggaggctaggtccccaccaagttctgtggatgcggaggatgcgcctcctgaagcgccttctgcccaagtaccgtnaagccaagaagattngacaagcacatgttacatgacatgttacctgaagnccaaggtaacatgttcaaagaacaaaaggcctcaatggagaataccacaattccaaggcttanaaggcaagagagaaacctctcctgatcattttgaggcaagccgccaagacaaggatcagganaggaacngcaaggangaagaanatggtncaaggcccannttatcacaacacancggtganncaatcaaaacaangacaaanaagcaagcaaaatnangccantaacttacttcggacatangtaccgatttgnn

SEQ ID NO: 82046 - DNA, 630 bp, Triticum aestivum
  unsure (1)..(630): unsure at all n locations
  Clone ID: PAT_TA_82046
gtcgagcggggccacgggcaaaggttctctgacaattggcgtggtgggatctgtactgggtgtaattcttctggcttgtttagcaggtttgatttggtatgtgcgatatggacggaaccagcctaacacaatagggcgtgctgaaaagttcacttaccagcgattgggcagctgcgacgccgtgacttcgcagtggaccgaaactttggagaagggtgccttttggcgccgtctacaaaggcacactggatgctgcgagnaagagaagttggacgttggctataaaaaagaatgcgcatactacgttcagtttnaagcaaagntgccttttataaagangtttgaaatttatgacccactgancatcgcacatcatactccttgttnggctggtgcgacnaangaatctcctgcttgtccnacaactatggtgatccactttnagtcctcttaatgcaagggcccctgtggatccngattcccgggtcaaagnccggtnaancttgntcaaaattggcaaaaagnacaacatacgcatggaatactcagtctgatacnccatatatgtcaaggcgnatcataanaacaaccagtaanttanntggaaggacccaagnaaatgttatcggg

SEQ ID NO: 82047 - DNA, 624 bp, Triticum aestivum
  unsure (1)..(624): unsure at all n locations
  Clone ID: PAT_TA_82047
cttgaacttgttaatgaatgaatgaatgccttggacatgtactcatgattttcttctaccattatcaacatgtgagcattgttctgtacttgtaaatggtgcttggatcattattagtgtaatatataatacatgcaataggttatcaccatggaattacacccgtcgcaaaaatatattgccacgaaacctgcctgttgcgataatgtatcaccacaaaatttgcatgttgcaataanttttgctacaaaccttgggccgttgcaacaagtgtgttgccacaaaatatgtccctgcgagagggcctgccacgaanctcattccttggtgctaggtattgccacaaaganatttgtgggcatatgtgtgtnccccaacggcgggctcntggcaatatattcaaagccacgagaaaaccttgcgatacatccatgttgccacgataccaaaaagttgcattacctatgccacggnttatgccacctgggaacattcacttggtgcgatagatcatatgcaacattgtactatgcaacaaaaatcatgcatanacgtttcctgtntgaacatatccctcggacaagtaatcgggcacaactacctcaacaagacaatggaacgggg

SEQ ID NO: 82048 - DNA, 554 bp, Triticum aestivum
  unsure (1)..(554): unsure at all n locations
  Clone ID: PAT_TA_82048
aaggccgagaaggcccccgccgggaagaancccaaggccganaagcggctgccggcgggcaagaccgcctccaaggagggcggcggcganaagaggggccggaagaagggcaagaagagcgtggagacctacaagatctacatcttcaaggtgctcaancaggttcaccccgacatcggcatctcctccaaggccatgtccatcatnaatccttcatcaaacgacattcttccnagaagctccccngggaagccgccaagtngccccgctnnaacaagaacccaacatcactcccnggagattcanactccgtccgctctctccccggggagctccccaacangccttctccgaaggcacaagctnacaattcactcctccttaatcaatcccngnactgtatttggtcngtttanctagattcatgctcaatgaantggggatantgttatcctattgttgggganttaccttcacatggacgtcntngaatacacaatnttggncatctttggaacncngtttaacaattaccttatcattccactaaaaaa

SEQ ID NO: 82049 - DNA, 630 bp, Triticum aestivum
  unsure (1)..(630): unsure at all n locations
  Clone ID: PAT_TA_82049
ccgcagcggctttacctaccgagaagaagagagaaaaaaggttcgagtgcgttccagagtgaggagtgagaagagatggctccggtgaagctgtacggcgcgaccctgtcgtggaacgtcaccaggtgcgtggcggcgctggagggaggccggcgtcgagtacgagattcgtacccatcaacttccggcaccggcgagcacaagacccccgaccacctccgccaaggaaccccttccggccaaggtgccagtttgcaagatggtgacttatactcttcccaacaactgctattttcaantacgccctnccgcaaagaacaanccagactgtttgaaggagggcgacatcaaggatccanaatgggggtgttttggtccaagtgggagcccatccattacactgccgtcttacccattctcttcnaangccttanccatccnanctttggggaccactgacaanaagcatcnaacacacttgtttaatnaaaaacttctggcgttncaagnnacctaacatcaaatacnggtggaactcnatctgcgnctaacagtgtcgtcacttctgnggtaanctanctcntttgactacccattaggctgtgctactctggagcttctcaagncaac

SEQ ID NO: 82050 - DNA, 613 bp, Triticum aestivum
  unsure (1)..(613): unsure at all n locations
  Clone ID: PAT_TA_82050
tcactgatgctccacaagatcccgatgtgtacggaaccgttggtcgtgcgtgggaacaaggacaaggtgataactacacagcgctcatttcatcctcacactgtcggtatcttgtgccgtggtgatgaagagttcgccgtggcacagctggagcttaagtagacccaatctaagtagccggtatgcaagctgacctgtgcgtgcttcgctccaagtgtacacaactgtgatcacaagtgggaggttttagcagcagtaccgttccaaatgcaantctcccgatcatctgactttgatctattgggaaaactggacacatcaccctttcaaagacgccctgtacnggtccaatttttgcaacggaggtatgcatcccgtgaagtcttcccaaagaaggctgcatcnctaacttcaattgccaattttttaaccnatcctggttatnaatanccatttnatgaaatcacttctgtttgacaacnaaaggggcaagaccaatcatgnattctccttnagatggaacanttngcaataaccgatanggtcatanaacgcaagcttgtaaacaattggaccttcttgaaatccccnaactccnatggccncnaccccc

SEQ ID NO: 82051 - DNA, 511 bp, Triticum aestivum
  unsure (1)..(511): unsure at all n locations
  Clone ID: PAT_TA_82051
cctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtccgacggcacctgcggtgggaccctgcaaagaantactgatccgggttcatgcccggcatgatatttcccgcctaaaataaaataaaactcaaggcgagatgagcagcgtcatcctgcctatgcgtgtgtgtgtggccaacaatgcttatacaattatgtcctctcttcgtcgctgtgttttctctctccnaagaaaatttngtgttgcttgntgttcaactatcccggatacctcccgtngaaaaacnctgttatgattgtcctggntgcaaataatagattccctttcaaaaggggggcccg

SEQ ID NO: 82052 - DNA, 643 bp, Triticum aestivum
  unsure (1)..(643): unsure at all n locations
  Clone ID: PAT_TA_82052
gttttttttttttttttttttttttttttttctgtttttttccttttaattcttttaatttgataaacacaacagtctcgtctgagacgatgtgagtgagttttgcagtcaagcaagtgaagcagtcgtgcttggtgggagtttctcggtttctttcctttagctttgttgatttgacaaatcctgacaagaaaaccggaccgagtgaagagatgaaagaagctggtcgaaattagacctcgaggaagtgggccgcgacggccatctcctgaatgagcgcctgggttttcgcgtgggatgggccagtcttgaacttctcgacgaccacgttgatccaacgcttgcgccagtacaaaaagctcaagcacaccatcgactgcgccggagccatggncaagcgatcttcnanggcaatcacgcggttggctccggctccacannggtgtccaaaacaacctgtgcctcgatnaatgacacgaagantcccanatgatcccgggcaccccntgncaanataanagnggcancgtcatcccaatgccatgtatccacggcccaaggaaaaaaagacggtccnggtggggtgcggcaatgctccaaaaatatcncaggggggccgtacaaatcnccnaaagatctatnn

SEQ ID NO: 82053 - DNA, 460 bp, Triticum aestivum
  unsure (1)..(460): unsure at all n locations
  Clone ID: PAT_TA_82053
gccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccaatgcaagtgcggcaccagctgcggctgctcctgctgcagctgctagattcatcatcgattatgcatgcaccgnccgtgcgtgcatcatcgattcgtatcgatnctactactaccatacatgttacccaacctgatntnaaggcttattncgcanctgacctgcatcaacatcaaggtgcatgccatgattgtaaaaagccccctaaataactccctttgatt

SEQ ID NO: 82054 - DNA, 601 bp, Triticum aestivum
  unsure (1)..(601): unsure at all n locations
  Clone ID: PAT_TA_82054
gtcaggtcgttcggtatcaggcgtaatgagaagatcgcctgctatgtgactatcaggggtgagaaggcgatgcagctgctggagagtggcctgaaggtgaaggagtacgagctgctcaggaggaacttcagcgacaccggatgctttggcttcggtatccaaggagcacatcgatctcggcatgaagtacgatccatctaccggcatctacggtatggacttctttggtgggtgctccgagcgtgctgggtaccgcgtctcccgcccgccgcaagtgcaagcccgcgtccggtatccaccagagggcaccaaaggaggacccatgaantggtccaagtcaattacanggttcatcctcaacaatcccatgccaactaagaggacttacncnctttaaacttggattnatgattaactggttgccggaatgtagttacctaaaaaccnatctttgcattttcccgtaccaaactggagatccgnttgttcncattcctcnaanagnaatacgtttaccctnaanataatanantctggctagtgatactcctttgttgtacccaactccaatttgtctcaccaattctcccactanacattt

SEQ ID NO: 82055 - DNA, 575 bp, Triticum aestivum
  unsure (1)..(575): unsure at all n locations
  Clone ID: PAT_TA_82055
caacgacgtcaagaactactggaacaccaagctcaagaagcggctcctcggcggccgccgcaaggaccgcggcgccggcacgcagcagcaccgccagggagagctggacggcgccaacaacgacggcgagcagcagccgctgagcgcgtcggccatggagaggatncagctctgcatgcagctgcaggaaatgcagaaccccctnagcagcatcggcaaccacaacaatccttgcacctgtgggcagcctagcaccatcatcangtggccgccatcaacaattaacaacagcaacagcaacagcagcgcagcacaacttcgatntacantacttgctancaaggaattcattctcttnatgncagactccgggggcacacattgngacanaccccgcaaacgctgctccccnttnangcggnaatcaaaatgtacatcnaaccgattaagatctctaaatggacacgacacacggaaantttananacagggtgtgatggggacttataggaatccatgatnctggattacctaacactcgnttcagatacacntggttaattacaanntaagcn

SEQ ID NO: 82056 - DNA, 513 bp, Triticum aestivum
  unsure (1)..(513): unsure at all n locations
  Clone ID: PAT_TA_82056
gttcatgcaccttgggcatctgaaggatgacgagtgcaagtaccgtctgattgctgtcattgtacacaatggacctaccctacgcgaaggacacaattttgcttatgtgagaacaagtcaaattggaggccagcagcaggagagccacagctctcccacatggtttctccgcaagcgacgacagcatcacacaagtatcactagaagaggtactccgagtgtcaaggcctacatcttttcctatgaaagggtttgaacaaccaaagggcgtgtcantctaccgagaacatccgccaaagaaagatgaacggatngaggagaactggatgggattgagaaggaaaanatttgtaatggttttgctgtttcaatcaaacaacatcacatttggttatttggtggagtggagtgatccatcccgggaaaggctntgatttnggattaaactcctcaaaccttgcttngactttgatttttgcnatcaattatgtnntaagnatatttntccacnan

SEQ ID NO: 82057 - DNA, 628 bp, Triticum aestivum
  unsure (1)..(628): unsure at all n locations
  Clone ID: PAT_TA_82057
cttcttttgagtgattaaattgtccaagtggcttctctgtccatgacttcttttgagggattaatttttctctaattttccttccatgtcgtatgtgcagcaagcaatcaaattgtattgtttatactcatattaccacaaaatcatcatttctttcttaacattaaggaaatgttaagtcacaagatataattaagcaggaaataaccattgggagggagtaaatgggctactgntttggacctacttgccgcttggatttgggatagacgaccttcggttggctaaccagccattggagccataaaactttataatggtaatatcaatacatccagtacagccggtccgtaagtgtttggcgttacgcaagcctccttggggatgaatgagcaatgttaaattggatataaagntcaatattgtccaagcgtggaaanattttgcgnaagaatggtttcattcccctcacggnccgacagtnccttgtgcgcaacagaattttgccgatggggtcctccanaaaggtacgtttgaccactgccacaatatgcaacgtgaacagttgcgatgggcncccaacagaacntntacaaaatataaactgggaatcnactacatttataca

SEQ ID NO: 82058 - DNA, 333 bp, Triticum aestivum
  unsure (1)..(333): unsure at all n locations
  Clone ID: PAT_TA_82058
gcggnccctgcgcccgcgcccaccgtcgcccccacgcnctccgccaccgcgccggcgcccgccgactccccgatgtcctcccctcnggcgcccaccccggacatgtcnccctcgcccaccgnagagctcgccancccgggcagcggngccgctggtctcagccccgncttcntgttggccgcngncgcggtcnccatctacgccttctatatgaccngntgatgtattatttcattgtntcnttgcagcttttgttccatttctncnnctctttgcgnctttcgtngcacattggcgtaccncatcttctgctgtaatcccancattgattta

SEQ ID NO: 82059 - DNA, 471 bp, Triticum aestivum
  unsure (1)..(471): unsure at all n locations
  Clone ID: PAT_TA_82059
cccccgaccatctcccctactcaagaagcaggcggcgacgacgttgccgccgccgacgacatcggcgcggggaagttcaccgtctcgaggagagcggttcctcaggggcccaaccctctgcacaactgacgaggatcaacgcagggtcacgaggatcgtcggcatcagctccggtggatctctgcggcaggcaccatggccaccangatacatatactatacccttttttttgtcctccccccattatttttttagctggctagcctanaaagatgataatacggtacagacaggccgtantaccaccattgatgtatgtatgtatgtatgcatgctcatcaatacctgtgggctgtgtgtggtccctcnctccattcctgcttccttgcaatgattaactacagcctcgtgtacatatcnatgattgatgtnggcaaggcgtgatanttgttggtaagcatttccttaaa

SEQ ID NO: 82060 - DNA, 214 bp, Triticum aestivum
  unsure (1)..(214): unsure at all n locations
  Clone ID: PAT_TA_82060
gagagagagagagagagagagagagagagagagagagggtgntngttattgatggttcttgtcagtgtggtctgcggntatcacaaatgtcccttgcatgtggcnaanatgaataagtggtggtgcatgtggncagaatnaaggataggttgcatctgttatgcttggtannggatcanaccctatctatgctaangnctgtatgctgctatca

SEQ ID NO: 82061 - DNA, 625 bp, Triticum aestivum
  unsure (1)..(625): unsure at all n locations
  Clone ID: PAT_TA_82061
gaaggaaggacgctttcagaggcgaaaggccatggggagagatttttctgtgatccatggatctccgatcgggaaaccgtatccaagctccgtggctagtctgcgctctttggacttttcaaacttagcgaactgaaacatctgagtagctaaaggaaggaaaatcaaccgagaccccgttagtagcggcgagcgagagcggaacaagggtttcatcaaaagaaatccgaagcggtttcattcgatttgttgtggattgggatgatgggaaaaaccaacaagcagcaagcgtaattaagaaaantgccgtaacgcgccctacggagttgtacaaancagcaacctttttggggcncaacatagcaacacagacgannacgggtngggcgccatngactggttttcnnaaaaattggaatccggcaaagagtatacctgtcatcgtccatggtcntcttccaataaaccgggtgtccaagattcctttaccanaaagggacacctcnagcnaattcccatgacgatacgtcaatacgtaggaaaggaaagaaccatcggatnataaaacnaatcatcaaaacatcangacgaccgggaaccncaggtcctttcaaggnccagaagn

SEQ ID NO: 82062 - DNA, 575 bp, Triticum aestivum
  unsure (1)..(575): unsure at all n locations
  Clone ID: PAT_TA_82062
agaagccccaccgcttccgccccggcaccgtcgcgctccgggagatccgcaagtaccagaagagcaccgagctgctcatccgcaagctccccttccagcgcctggtgcgggagatcgcgcaggacttcaagaccgacctccgcttccagagctccgccgtctccgcgctgcaggaggccgccgaggcctacctcgttgggctcttcgaggacaccaacctctgcgccatccacgccaagcgcgtcaccatcatgcccaaggacatccagctcgccccgcgcatncgttggcgaaaaanggcctagctgcctccctaaaatcctatgtccgatttggccncaagtgtagaatgcttacaatttcctaatanccttgtcgttggaataaggtcccccacantgtgttaaggggttanttcngtagntatggacancctgttanatcacaatgagaatnacatctatttaantctgctgtctcggttataanaaaaaagtttggnangtaaaatgtggataacaaaatagtgccgcgcttcaattgnaantgtacactnctgaananagactcgcaat

SEQ ID NO: 82063 - DNA, 653 bp, Triticum aestivum
  unsure (1)..(653): unsure at all n locations
  Clone ID: PAT_TA_82063
cgggtgtattctttgtgttgtgggttcgacaacaattgtgctacatgcccctgcggaacgtgaaattgagtctgtggcagaagtatgggatcttgctaccgaaccaggatttctactttatgcagccattgtgctcacagcagctttcgtgctcatattccattttgtcccacagtatggtcagacacatattatggtgtatattggtatctgttctctttttgggtctctgtcggtcatgagtgtcaaagctcttgggatagccttgaagctgacgtttgcagggatgaatcaagctagtctatccacaaacatggtcttcacacttgttgtggttgcatgcatagtaacacagatgaactatctgaacaaggccttgacacattcaatacgcagttgtttcgccatttaatatacaagttactccgttgacattttggctantgtaataatgtcaaggacgggatctcaaaatccgatcaaatgtcacggaagtgtggttgtacanccttcgggacttctgctcacaagacaaagnatgggggatggctcaacagatnccaaccaatccaanancgacaggatctataactaggattccaagcgcgcgangatccccagcaccggggcaagaatccaggcncccatgatcn

SEQ ID NO: 82064 - DNA, 599 bp, Triticum aestivum
  unsure (1)..(599): unsure at all n locations
  Clone ID: PAT_TA_82064
ccacccttcacctggtgctcaggctcaggggtgggatgcagatttttgtgaagaccctcaccggcaagaccatcacacttgaggtcgagtcctcggacacaattgacaatgtgaaggctaagatccaggacaaggaaggcatccctccggaccagcaacgtctcatctttgctggcaagcagctggaggatggccgcaccctggctgactacaacatccagaaggagtcnaccctccacctggtgctccgccttcgtgggggcatgcaaatctttgtcaagacctcaccggcaagaccatcaccctggaggttgagtcctctgacaccatcgacaatgtgaaggcgaaatccaagacaaggagggattcccccggaccancancgcctgatcttcccnggtaacanctttaggatggcccaccctggcggactataacatccagaagatccaccctcanttggngcncgtcnccgtgggggcattatnctgnaatggacgntcccgngggttggttaaagcttngtnttgaantncccnatgggcntttcgnccccgncttcanttcacngaggggagccctaatcggtntttaaatcc

SEQ ID NO: 82065 - DNA, 305 bp, Triticum aestivum
  unsure (1)..(305): unsure at all n locations
  Clone ID: PAT_TA_82065
ngatcctgatcntccaggccgtcntggtcatgggactcctctcacacgtgnncgccaattttttccccaagtgctgnaacaactgcaggtccttctcgggggtcgangtctgnnacgactcccaccccaagtgtcnccagggntgctcggcgtgccgcgtggtgtcnacganccccgaaatgtggcgctgcgcggatatgaaatccaccgtcnaccgcacntncagtggancctgnacgaagtactgatgggttcatgccngnatgatatgttcccncctaaaananaataaaagctcatcgcga

SEQ ID NO: 82066 - DNA, 572 bp, Triticum aestivum
  unsure (1)..(572): unsure at all n locations
  Clone ID: PAT_TA_82066
aagaaatacccaaacaaggcctacttgctttatcgaccctgctgggctgcaaatctttcaagacgaggagagtttcattctgtttgcccagaaatgggctgtacatttttaaaagacatcaaaccgggaattagtttcaatttttttcattacaagatcttaaattccattgatttttatgtgtggacaattagttggattttatatttatataaattatttttcaaaatagtttgaatgtaaatcgatatttctggattaaaaacagttgactgcaccgaaatatgcanaatttcatatacttttnaaccgtggcgacaatatggggtgtaatgctaacaaaaanaanatgggctccaaaaaaatcttaagaattagcanatgggttgtacattattacganataatggcagatgggcntatgctatttccacagatttnangntgactntgcgcctactacagttgaccgtatgctttatanaacaaggtgacgcanaccaacgcctgcnactatatcaaacacganacannacgtggattcatcaacggttcgtgctctcatcncgcct

SEQ ID NO: 82067 - DNA, 634 bp, Triticum aestivum
  unsure (1)..(634): unsure at all n locations
  Clone ID: PAT_TA_82067
cgcagccgacgccgtcgtgggcacgggagcccctcttcgagaaggccgtgaccccaagcgatgtcggcaagctcaatcggctcgtggtaccgaagcaacacgccgagaagcactttcccctgaagcgcaccccggagacgacgaccaccaccggcaacggcgtgctgctcaactttgaggacggtgaggggaaggtgtggaggttccggtactccgtattgggaacagcagtcaagagctacgtgctcacaaagggctgggagtcgcttcgtccgtgagaaggacctccgctgccgggcgactccatccgtgttctccgtgctcccgcgtacgggcaaggagaagcattcttcatccgactgcaaagaagaacacgaccgttanacggnggcaatctgcgtcgccgctgccgtggtgggagacgtcaaaggagaacattccgcgtcgttaggtttccgtgtcacatcccggataaanaggtgcaagcgcnatggcggacaaggccnccggattatcaagagnaatgctnacanangtcggatccctgccnaagtctcgtctaaagatcgnantcactaatattaaacttccccnttctctgtgtaatnaanagtgtcgtcagattnnaatcccg

SEQ ID NO: 82068 - DNA, 625 bp, Triticum aestivum
  unsure (1)..(625): unsure at all n locations
  Clone ID: PAT_TA_82068
gacacacctcacggatgagttcaggaacctggaaagaatcgacttgtgattgagcgccagtcatattgggttcatagttggctgcctacataactattagacacgacatcatggacatgctggcaactagaaccacatggttggccatagctctctttttcataactattgtatccactaagatttcaagatggaaaagcaatatccatcatttgcccacaagaccacttccacctgtggtgaatgtccttgctctcttaccttcggtttttaaaaagggtttgggttacaatcaatgatctatacacaaggtacggcagtgtatttacaataaatttgcttggggccaaagataacttgttggttgggaccagattctcggtcattcttccaagggctcgatcagagattactttgggtaattttgccgangttacgtcccatcttgggcaagaattttgtatggtgtanattcgcaactcgcantgagcaagtaaactcctgctgaatattaaagcatcaagttgcnaanctcgttgatccatattcaagaantaaggctacttgcaacggganatatgnatatattaacataacttaccagngccagttaccatcgnccnac

SEQ ID NO: 82069 - DNA, 611 bp, Triticum aestivum
  unsure (1)..(611): unsure at all n locations
  Clone ID: PAT_TA_82069
gtcctttttcgaccatggaaaatttagtaattgaccatggcaaattattttttggtagatcatggcaaatttattaattgttaagaacatccacatcttctgtcatgcccttttttggcaattttttctccattttttaaatttatttccatggcaaaagtactccatttttgccatggaaataattaattcattttttccatgtcaaaaatagtttctattttcacatggcaaattttttgttttagttgccattgcaaattttatttttagttgccatgacaaattttttgtaaggactatgggcaattttaatttaaatattatggcaaatttacattttatagaacatggtaaattttactatgtagcatcttaaatatattggtgtanccaaggcatttttaatttattccatgtcaaaagacgcattttgccgtggnacaataaacaattttgccatgcaaatatcaagattcnagtgatattacgtaagtattttcagctttagtggtcattttcatgttttaacaaatgggcaatggctncacacagtgcanaggttaccctttcagacaattactctncanggaattaccaattggaatttn

SEQ ID NO: 82070 - DNA, 636 bp, Triticum aestivum
  unsure (1)..(636): unsure at all n locations
  Clone ID: PAT_TA_82070
tatttagaaaaatagaaaaataagaagcagtcctggaaggacacgagagtggagggcacgccccaccctcctaggtgcgcccccctacctcatgggcacctcgtgcgctttctggactccgttttcttgcacaatgcgtattttggtcggtaaaaattcattatataatctcccgagggttttgactcccgtatcacgcaattatcctctatttgtgtttcaagctgttgctgctgcagattagagcaagatgtcttcgcaagagtcagtcgggaagagccgggtgtcacatccggcaccgagatcgatgacaaacaacaatgttgacctctttggggccaagcaacggaggaagatatggaggctgatttgaagaggatagatgccatggaagaggatcaagaatcacttcccgctttcaagctggatcacaatgggagaatgcanactcggcnatccaaaccggtaacccttcaatgtaaattcttcctaanagatatgaaaagatgtcagtggtctcccgcanntatcaacacctnggtgnaggaacttggtgtanaggaaaatccaaaggatatgncccaacacaantatanccagggggccgtacaatcnccaaangatcttanccccatg

SEQ ID NO: 82071 - DNA, 488 bp, Triticum aestivum
  unsure (1)..(488): unsure at all n locations
  Clone ID: PAT_TA_82071
aggatattttcatatctgcaaaactcccatcttagccccctggccttttcttttcatgtagttgtttatttaaataaacagaaattgaaaagaaagganaacacttacctgggccgatctcacctggggcgccctggcccagcagcgcagctgcaagagagcagcagcccancctagcctcccccggtaatttttctctccaatgcaatccttcggccccacctgtcatcctcactcctcttactttcctccagctttgcacttttcttctctcacantaactctcggtgaangaagcacacatgnncaccgcggtgaaaccacgacgccctcngatgcctagtagctctccnatanattcacccccggcttccaaagggttttccctagcctncttcntcatcnccnccggcagtngcaggtgagtccccacgttagcataaagccatgcccgtgattggnagcnttattngggtgcacaanggtgt

SEQ ID NO: 82072 - DNA, 241 bp, Triticum aestivum
  Clone ID: PAT_TA_82072
cggaggaggaaccatgaagccggcggttcagtatattttgtgtagtggtgattgaatcattggtgatgaattttatctatcattttgtaaacccacattgtgtttgagacaatgaaccttaatgtttcctctagttaattagctatattagcttatgggaaattttgaaagtcattatgttgataacggatgaagtatatacatgtgaaattaattaatatgtgtttctaaaaaaaaaaaa

SEQ ID NO: 82073 - DNA, 571 bp, Triticum aestivum
  unsure (1)..(571): unsure at all n locations
  Clone ID: PAT_TA_82073
gatcttgtggcttgttgtccctggagcagtcgcaccctaccaagaaaggatcccaacagaagggcttctggatgctacgacgcaatagcttggccttgcaaatgcagtgtacttaacacagaaggcaaggacggttggttttgacacaaccatttagttatattcatctaagaaccaactagataactgacttccaaggaaatcaatatccatctatgtgtacggaaaactcnaagaggctgaagatcgactggaaactaaagctctcaagtacatggaaggatcttacagtagggtgttgcaagacttccanctgtggaccaagctgcagttggttcancanaaatataaatctctggngcatcnacaacanacatataaatctctanagcatcancagaaanaacacgatcnaaaatagactattncacaacagctgggncagtagcnnagtanagattcatggcancaangaattnccgtatattgaggcaacttcacanaggtnancacccncgcnanatcnaacgtnttccaaagataaatagtgccaacacctaagtcnanttca

SEQ ID NO: 82074 - DNA, 415 bp, Triticum aestivum
  unsure (1)..(415): unsure at all n locations
  Clone ID: PAT_TA_82074
aaagggtggtcgcgtggccgattgaaggtcctccttggctgtnctcatgtcttgcgcctggagttggccgctgtcgtccatgtcgcgtcgggaggaacggcagcgtagagagggcggccaagcagtaggctgcgtgctgcgcgccgtcccgcaaagagccgggccaggatgggtgctggccaccgccgtctttgcgaccgccgtgccgtgagcggccgtggagcatggagatgcgtcgtgcgccgccatggcgtgggggccgtggccggtagccgccgggagccacggatgcgcgtggaggcacaggagccgaacacggatnntggtcgccgctcggctctgggccnaagggngcctttaanangcgcaagncggagnatccannaccgangggtgccgctactccntnccaaaa

SEQ ID NO: 82075 - DNA, 609 bp, Triticum aestivum
  unsure (1)..(609): unsure at all n locations
  Clone ID: PAT_TA_82075
gaggagcgctcttgttgtttctgaaagagctcatatctagaagtttagaaacacaacaacatggagcacaataactataatggcagccactctagtatcctaccggaaacatgaacactaataacttcagaattaccatttgaatacacataaatatgtctctaaaattcctatataatagtatcggcatgggaattttattggaatcatgacatgctattcatatgttacaaagaacgaaatcatctaaaactaagtatggatttcctttgtaagaactgaatcatctaaaacttaattcttatgttttttcgttgtttcaaaccggtcgcattgcattttgttnaatttccaaaatttcatcatagtccccgtaagattgcacttcatcatcatgagtgaaaagggaaatattgggtccaagacatactcctccncaataatgaacgagatgaatacaaatatcagttcatatgagcgattattattgcncatatgatccaccatatatnnccatgtncntttaatnaagtgatctcatccaaatcacaatanaatgacttgnngacctgttagaaatacnctncagccantccaaatnnttgtgtt

SEQ ID NO: 82076 - DNA, 416 bp, Triticum aestivum
  unsure (1)..(416): unsure at all n locations
  Clone ID: PAT_TA_82076
ggttacatgcttagaggagaacctattgtaaataatatcatgttctagcatcatttgagcgacaagtaattccggacggatgtagtatcacttaattacaagtgacatttatgatcaccattgatcttacagtatgattgttttcatgactttcaaaaaagaaatatcctaaaagttgagtgcagctggacggacctcaatccatttgagccaagaaaagtagatgcggactgtcctcaatcatttggagatatgaatagtagatgggaaagggtttgaaatattttatgcaacaatggttactaaatggtaggaacatgtgttttttgcagtagtcctaaatggnaacctccaaagtgcctaattcatatgttataattttccaangaaantcataatgcatccaanaaaaaaaa

SEQ ID NO: 82077 - DNA, 607 bp, Triticum aestivum
  unsure (1)..(607): unsure at all n locations
  Clone ID: PAT_TA_82077
gcccatcggtttctcgaccactgatcctgatgcacccgacccggagcgtgctgatgtcttctacgttatggatagattccctgtcagctgcaacccctgcaacttcgaggcactcatgtacagtgacccttccaatggcgggaggttaaaaggctggcattggcatgaactgccgccaccacctgcccatgttgacaattgcattgttaactgccatgctctgcttngacattaacggcgacccatacttgctgtctcctccactggagaaaagcatcggcacctactgcttcaacacggtcaattacaagtggtttaaggtggtcctggactccncccttcttactcctgctgaacatgtnccaaacttngaaacncctggttgggatttcaattgataggctaacattttgtgcaatggtaccctctcttcgcacggaaattccnctttggtganattggcaaactttactgccnaaganggtgatgcaaatgaacttgtgtactnggaaatggaggttngcacacaaatcctgaattggttggacaaaaactgggactgacnaaaggtcntataccgctgagtgtgncanaaatcggctttatg

SEQ ID NO: 82078 - DNA, 319 bp, Triticum aestivum
  unsure (1)..(319): unsure at all n locations
  Clone ID: PAT_TA_82078
accaaaaaacgtacttgctgcttgatccatgctgctgctcgaacatcgccgatttctgcgctccctttgatcggaaacggacggccaggatcgatccagcgagcatgagatgctcttccgctcgccgctggatctcaattattgttgtctctgtgatttagtagctagtgctgcagctttgctatcgatctgttggctgattactggatggatgtatccatcgtctctctctctgtgtccttcttattcctcatgtttgggcacctgtcaccctcatgcttgtctctctaaatataattcctaaaanaaaaaaaaaaaa

SEQ ID NO: 82079 - DNA, 633 bp, Triticum aestivum
  unsure (1)..(633): unsure at all n locations
  Clone ID: PAT_TA_82079
accgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaagtcatcatttctgctcccaacaaaagatgctcccatgtttgtctgtggtgtcaatgagaanggatacaaagtccgacatcnacattgtccccaaacgctaattgcaacaataactggccttgctcctccntgctaanggtatcaatgacaaggttggcattgttnaagggttgatgacaaaagtcaatgccaatgactgnaacccaaaaaacggttaatggccctccaacaagggctggaaagtggaaaggctgcaaattnaaaacatccaacaanatggtgcccaaaggttttgaaagngncccaaanttaacggaattnacggnaaggctcccttccanggtgagttccttgtgattgacggtaacttcaaccncaacaagtaattagg

SEQ ID NO: 82080 - DNA, 412 bp, Triticum aestivum
  unsure (1)..(412): unsure at all n locations
  Clone ID: PAT_TA_82080
ggggagcgaactggcagtgcaacgcgccgttggtcgggcaggggatctccttctccgtcacctccaccaacggccagacgctctacatgtacaacctcgtgccggcgtggtgggggttcggcatgaccttcaccagcaaccagcagttcggctattaattattcacctgatcaatagctcgctactacctcgcacgtactgccgcgtcgatctcagctaggctgcatatggcaatggcatcaagctgcatcggattgcgcgtgtacgtagcttgatttgcctgccatttattcgtctgcattctgaattctgatctgaattggggattttttcgatctttttggtaacatgtatgtatatcntttgtctcatatatatatatatatattaaaagctaaaaaaaaaggggggg

SEQ ID NO: 82081 - DNA, 431 bp, Triticum aestivum
  unsure (1)..(431): unsure at all n locations
  Clone ID: PAT_TA_82081
acggccagcaatgtcgggccgcggcaagggaggcaaggggctgggcaagggcggcgccaagcgccaccggaaggtgctgcgtgacaacatccagggcatcaccaagccggcgatccggcgtctggcgcggcgcggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgacagggccgcaccctctacggattcggcggctgatctgatcccgcgtgttcctccgttgttangggttgccgatgtgatgtaatgtgatgcgcattgtttcaaattaatcaatggatcgctgttgctgttcaaaaaaaaaaaa

SEQ ID NO: 82082 - DNA, 466 bp, Triticum aestivum
  unsure (1)..(466): unsure at all n locations
  Clone ID: PAT_TA_82082
ggcacccgcaagaccatggccgccatccgcaccgccatctcccacgtccagaacctcatcaccggggtcaccaagggcttccgctacaagatgcgcttcgtgtatgctcacttccccatcaacgcctccatcaccgccgccaaccggggcatcgagatcaggaacttcctcggcgagaagaaggtgaggaaggtggacatgctcgacggggtcacatcttgcggtccgagaaaggtcaagggatgagatctcctcgacggnaacaaatcaactcgtctccggtccgcggccctcatcaaccaagaaatgcaactcaagaacaaggnttcaggaattcttggccggatcnacttaacnacaagggggcaatcaaggaggantaaatgcgaaaaccntcaaaaaccttgttctgcctgcctgnttaaccgccttggtcctggttggaatttnaacttcccaaaacgaa

SEQ ID NO: 82083 - DNA, 584 bp, Triticum aestivum
  unsure (1)..(584): unsure at all n locations
  Clone ID: PAT_TA_82083
aacatacaccaacctcaacaggcttgtttctcaggtcatttcatcgctgacagcttccctgaggtttgatggtgctctgaatgttgatgtcaatgaattccagaccaacttggtgccctacccgaggatccacttcatgctttcctcctatgccccagtgatctcagctgagaaggcctaccatgagcagctgtctgttgctgagatcaccaacagcgcctttgagccttcatctatgatggccaagtgtgacccccgccacggcaagtacatggcctgctgtctcatgtaccgtggtgatgttgttcccaaaggatgtcaacgctgctgtgggcaacatcaaagaccaagcgcactatccaatttggttgactggtgcccactggcttcaaatgtggtatcaactaccaagcaacaagtgttgtccaagcggtgaccttgccaangtccaaanggctgtgtcatgattccaactccacaatgtcntcnagncctccccgcattgacacaanttgactcatgtacccancgngcttntcantggtacttggttaggaatgagaggaaattnctaagccttaggt

SEQ ID NO: 82084 - DNA, 624 bp, Triticum aestivum
  unsure (1)..(624): unsure at all n locations
  Clone ID: PAT_TA_82084
gactccaagacccttctcttcggtgagaaggaggttgctgtgtttggctgcaggaaccctgaggagatcccatgggctgctgctggtgctgagtacgttgttgagtccaccggtgttttcaccgacaaggacaaggctgcagctcacattaagggtggtgccaagaaggtcatcatttctgctcccancaaggatgctcccatgtttgtctgtggtgtcaatgagaaggaatacaagtctgacatcgacattgtctccaacgctagctgcaccactaactgccttgctcctcctgctaangttatcaatgacaagtttggcattgttganggtttgatgaccacagttcaagccatgactgcaacccaaaagactgttgatggccttcaacaaggactggagaagtggaaaggctgccancttcaacatcaatccaaacaacactggtgcccaaagntgttggnaagtgctcccaaagctaacggaagttgactggnatggctccgngtccacggtgangttcgtggtgtcnacgttaaacnttcaaacancaactatataaataaggtgcntcangnggatntaggaaaccaagganttggttacttatagccttttcncgnn

SEQ ID NO: 82085 - DNA, 623 bp, Triticum aestivum
  unsure (1)..(623): unsure at all n locations
  Clone ID: PAT_TA_82085
cttggcatcagtgtcccaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcgcaccatcaaggatgaaggctttggctcactggtggagaggaaacactgctaacgtcatccgttacttccaancaanggttttaaatttttgattcaaggnttacttcaaagaggatttcaacttnaaaaanggaaangatggttactggaantggttccggtggnaaccttgcttctgggnggtgcaactggtgcttccccncngtcctccngtacccctttacnagctanganagntggcaatnacncaaagnatcaaaggtggaggnaaangaattnaagggctggttattcacgcaaannncaatcaatggatnccgggcttacgggatnacaccccnngttgaacatgcaactggcgtcttgncgntancctaacaattc

SEQ ID NO: 82086 - DNA, 542 bp, Triticum aestivum
  unsure (1)..(542): unsure at all n locations
  Clone ID: PAT_TA_82086
gataaccccaggaagatgagctacgtggtgggctacggcaaaaggtacccgaggcggctgcaccaccggggggcctccacgccgaacaacggcgtcaggtactcctgcaccggcggcaacaagtggcgcgacgccaaggggaaggacccacacgtgctcacgggggcgatggtcggtgggcccgacaagcacgacaagttcaaggacgcgcggattaagctacgcacagaacgagcccacactggtgggcaatgccggctcgtcgccgtctcntcgccatcactagcagcggccgcggtttgggcgtccgcgccgttcgacaagaacacatttcaacgccgttcccgcccatgttccccgctgtccgccgccgccggcaactggaaccgtttagggacaaaccgccctacctgactttagaaaatattctaccnggatatcctactgggtgacgttcctgttggtttnattaagttaattttttccctgaatttttcaanatttncttgctncaaaaattcatggtcaacttcctggttggt

SEQ ID NO: 82087 - DNA, 553 bp, Triticum aestivum
  unsure (1)..(553): unsure at all n locations
  Clone ID: PAT_TA_82087
aaacatttcaggctatgtcaggcttgatttgcagtcaaaatacaaggtggcggcgtcgatttggaattcttactgatttgagaactaaaattatgatttataattgtaatagcaattggaagagctctgaggaccgtacaattctcagaaagtgttaagtgcagacttaagcgaaaagcttcagacattgcagtgctaagatacttatactatacatatacaaaggtcaacactgtgagctgggacacacactgcatctccttacactatacacttccatttgaaagaacctaatggccatcanggttatgaattccttgggtggaaatgataatgtggtttcaagaatttgggatttaacacgaggtgattnagtgtgaaaaggatatagctcaaactttaaaggttccttaaattacaaancntgatctaacatganaaggcaacaaggtgcactttgtcaanagcaaaaatccancaacatgccattagggaaactttcanggaacatcatggatgtgatttaaacggggattaataatgatgcatatna

SEQ ID NO: 82088 - DNA, 578 bp, Triticum aestivum
  unsure (1)..(578): unsure at all n locations
  Clone ID: PAT_TA_82088
atctttgccggcaagcagctcgaggatggccgcacccttgcggattacaacatccagaaggagtccaccctccacttggtgctcaggctccgtggtggcatgcagatatttgtgaagaccctcaccggcaagaccatcaccctggaggtggagtcatctgacaccatcgacaacgtgaaggcgaagatccaggacaaggagggcattcccccggaccagcagcgcctcatctttgctggtaagcagcttgaggatggccgcaccttgggcggactacaacattcaagaaggagtcaacccttcacttgggtgctccgtctccgttggtgggcaattaactcctgggccatgggagctgcttttgtctcctggggttcaanaantctcgtcttccggtgtccttaaaggatcctggtccaagtccngcccttgcctgaacgtctttgtttccaanaccgtncnatgagcatgttancntttggaacctgcaaattctgctggggtgcacaacttngatgaactaatattaaatgagcccgaatncaaaaaaaaanggggggccggtaccaatcncctaa

SEQ ID NO: 82089 - DNA, 475 bp, Triticum aestivum
  unsure (1)..(475): unsure at all n locations
  Clone ID: PAT_TA_82089
gagcggtggcccccgctcgagtccagccccgaagtcttcaaccagttcatgtggtcgctgggtgtcccgcggggcgaggccgagttccacgacgtgtacgggctagacgccgacgcgctggccatggtgccccagcccgtgctcgccgtcgtcttctgcttccccgatncgcccgaggatncaagccgcccctccaaaacaagtctcaactactgaagacaagcaggaaagtttgggatggggtgtatttcaaaaaacagattngactcatttangaaatgcttgtggaactatcgctttacttcaatgctgttgggaaatgcatgttcaanaaacaatctaattgggagaattcaagctttgacctgtttttncaaatcaaacaagcancatggacccnttatnancgttccaaantgtttggnaaaagnccattacatggaaaanactcaatccattggntgccaatgntggg

SEQ ID NO: 82090 - DNA, 562 bp, Triticum aestivum
  unsure (1)..(562): unsure at all n locations
  Clone ID: PAT_TA_82090
gaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacagaggaagcaaagaagagcaacaatgtccaagaggaagctttgagaagcgccagcagggacgtacactgggactcccacattngaggagcattcaatnggtggaaaggctggctgggcctgcatttcctctcgccctggacagtgtggncaaagctgatggggtacatccctgganggcaaaggactggagttctacatgaaggaactcccagaagaagaaaggcaanggggccacacttagccnaaagactgctgcatgttacccnttggtttcctaaatgtgctccaagtcaagttttgcanacatactgacacatttccggtnaacgtccnatcccaagttgaacnganaattttgccngnttgggtgtatca

SEQ ID NO: 82091 - DNA, 568 bp, Triticum aestivum
  unsure (1)..(568): unsure at all n locations
  Clone ID: PAT_TA_82091
gtgtggcaagtggcacctccacattatagtgatgttacttttttggaggaaaccaaaagcaatcatacgtacctgcaatcaaacattatactattattctagttccatatggctcctatgctacataggtgttctaccgggttttttggctggctataaactgacaggtcaatgcagtaggccatctaagagctatgatatagtcatgtggaatagtagtaatttatacaaggtacgctcttgaacatttggtctgcttgatgtgtaagcctgatctttgtaaagctcataatcataggtgtactcctagattctacttcaagtgggtccaaatattggatacattaacatcaaagatagattacaaagtaacaactangatttaacaagtaatagtgtgtgattggataagtcctgacatgtnncatggaccaaacctatttgtgcaaattggccgttccngatcaaattggtgtccatttttgggggtgctgttatgggtaaacgatcaattacnaacggatccaacanaagttgcatccagggttaactccgaatacttggtgat

SEQ ID NO: 82092 - DNA, 593 bp, Triticum aestivum
  unsure (1)..(593): unsure at all n locations
  Clone ID: PAT_TA_82092
ngagttttttttttttttttttttttttttttttttttaagcannaaatccgcccattattcagatcagagtttcagctgcaattcttacataattacattgcctgtactccacaangctatnaatattcacatggtgacagancgnccatgttcgaattccanaagcctaagcctaaagataccnataaacccttttangcgcagcatatagtataataacattcanagantcataanganccgaaccaacacaggagcatatatatangnacatatatatatncatgatgatacatatccactccanttttgcngngctgtgaggaaatgctctnanatatcacatctaacgactcatcaagccatctccgagctncgaacgacacangcttcantntccaggagggnantcaaaagtgnccnggntcttccctgagatcccagtngganggcctcaaggatgctccncnaggnagtcggtcntcgagtcancaaggcacccntgggcaaggggccatggnnanacctgcanataaggcatccctggcccaacngaatctgccctgcctcnaangggggggccggtcccan

SEQ ID NO: 82093 - DNA, 590 bp, Triticum aestivum
  unsure (1)..(590): unsure at all n locations
  Clone ID: PAT_TA_82093
cgacaatgtccgaggacgaggatgaggggccaccgatgatcatggaggcggcgccgatggatatgagctcgaatggacatgacatgatgggcttcggtccgctggtgcccacggacacggagcgttccctcatggagagggtcaggcaggagctcaaaattgaactcaaacagggtttcaagtcaaggattggggacgtgagggaggagtanccggnnaagaaggagggccgggaagttgcctggggacaccaccaccatactgaagcaatggtggcaggaacacgccaagtggcctaccccacggaagacgataaggccaacttgttgaagagactgggcctgcagctgaagcaatcaacaactgggtcatcaatcaanaggaacccaactgggcacaacaatccccaagacatcaacctncaaatcaaagccttaaagtactagntcaaaactgcaaatatatacatgcatatatatacctgaccctaacccacnaaaatttccgtgacacacacacagagagagagagaattagaanntccaatcattgtaaaccaattataatcagaggngacacttaatgacatn

SEQ ID NO: 82094 - DNA, 588 bp, Triticum aestivum
  unsure (1)..(588): unsure at all n locations
  Clone ID: PAT_TA_82094
acaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtgggtttacaattccgtccgaacaatgagcttggtgaggactcagacccttgtcaagaatgccattggtgcaagtttgatgcaccccttttcaaacaatgggtacctgacccattatggagtttgaaatccggttaggaaagaagaaactgctgcaactgccaaagaaggaactgcttaaggacaagagctgagttnctgctgctgccacaanaggaacaannaanacaacaatttccanaggaacttttanaaccccaacaaggacttcacggacccncacatttangacattcaattgtgnaaggtgctgcctgcattcgtcncccctgnaaatntggcaaactanggtacaccngnaggcaaagga

SEQ ID NO: 82095 - DNA, 580 bp, Triticum aestivum
  unsure (1)..(580): unsure at all n locations
  Clone ID: PAT_TA_82095
agatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctgggtagggagaanttgctgcggtccatctggtggtggtggtgttggctgtttcaactggctgcccctgctgctgggaggtgctgctgcccctggcaagctgagtccaaagaaagaagagaagtcgntggagaaggaagagagtgatgatgacatgggttcatccgttccgactaagttgtggggacttgttcctgaanatcnacccttgggcaaggaaactaganccaatgganttttaacctttattaactganttgtgaaacacgggaanaaantttganaagtnattnaaccctggtngcggttgattacgggggaacanactttgcntccaaaaaaaaaaaa

SEQ ID NO: 82096 - DNA, 589 bp, Triticum aestivum
  unsure (1)..(589): unsure at all n locations
  Clone ID: PAT_TA_82096
aattaacaatttaatatgtgcttattatcagttcagtgctaatattgtaagacaatagtacagttaagcttactgtgttgggaaatttctcccctttgattccacaactgtatgtgttaggtaggctggatggagtaggattagttagtggatcagacaccggatgcgtatttaaaagagtgggagtgctacaaagatgaggaggaagaaatcctaaaaagggtgctcatgtatgttggggattagggaatacagtaaaaaataccatgcattcatactgggtatcggtggacaaacaacattttgtgctcctactgtacaagcttagcgtgggtctccttnagtgtctcccatgatgtgtccaataatgttgggagatcttttttcccaaaacattggaacgttatnaatacacctattccttggcaaagcatgggtccnaaagcaacacatgctaagcctggaccgcaactacctccttccnnccacttccccttttgcctaccnaacctaanacttccncacttttttttgggacanacttttttaatggccaattttccngaaccaacatcntggggaacgggct

SEQ ID NO: 82097 - DNA, 460 bp, Triticum aestivum
  unsure (1)..(460): unsure at all n locations
  Clone ID: PAT_TA_82097
cagaagccgaaagcaagtgagctgagcgacgatggtggtggtggtggcgaccgcgagccccggcgggccggaggcgctgcaggtgtgcgcgctgcttaccagcggcgggtatgcggagaaggtggtggttccggcagggcagctgctcccggtgaccgggagggggcgtcgctgactgacagcccgaggtggcctccaccgtctgggtccaccattttcatgccaatcacctctccctccggtgaaccttccttatccatggtggatcaaagtggaatccgggtacattcaactatacaagaattcaaaagcacctttgggaaatgttacacaccgagacattattctttggttaagtnacaagcaacaacaaaattttccaagttccaaatttngaactttcaaattttcacattcnaatacacccgattgatgttttaacgtttccaaaaaaaaaaaa

SEQ ID NO: 82098 - DNA, 517 bp, Triticum aestivum
  unsure (1)..(517): unsure at all n locations
  Clone ID: PAT_TA_82098
gccgtggcggcgtgggtggtgcacaccagggagcggcggcggcggcgcgaggccgtgcggttccgggtgtcgccgtaccggctccccatcgaggacaagtcgctgctcaagagcccccgccggccctaccggcgcgccgagagcggcgggctcatcggcaaaggcggctgggtgatccgatccggcggtgcatccgtgacagatcggcggcggccacgttagttaaagcaagcgcaagagctggacgctggctgctctgggaacacggcatttcaactgcaagacagcggccaatgtcantcatttaanacacagcacaactccggnctctgccaacaacggaacgacatttccaaaactgatncaagctgcatcccaagagcaaaaaacaatttatgttgaaccaaaccgcccgggcgttaattttatacattttngttccctgttatatatattaaggcgtactaatattgcaacaaaaaaaaantaccaagcttccgtaatttcaaagatgaan

SEQ ID NO: 82099 - DNA, 426 bp, Triticum aestivum
  unsure (1)..(426): unsure at all n locations
  Clone ID: PAT_TA_82099
acaaaaataggcaacatggttgtttcatgctcgatttggtttgtaggttacactaaggaacaccatcataaggaaaagggcattgcactgcgttctttataattggcctgttactattcggtctgctgtagtacttaattgctacaccatttcaagttatgtagtctaaaataaccctttcaaatgaacctttttaattgatattcaagagcatcaacatggtgggactagatcatgaaatcaactatgatcatgagaacttgaagctatttggtgactaaattgtcaattgttttgcctgaattgaaaactggcaagtgtgatgacattactgtaaatgccttgccnaaaaanatttgccaaaacccccccccccaaaanagntccccttttggaaaacnccccnaaaaaaaantgggggggaaa

SEQ ID NO: 82100 - DNA, 326 bp, Triticum aestivum
  unsure (1)..(326): unsure at all n locations
  Clone ID: PAT_TA_82100
gggagatggagggcagggaggagacgctggcgagctgcctgaggctggggttcgcgtgctgcgccgcggcgcccggcaagaggcccgccatgaaggacgtgctccaggcgatcgacaggatcccgtctccttcctccaactcctccttctccgcgcantgacagtgacgacgtcaattgttccgatcgttccttcctcctctcctccaattggaatnggnattttcngcttgttgatttcttctcggggtgctcgtggtncccttgtnttaacaccatttttttnccccgtctntttcnaaaaagaattggggcctccnaaaaaaa

SEQ ID NO: 82101 - DNA, 168 bp, Triticum aestivum
  unsure (1)..(168): unsure at all n locations
  Clone ID: PAT_TA_82101
cggaagaagcgatcgacaggcgctcgctcgcgaggatgatctaccgcaactggtccctgctctcctccacggtcgtcatctggggcagcgtcggcgccgccggcctcgccgggatcttcctcttcggcggnaaggaaaaattccagnntttttttncccgaagnnggg

SEQ ID NO: 82102 - DNA, 337 bp, Triticum aestivum
  Clone ID: PAT_TA_82102
agaagaaagtaactaagctgctgatgtgattctctccctcttcagcggcccggtactatctgcatttgtgtagtaacgatgtcattatttagctctgatgcatgcatcagtgtaggttgtatgtacccttcacatgggccgttggttgctctgctactatgataggaggaatcgagcgtaattcaagttttttctcatgattttaagtagctagcatggcaatgaaaatgaactgccttgttctctagtgtttactaatattcttattattgagagagctatgttctctaggtttttaattttaagtgagagattcatgttctctaaaaaaaaaaaa

SEQ ID NO: 82103 - DNA, 158 bp, Triticum aestivum
  unsure (1)..(158): unsure at all n locations
  Clone ID: PAT_TA_82103
ccccaatccgagttgcctccttcccctganaatggcggcggtctggatggcgttggcggtgatgctggccgctgctgcnnaggtggcgntggttgcccgggtaacggcccggccttcctctgggtnccaaaaaaatagggttttacccanattgggga

SEQ ID NO: 82104 - DNA, 282 bp, Triticum aestivum
  unsure (1)..(282): unsure at all n locations
  Clone ID: PAT_TA_82104
gacacggcgaagcgctgcctctgcctgtcgcggatggaccggccggccatgtcgaaggtcgtggccaacctcgaggaggcactccaaatgatacgcagccatgagccaatgtccatggcacgctggagcctcattcgacgaagaaccagtgagaattaactacactgggtgtnaaaaactctcttatnccataggatcatagggacatagggaagtaatgcttatnaaagcaanaattaaagcatctgtncaaaanttttgttttttgggttaccaccgaaa

SEQ ID NO: 82105 - DNA, 227 bp, Triticum aestivum
  unsure (1)..(227): unsure at all n locations
  Clone ID: PAT_TA_82105
tccagagcagcccgtgaggagatctggcaagctggggagattgtggctggcaagccctttttgctacaggctaagtttggtgatccgaactatgctcagcttaagcaagtgtggagttctccggacaattttttagacttgccgaagagttctgccgatgcggcgcagttttaccatacgcaacaggggtatgcaacggaaaancttgtcgggacanaatttggcgc

SEQ ID NO: 82106 - DNA, 541 bp, Triticum aestivum
  unsure (1)..(541): unsure at all n locations
  Clone ID: PAT_TA_82106
gcggcgccaagcgccacaggaaggtgctgcgcgacaacatccagggcatcaccaagccggcgatccggaggctcgctcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctangcgtcaatctccgtccgcaacccgtcgcctcctcgccttcagcccaacaacttccgccccgccgtgggctgcagcctgcagacgccgagaaaactgttcatatcttcgttcaatagctgttacccgggaacaatgttgcctgttcaacccatctgtncanccgcnanaatttcncccaattaccttggtaccccatnacccatncngaaattnnaanaatatncncttcccnttnaatgaaccaattcaatggnntgaacaaaaaaaaa

SEQ ID NO: 82107 - DNA, 257 bp, Triticum aestivum
  Clone ID: PAT_TA_82107
ggctgctttgcccggcaatgatcgaaatgcgcatcagtctcgctcggtacggcggaacttcaaccacaagctgtgaatggcaagggttggacctagcaagcctagcatacaagtatggaaccaatattgaggccagatgaactgaatgaaacttgtcaaatcctttctaagagtagcacttcctttttctgaaagttcagatgatcctgtaagccatgaagctgacccagagggtcttcttttccaaaaaaaaaaaa

SEQ ID NO: 82108 - DNA, 498 bp, Triticum aestivum
  unsure (1)..(498): unsure at all n locations
  Clone ID: PAT_TA_82108
aagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccaagtgcaagtgcggcaccagctgcggctgctccctgctgcagctgctagattcatcatccgatnatgcatgcacccgtnccctgccgtgcatcatcgattcgtatcgatttactactaccataccatgttacccgcaaccttgattcnnaaggcctttatgttcgcacctgacctgcatcaacatcaangtgccatgccatgattgttaaacagcccccctaaaataaactcccttggattaactatta

SEQ ID NO: 82109 - DNA, 551 bp, Triticum aestivum
  unsure (1)..(551): unsure at all n locations
  Clone ID: PAT_TA_82109
aggacacggagacacggtggattttccgaacgccacttcctgagcacgaactcagcacaacaccacacacttacaatgatcaccgcagctgcctttatacccgggcaacgctgggctccaacccactcgcacctgcccactcgcgcgctccgatcggcccgctctgcacgccccgcgacgcgctccgcgcgcgcgccctgcgccgagccctcaacgatcacgcgctcccgctgcgctcggatcacgcactgacctagtctacacacacaccccgtgcggtgttcacctgcacggacacgcccatgcaccacacgcacacctacacacactactcgccgcgtgccccgacacgcccgacccggccagtcgcgcccatacacgcgctggtcgtgtccaatgcatcgccgcggtttattaacccaacagtgttgtcctattttgaactggcattaactgaactgtgaaactttttgatcctcggaacatgggctaatttatcaacaaaagactctttcgctgcttcaaattgcaaacaagtatacacaatagtn

SEQ ID NO: 82110 - DNA, 574 bp, Triticum aestivum
  unsure (1)..(574): unsure at all n locations
  Clone ID: PAT_TA_82110
agaattattaagttcaactctaggtgaagtttctctattgtgtgtgtacttgtgtgtaacttagtttgatggaccattcattaagttaagtcgagacagctggctacaagtttgatgtcaggtttcagagctgaaacgttgttttgtcactccaatactctgaactcttcataactagtagtacgaagtttctggctattgggtgtgacacaatcgacaaggaaactggactatttataactaagtacgaagtggagggccagaggtacagaagaagactgggcaatttatgggtgtgacacaatccaacaaggaaactttctgtacgcaacctttccgcacacttgcattgcatgtgacatgttctcccttcanccaatcaaggtgtcttcnantaaacgcaaatnncttatgggtgtgcgttggcttgatgggacccctgggtgatgcctgaaccctgnaagtggtgttanttgcnccngctacatnggacnccctctgttcccnaaatataatccttnganagatcccactatgggccaacatacgggcaaataatggatcnacaccctaa
